United States Patent 6,812,339 (POLYMORPHISMS IN KNOWN GENES ASSOCIATED WITH HUMAN DISEASE, METHODS OF DETECTION AND USES THEREOF) - sequence listing, part 73

SEQ ID NO: 16919 - DNA, 153866 bp, Human
tcaatgttcttcagtacaacagttaaaaatatttaaagaaatgctgagtaagtaggaaaccctcagaagtaagctgaaaatgaacagtctcagtgggcaaataggtctaccatataaaagctctatttgatgattatctattgtaagatcatctttttttttctgtatggaagtaacaaatttaactcagagaaaagttgtattgccaaattcttgaaattaaaccttagtatctggcaacatttttcctcccatggtactagattactagatttttatgttaaatttaattttcttgaattcaaatgtatgagcttgatttctaaaaaacaaacaaacaaaccaaaaaaccaaaaccctcatatggagaaacatgaagttagcatataaacaagaaaagaagaaactttgatctataaatgaagaaaaatgggttttgataagctctctttgacaggtcaccctccttgggcttcagagttataaaaaaatcgatacgtgagattagagatgtgacagtatttctaaatttctgtttccaaccgtttcatgacttttcatttcctctagaaaagacataggatattaatataataagatttgcaatttgttaaatatcaaatgagtcaacaaatatgaagcttcaaggaaaaggtgacaacaggtggtacaagacatctgagctgcagaacaaagatggttgtaaagtgcacagaactgttacaaagccttaagagctactataatccatgattattaaataacaccacatactatttcaattagcatttgccaagcttgctttccttgtcattggattaaaaattatacccggattttcaagtgtattctatttgtgacaatatgcattgataatttctctcctcacactgctgcactctcacctccgttcccagattagctcctggaactcgagatatttttgtggctagagattgctttcttaatgttagattttccttacaattccatatatagtcaagcattccatgcatggtagttaattgtttgcttaatttggcaactgggatattagaattatgtatcattaggcagtgatatttttgtaaggttgtttgctagatagatcctatttcatttatattaagtcttgggaagataaactttatttttccagagcctagcagtgactgacacatattcgaatgaatgaaggtagatagaaaatgtctatattcatttacgtaatgattagttaaggagaaaagtacttcccagcataaagatttctggcaaccctttgcttatttgacttttcccttcaggcaagttcaaggcttgtgaaattcctagaaaggcgaggggagagaacgcgtgacacagaaaggggccggagttcgggaccctacgcagttttgggacgttatgggcatggagggaaatgtttgctttggaggctttgggtaagctagggatccgacaagccctgggcgcagggaggaacgctgccctccggcctccagtcgcgctccccgaagcccagcgccagcgtcgcgcaacctgccgcaggggcggctcccgggccaggcagccaggcgcgccctcgccccacccgggaacgccaggcccgcgcagggaggggcggggctccatggcggccccgccccgccgcccggagggtcacaatgtagggttagggcggccggcgggcggggctctgcgggggaggagccgccgggcgggggcggggatggcgcgtgggggaggggagggaggaggactcgcggagggaggaggacaacgccattccgggcggccgctccctccgtcccctctctcccttccccaaagcagcccgcggaccggcagcaaaggaacgtgcgaacgcgtgacgccgcccgactggctcgcgctctcccgtgccccggcgtcctccgcccgctcatggcccgggccgccgcggacgagcggcgctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaaggtgaggcgagtccgccagccggcgggccccacttctccttccgacgggctgtcctctcccgctgcggccgggcgccccggcctcgccgccgccgccttcccgggcttcctccccggtcacccccggcccctgcccatcgcctcgggggcgtcgcgcccagagcccagctgcgtgtgggaagcagagtgtagtttgcgggcttcaatccacttccttctgccgattgttttcccgtagcagacggtgccaggtattgagagcgaccctcacattcctacagtgctctgtgtggcatcttaatgaaactttattctctccccttaaatgagaaagaatagctagttgtcatcctttctgaaccgattttgtctttcaaaggtagtagtgtaccaggcctgctattttgcaaaacggtctccaccaaaatcgaattacctgcctcgcggggcaggcgtgttgaccaggtggactctagaagtaggtggtttgcttggtttcttttccttttaaggtttccctttcttcttcttcttttctgtttttttttttttttttttttttttcaatatagaaactgtccctaagagaggaaacctttctggccatgttattccaggaatcttttgtcccctaagtttgaccttgttctttcgttcaccctttactcttgcatcagtcacacattcaaatggtcactcactaaagaaaacaattaaaaaactgtttgtgaaactttatatctttaaagtgaatagagatcattctgctattttagattttgctttcagaatcttaagtgcactatcatggcttgcaccatgttctgaagagtagttggccatgatttaacttctttttttaatttttaatttgcgtgaaaagcattttgggcaaaagagtaaaccgtgccttagttgtgttggtattacggggacagttagggtttactgtgatcaaccaccagagttatgtttggtttatctgggtgagtaatgaatgccccaccctgttgtagatttggtgtagattgcaatattctacctgtgcttgactttagaataagacctgttctaaaatgggctgtctacatacagcctgctaaatttttgctttgagattatttttagaattttatgatactgctttaaagtaatcgaagatactcaagtttggaaagcaaggatagtgcattgttattttaggcacgttgggaaagttgtttttgagacttgtatgttagttgatattattggtaaagttagaaggatattgcacactgcactttatttacagtgaaataattcaagatttaataatgagaatttaaaagagtttccttcctaatcctccctattctattttgaataccttcaagttcaatttttaaagacttaaggcttaggaaagagcacatggtcatgtgaacgctaagcaatatttaatatgtatggtaccatttgtttataattgtcttcagtgttgaatattaaagtctgtttcaaagtgagaaataccaatttttcacttcctaagtttgaacaatgggaagaactttgtaagtttaggatttttttattttcatttgattttgactaaactgtattaaataactatgcaggctctattgtatggttcagaggttatgcataaaattgtagaatcaagaatcaagttaacgaaagtgatcttggctgtcgagtccaatttcctactttaatgaatcccctccacacacaaagggagtagtagttaattcaaaatattatcattatgatgctacttttagtatggctgtgttttagatcatttcattgttattggggattttttttagagaaacttttatacttccataatatttagattgttttacagaagaaacacttaaatgtgtttgctttccgtattaatacacgattactttgttactcatattagaactatttaaaaatatttatatggatacaagtaaaccatctacctcgataagttgacagatttaaatccgtcaagctagtaaccaggaagcggacttaaagctggtaactaggaagtgaacttcacacttagaagaaacaaaagtgaaagtctgtttttactcagacactttatgggttatctaaaaggagaggtgtgtagtgtatattgcatagccaacattttagccagttttcttctcaccttaaaaaactgtgtgtacatatgtgtttttaaattttaagtatttactatttaaaatttaagtatttactatttagctatattattttcaagatttttaaaacttttattttgcagatggatgtaagtttttttgttgtttgcagcaccacactacacaaaactttcatgattttttggttcgcctatagaattcattagtctttgtcacaatgtagtatgatgaggcaagaggctgcctttcccttttgatgtgttctttgcttgattgctggagtttggccaacccagggacttatgagatgtagtaaaactgcagaaagctgcttttctgaggtttaggtatttcaggtgaggtgcagttggcagcagatgagttaaattctgtgataattttggttttggacatatatcttcagcctttgtgcttcatgtttaccaaagtgtaggagccttagatctcagaaatttgatacatagattcaagttccaaatgaggatactccacggcgccccccccccccccccccaatctatctaacccgatgaaccaagctaggattctttagggcagttattattgggaggagttttgctcccagggaccaaattaatttacagagtgaaatgaacaggatactatttaattaaatgtatccttctgagttgaataaaatatattgtttcactctagggcttagaacagttctttacacatagtaggactcagcaaatatgtgatgaatgaaataagtgactggtttccaaaaggagtgtagtactttgtttcctaactgaatcttggaatttaaaaattattgagaaacaatgaggctgggcatggtggctcatgctttaatcccagcactttgggaggctgaggtgggaggatcacttgaagccaggagttcaaaaccagcctgggcaacaaaatgacacctgccaggagtggtgtctcaagcctgtaatcccagtactttgggaaggtgaggcaggcggatcacgaggtcaggagttcgagaccagcctgaccaacatggtgaaacccagtctctactactaaaaatacaaaaattagccaggcgtggtggcacatgcctgtaatcccagctactcaggagactgaggcaggagaatcgcttgaactcgggaggcggaggttgcagtgagccgagatcgcgccattgcactccagcctgggcgacagagcaagactccatgtcaaaaaaacaaaaaaccaaaacaaaacaatgaaagcttgaaaaactgtgcgtgctcatgctaggagaataggcagtggtactgaaagacaggatgtgggatagatctcaaccacctttttgtcaccttgggcaagtcattaagtgcttctgaaggttctttcaaagcagtaatattagtatgttaacagtagtatgttaaggctttaaactttagcaacttctttagattagattgtttaatggtcctaagcaagtgttctgtatagggagaataaaaaagaaacagtatagaatggaagcagaggaatctaacagatctacagtcaactttcactgaattcctccaaagatgagggttaggtgggaaggttgtcatagattagccaagttcaagagttaaaacttgaaaaacaatgcagactggattcagggtaaatttcttacttaaaataacatgtattttccaatttaggattatctaaggttataaaactataccatgcagcatttgatagttaacattacttaaatcactttaaatgttacttaaaggaggcattctttattaggaatcagttgattatcttattattagtataagacttgatttgggcagagaggtttccagctgtttattccttttcttattctttccttttcacacctacttttgacttgtagactcacattgtatccagtcttttaaatgaattcacatcatttctaataaatattctgttgattttcttcaatattatatgtatacagtccatatcctttacaaatacttaatattctgacctctttcttgtcattatttttaccacttattactttaagatgacagaatgctactacaatttatgttagtttctattatatattgtttccttataatatggaaattttcttacattcctaagttttataaatgtttcaaaactagatttagatgttgactgtcatgtctttttctttgcagtgaatgatattttatgtcagtaacataagaaccatttgtacatacgatatatgaatatttactatataatccgtgtaaggcgctgtgctgagccttcttacaaacttttttcatttaatctttccaaccaccttatgaagtgagtgctatttttctcctttcttattgaagctgaagaaacagtattggagaactaaagcaacatttcatctctagtatgtattaagggttggataaactcaaaagtcatgtgatacacaagcccctgctcttaaccacaatgttgtatcgttttggctgtccttgaattcctgataaaaccccatttggtcatgttgctttactattttaaatatgtttctatatttaatataataaatttaaacctagaatttggtatacaattggccttctgtatccacaggttctgaatccatagattcaaccagctgtggattgaaaatattctggaaaaaaaaagcattgttgcatctgtactgaacatgtacagtctcattttggtcattattccctaacaatacagtataacaactatttatgtagcatttacattgtgttaggtattataagtaatctagaaatgatttaaagtatgctggaggatgtgtggatgtgtaagttacatgcaagtattataccattttatataagggactttgacattcgcagattttggcctctgggggtcctggaaccagttctccttggattctttaatgagattgcttacaaggtttggtgtgcccatgagggctattaagataaggttagctcataaaatgattagaaggctttctgtgttttcctgtgcttttggaattgtttagtgtaggattatgttgagtcattcaaaattggtggtgtatgatcttttttgatttgaaaaattagatagcgttcaactgaggtacttgttactttgaagatttggtgaacatgactgtatcagggctgagctgctcatttagagcaaattttaggtaaagtttccaaattttgcttattgtcttttaaattttctatcttttctagggtcaaattttaaatttttttagttctagaaaattctaaatttcatttaggtttctgtatttattggtctaaagttttgtcctaaatctgtgtgtgtgtgtgtgtatgtgtgtgtgtgtgtgtgtgtatgtatgtacatatatatatatgtatgtagacatgccattttttttatccctgcttgttttgtcgtcagtagtgtttgccagatgctgatcttatttcctgcttttttttttgagacggggttttgctctctcacccaagctggagtgcaatggtgcaatctcagctcactgcaacttctgcctcccaggttcaagcaattctcctgcctcagccttctgagtagctgggactacaggtgtacaccaccacgcccagctactttttgtaattttactagagagagggtttcatcgtgttggccaggctggtcttaaactcctgaccccgagtgatcagcctgccttgggctcccgaagtactgggcagtttctctttgtatttctaatggattcaatccaaacttgtgtttttgtcttttagaatttaaccatgcacatgtggtgataactgataaatttaatctttttattgtcatctgattatccatttattagtcttgttttctccattcagttttgatggatagaccaaattttcattgtatcaccacccccacccttgtctttaacgttttcttttcaattttggctcttttaattttaaacaaatatatttttataatataaaattttgataatataaaacattaatagcttttttcggtaacataaaaaattaacttttttctccacccatttgccccaaattaggtaagacattttagcatgttttttcttatggtattcctagttttgttgggataatatagaattgtaattctaggtgatgaattttcttagtgttgcagatgcattattagtagctagttttttttaattaactatttaattttaactgtgttttttggtctgttgtataatgctttttgatggtttgatgccactctgctttttttttttttccagataagttaactctctgtgttaccttgtaagattttactctttgtttttaagagttcagaaatttcacttgcgtgtgtttatgtatgtatctttttaatggtcctgcctaggatttttcgtctgaaatctgtgttctcaggaatttttcttccactcttttcctcatcttcatttaaaactacattatttggattttatacgtcacttatctttcttcctggcttcaaatgtttcttctctcccattttgtcctgtatgctgtggtaactttttagtttgattatctagattattatttttgtaatgccagttctgtatttactacccttatatgtggtcagatagtttacaaagagtttgtttttaataatatatatttttagtttggttctgaagtacacataattgaattaattttgccaattttctcatgatcagctcttcctgcaaatatattttcatttatttgttaaattgcttattttaaataataaacacacacgaaccccctatttaaaacaaaagctggaacttcgataataacctatatcccttatcctatccctttactttcatttgagtgtatcatcttgaatcctctgttcatcttcctgttgatttattgcatctatatcaatggctgaaggtattttttttaatgttagttgttttaacttaaaaattttaagaacttttccctgctacaatatctagaaggtagtcgtctgtatttttaaccaagagttttaaagttatatttgcaacattttatactctttttcatctgtgcttgagttttgtatatggtgcgaggtagggatacagttttattttcatcatatacagattgaatctctcatatccaaaatgcttgggaccagaagtgttttggattttggacttttttttttttcccttcagattttggaatatttgtattttgcttacctgggttgggtaaatatccgaaatttgaaaatctgaaatctgaaataagccagtgagcatttcctttcaacatcttgttggttctcagaaaatatggagttttcaaattgtggagcatttcttatttctggcttggagttttgggatgtgcaacctgtaaatgattttaaaaagttcttttgttatccttgctttattgaaaagttaatgctctcttctactgaattgataggccatctttgtcatatatgcaaaagtttaatgcaaaatttttttccctttccttgactttcatcattcattttgtgaatatcatcctgtgttcattgttgttgctttaaaataatctctcatactggaaaagaaagttctttgcctttgttcctttttttcagaagtaacacttgacttttccttagaaattttagaatgatcataccaagctctctcaaatcctctgtctttttgattaatttgattgaatctgtagatccatttgggattattaagatctttatgatacaggatgagcaggatatactatttttattaggtcgtgtttaatatctcttgtatggtttataatttaacacaaaactattgtacatcttttgtttcaggtagttgataatttctgataactgttatatggcagtgcttttaaaaatttgttattggtgtatgcaaatgcagtggtcttttgtatgttaattttatacctagccaccttgctaaatgtttctaataccttttccagagacaattttgtactttctgtgtaaaagatcatatcattaagggaggagaccacgcctcatattgtcttatgcccaatttctgccctcaaagaaagaaaaagtaaaaactaaaaggcagaaatgaaatccacaagcagacagcccagggccacaccctgggcctggtagttaaagatcgacccctgacctaatcagttatgttatctatagattacagacattgcacagacactgtgaaaatcccgatactgttttgttcagatctaattaccggtgcatgcagcccccagtcacataccccctgcttgctcatttgatcatgaccctctcacacgcaccctcttagagttgtgagcccttaaaagggacaggaattgctcaccccgggagctcggctcttgagacaggagtcttgctgatgcccccagccgaataaaccccttcctcctttaactcggttctgaggagttttgtctgcggctcgtcctgctacatcatgattaaaaagttttatgtataatttcagtttttgtgcctgtactttcattttttttcctgtactagcaaatacttccaataaatattgattagaagtgataacaatgagtatttttttgttcttgctgatctaaaaaggcagttacctacttttgtacctcatgcatttctgaaatatttacatgtgttagttgtgcagatttacaaagtaggttctgtttaactaaaagatattgtagtattttcagtcgtgatgcttgcaggtattttttctttgggtactggtgacctttgtttaagctttcaccctaggtatcctgggtgtggtggtggaggggtgctggtagtttgtcagtctcttctctgtcatcctaggaactgtgaagtcaggcagggcactttttttttgtattagtggccctcactaatttccttctccaggggccactccacaattgatttctgccctgatgtgcttagagtaaggtgtctacagggtctttcttcccctgacactggcataattttactctctaatgtcatagaattgctttaagcactgacctgcagcagtggcctgcctttttcctacaatataatcactgatttttgttatgtttgaaggaccaaatttggcttgtgaaagtgagtttaggaatgtcactatataatgtgagcaagtagatgatgtgaaagttgaatttataaaaggatgaggccttgcatttattttggcagactttaattaatttccaaggacatcatccttgtcatgacatcttgttttatgtatgtagtaagtaatttttcagtttttctcttttttgccccttgattaactctgcttcagtacagaccatctgctttatttttagtttttggttctctgaactgctggatattttaaatgcccagcaatattttccttagtcttgttactataggtttagatcagtttcgtataatatggtttttatggactgtcttaattatctgtagtgcttgctaaaagtgcagacttctgtgcctcaccctagacgtattgtttcaagatgttgagggttgggctaaagcctgcttaataagaatcgcagattattcttctgcacttaatgtttgaggatcactggttgaagttaattagtattcttaaaggtaaaagtgccttgagcactgtgtaaattgactgcaggggtcctttagggattgaattatcacaatacaccaaatttaatatggaagcagggtctttgaacggacattgtttttttttgtttcaggtgtttctctccatcagtgcagcaacatgtttccttgtagaggagctgtctcctccctcaggcttttctggccaacatctctatggaaacccaaagcttcaggtggctaggtgggatacttgcccctcttactcctggaggcacaaataagttgaatcgatggattaaggagttggaaagtgattgtacatgctaaagttgtaatcttcctgtttctttctggctgtttttttttttttttttttttttttttttttttggtatgtgcgtgtgtatttgtgtatgaataattcctataggatttttttgtgggggctaaccatagcatatgaaaacttatgtacaacttaaatatattaagattagtattctttgtacaattttagacatgaaatagaatatcttattgtcctggaaatttcctttgttcctcattcatactgtccctcttttctacaccaccccccacccccacactactgctatcttgacttttttcaagttaatgttatcgtggtatgatttacactgaaagtgtgtaatttgatgaatttggccatacagaacatttctgtcactccacaaaatttgtcctgtatcacctttctcattaattatcaacaccgtcattatttcaggcaactgttgatctgatttttattactgtagatcagttttggctgttctgggtcttcacatcgatttgtttataccaaattttttttttttctcgcatctgactgcttttgctcagcaaaaagcttttgagattcacccatgttttattgcatgtatcaatatgtttctttttactatggagtaatattatataaatattctcacatctgtgtattcatgtaccttttgatgtacttttttttttttttccagttttttgacccatatataatgttatgtgtacatttgtaagcaggtctttgagacgtatttctatttctcttgggcaaatacataggtgtagaattgttatagtactaaattgttatccaaattgattgtatcattgtacattctcattagcaatataggagaatttcaggtggtctacatttttgccaacacctggcatttttaatcttttatgttttagccatttggtgaatatgtggtgtacctcattgtggtagtaattgtatatttccctaatgactaatgattttggatgtctttcaagtgcttgttggccagtttgaggatgattttttttaacattgcttctcatacattatccagttttaacactcctacacgataggaatcacagtagctgcattcttccaagtcttaaaatggcaaaaatgtcagagatgtagctaaaggtagaacactccaggaccaagtgctaatatgttcacaaaacaaattgagattgcacaattttttttgtttgcttgtttaaactaacacctgataaaaaggtacattgctgaaaaatgggaactcatttcttcatcatgcctcaaagtaaatattaaatttatctctttaacaattaattgcacacatacatgagaaatctttatgatacatattttattacaccgtgtacaaaaataatttcacattttagttgggttggaagtttgaaaagaacatagtgcagttgcaggggtgggatgaactgtggtgaggtaagtaaattggacagaaattgggcagaaagatacttcctttttttttttttttaacagttttttatctgtctgaagacagggaagaagaggaatctgaattggaaaacccccactatatctgttgggtttttgttgttgctgttcagtctggaaatgggtggtgtgtggtgagaggtcattaggtcatcagggcagaattgtttgcagagctgggagctacatcctcacggaagtgggatagatgtgctggggaggggtgtgcagagaggagccaggaatgatgtaccattagtggccagggcttgttatggtaacaccaatgttgaaaccaactgtgcattcacatatacaaaagttttgtgtcttaattcatgccagaatacatgcataatcaaatgtctcagttaaggtggagctacagaaacactgggctgaatgaagttctggggttttctttgtcttcgtgtgaggcctctgggctgggtctgggtgtctgatcaagaatgccctgaagttttcccatggggctttggagaacggctttggagctgggcagagctgaggatgagcacagaagaaaggaaacgagaaatggtccactacctgaggtttaaaatcctcaatttttggagggaagaagtgacacaagattttatcggtgccacttcaccagcaagaaacctctaaggccagcagtgcctctgcccaggctttgcttacactcactgggctcgctctgcctgctcggcccagcagggtgctctcagctgatccccagcccagatcccacgaccactgccactccgtgctcagcccatggcgggactgggtataccgcatgtggcttccacagctggactccagcattcagatgaggggaacgtggtggaacccagaaactcggagacggcagcaaccgtggagccccaagggggtgtcatagcttctgcctggggagtcccgaggtctgagccaccagggaatgccacagccctctcttgttcctgccgctcacagctccctgaatgggggtgtgttagagcttgtttattcctgctgcgcatggctttgtgaatgggggtgtattatggttctagttcgaggggtcctgatgtttgggcccccagaggggtcgcggctcatcactcccatattccagcaattgggagtgtgtaacagctcttttcatgcccactgcccacagctccaggagccagccaggtgcgtgttacagccgttctttgttcccaccgtttggcgagttctgggtttttgtccagtgaccaagaataatgaggtacgtggacaccagagagtgaggaaggcagagaagaatgttattgagcaacagaaaagctcttgacaatgagaggggacgtgaagtggatagccctctgtgtgagggggccccaaaagctggtagccatctttgcagttgagtccagggtttttttaggtttggaatgaggagatgtgggctggaggtagccttggaaaaggcaacattcaattggtttaaaagcattattcggaaagaaccaattgggaaagagtaggcaaaaagaaaagttttcactccagctgtggactctatctatatctagaacaggcagcttggtaggctttaaactgtctttggtttgaaggtcaggtttcaccagggacctgtccctgcctgcctaggagttggtctactgtggcgcctgcctaggaattggtctactgtggcgcctgcctaggaatttgtctactgtccctgcctgcctgggaatttgtctactgtggctatcagaaacagctctgcgcaggcctcctggggtcagtggacactctctttaccaattttggtagcatcatgcagatttgcagaactggcttctaggcttcttcccaagtgaggcaggaattgaagtcacttagaacagtggaacttacagaactgacagtgtttccattcttgctgggtggcgccaggaggagagcaccagtgtacctgagcatgtcgaactgtagcagagtagctgaaagcagcatataagatgaccctggtcagctctgtggtttctatggtgtaaagtgggtaggggtttcaggcctttggggttacagagatcagagccactccctcaggtcatggggtcctgtgctaggaggtgtggtcctagggctgtgtgaacattggtggggtttgccattactttatttttgtccatcttggtgttggcttaggcaaaccttagggtctgcgtttttttgttgttgttgttatttttgagacaaaggtctcaccgtgtcacccaggctggagtgcagtggtgcaatctggctcactgcaacctctgcctcctgggttcaagtgattgtcatgcctcagcatcccacatagctgggactacaggtacacgccaccaggcctggctaatttttatgacggggttttgccatgttggccaggctggtcttgaactcctgacctcaagtgatcttcctgtctcggcctcctagggtctgcagttttgttgttgttgttgttttggggcagagcttcgttcttgttgcccaggctggagtgcagtggtgtgatctcagctcacggcagcccccacctcccaggttcaagcgattctcctgccccaacctcctgagtagctgggactacaggtgcctgccaccacacccgtctaatttttgtatttttactagagatggggttttccatgttgtccaggcgagtcttgaactcctgacctcaggtgatccacctgcctcagcctcccaaagtgctgggattacaggcgtgagccaccgcaccccgccgggtctgccgcttttgaatgaaagtaaatgctcttccaagcatttcttgcatgagcagaagagtgtgtagaattctctcggtttgctgtctaaagcaagagggctgactgaccactttagggccacggcctccatccccgccacttcccctcccttcccctcccttcccactccttcttttcctgagtgctgatgttgttctgccttaagcttctaagcaggggcatcttttatggtcggggggagggaggtgtgggaggcaggcaggggatgttgcaggagagctactgataacccagggcctctgtcttttccttattgaccatttttatgtcttctttttaacatgttaagattatttcccaatttcttagttgggttatcttcttgctgttgagttgtaggaattctttatattttggttgtcttttatcatgtatatgtaattacaaatactttctcccaatgtgtggcttgtatttgcattttcttaacagtttctttgaagttgaagtattttaatattgattgtttaatttacttttatggttagtactttaaccattttctttttctttttcttttctttttttttttttttttttgtgacggaatttcactcttattgcccaggctggagtgcaatggcatgatctcactcactgcagcctccgcctccctgggttcaagcgattcttctgcctcagcctcctgagtagctgggattacaggcatgcaccaccacgctcagctaatttttgtatttttagtagagacagggtttcaccatgttggccagcctggtctcgaactcgcgacctcaggtgatccgcccgcctcggtctcccaaagtgctgggattacaggcgtgagccaccacgcccggctgctttaaccattttcttgaaacttagtttgtaaattttttctccctgtgttttgttctagaagttttgccattttaggtttacgatccatttggaattcatttctgtgtgtgttctgaggtgtcactaagtcaaggttcatttattgcatgtggaatctagtcccagcacctacttttgaaaaagctgtcctttcatcattgaattatattggtacctttatggaaaattaattgatcatgtatgagtgggtttatttttgaactcagttcctttctatccttatgtggtgccgttctttcttgattactgtggctttgaaatgtgccttgaagtgggtgaatgtaaattcttcaactttgttcttgttagaaatttgttttggctattctagaattttttgtatttccatatacaattctgaggtactttgaacagttggacaaagagccttctggggtttctgagtaggattgtgttggatgtatggattctttctgactgtttggacatctttacagtattttagcctttcaatccaagaacacatatatttctccatttatttaggttttgttttttaacggtttaaaggtctttgcatatcttttgttacagttgacttttttgatgctattgtaagtggtattttttatttttatttttattttttttgagacgcagtctcactttcactgcaaccgccgcctcccaggttcaagcgattctcctgcctcagcctccctagtagctgggactacaggtgtgtgccaccacacccggctaattttttgtatttttagtagagatggagtttcactgtgttatagccaggatagtcttgatctctggacagcatgatccaccagcctcggcctcccaaagtgctgggattacagttgtgagccactgcaccctgccagtggtttttagtttttattccaattgttttttgctggtatatagaatgtggttgatttttctgtatgaagcttgtatctgcgactttgcgaaattcacttattctaataaatgtatttaccacttttattcattttaaaaattgtgctttttggggtattctctaaaatgtttaatagaagtggtaatgacagacatctttgtcttgttcccgattttgtatggaaagcagtcttttactactaagtatggttttagttgttgcacttcttattttgttaaaaatgtgttattgttaatttatacttctagatatactacagcttaaccattctacagttaaactatttgtttatatatctttttatatatttatggtccactgtgattcttttctgtgaaattgacatttgtttctcttgcctgttttttcttttgggctatttatctttttctttatgatttgaggtagttctttatggtttagatactacttttgtttttctatttacaatagtccacgtttactctcatggaatgtgttccaagacccccagtggatgcctgaaactgtggctagtattgaaccatttatagagtatattttgaaagagactacattcacataacatactgtatatgttttcaaaatatttgaaatagtataccatatatagtatggttcagtactatatagaatatagtatatatagttttttcttatctatatatacctgtgataaagtttaatttataaattaggcactatataactatatagtacatatagtttttttcctatatatagtatctacctgtgataaagtttaatttataaattaggtaatttataaattagtagagactaacaacaataactagtaatgaaatagaacaactatgataatataatgttgtgtgaatgtagtctttttcaaaatatccgataactgagatggctgctgactactaagtgggtagtatacacagtgtggatatgttggacaaagggaagattcatgttgtgggtggcatggagtgagatttcattatgcacagcactcagtcagaatagtgcacaatttaaaacatcgtttctggaacttttcatatttttggactacgcttgatcattggtaactgaaacttcaaaaagtgaaacgagataaggggaaactactgtatatgttttgcaaatattttctgttttcacgatgtctttttattctctttatgtactttcatgagtagacatttttatttttaatttagtttcatgtataattagcttcctttaatatttgaacttccatgtcctgtttcacaaagatagtctcatttattgccctctaagtgttttcttaatttgtcttcatgcagggtttaagtttcattccacttgggtttgatttttgcatgttgtttgagtagatgtcagaatttttcccctctggagaaccagcgactttattgaacagttcctccttcccattaatactctgcctgacaacagtatgtatactttttaaattcttcagttgggaccattgtaaagaaaaacaggtgtcaggaactttcgcccttgaattaaaaaatatatttttgagacagagtcttgctctcttgcccaggctggagtgcagtggcataatcatagcctgcttcagcctcaaactcctggacccacactatcctccctcctcagcctcccaagtagctgggactacaggtgtgtaccatccacccagctactttttagttttttttttttttttttttttttttgtagagatggggtctcgctctgtttcccaggctggtcttgaattcctggtgttaagcaaacctttcactttggccttccaaagcattggcattacaggcatgagccactgtgctcagccaaattaaaatatttttattatggttttactgaaacttgtttaaatataaactaggcatacatttattatgttctgttgggtagctcttatgtaataagatgaaaaaccaactactaacttaaaggtaaccaaaactacaaaactggagaaattcagaataaaaaggttagcttaatttgacagatggcagtgttttgcagaagctaatttggcatttgtggcttcaactaaggaaatcggtatatgtatttcaggatattgtaatatgttaagcttttggaagtaaattttatttctgttgtcaactatactgcatttctgacttgatacctaattaataaccattattgtagagtgagtggtatttttggtctttttattgtaaaactgtaacagatatgctctcaagtgtgtttttttttttaatttttttttcttaagctatagctcagtaaatgccgatatttccatgttgaactgaacaggttgtgtgatttaatgtagagcaggatacacttgctgtgaataagaggtaacaattatagcttacctataagttagcgccaaataaatattcatcagaacttgtgagtactttgccttgtgtacatatttgagtgcctgggcaatcaagagagtgacatactatgcagcgtgataactgcttttgtagacattgtgaaatagtattcttatactgaagtaataattgtattctaaatattgctttattgctagtatgtgtttctgcttatctgtgggaattttccaaggtttgtctttgattttctgatttctttgcaagctttacctttgagagattatatattttccgagtcatatatgttcattactatcaagtatgtgtattgaaaataagtgtaatgttacatcttcacataaattctagttttaggttttcaattgcatgtgtacatttctgcttagtcatcactcagtatcatgaccgttcatttatgtattctttgttttaagcagactgagaaatagataacatacaaaaagcttttaaattggtagtggctagagccagaggtgcacagataatattgaaagttaaataaagtatttgtaggtagaactaagaggatctaggaagactaggaaagatcttataaaggaggtaatagctgaaataaactgttgaagatttgtaggcaggtcgaagtgttattccaagtaaagagaagtctatgagcaagggacaaatcttcaatgatttagtgccttctgttatctacacatggttttatttggctgagtgtgatataataataaatatttggtctttttcccttgttcctggcatggagcccctaaagcctttggaatttactctctagtctgtgctaatcagatgagtggcgtgggtctgggtgtttggggaggagaggctgtgtagcttccacttcagggtgggtactctttaccactgtagttagagggtgagaactttcaaccccagtccagcatccggggagggaagaggggctgcagattgagcccaatcaccaatggccaatgatttaatcaattatactttaatgaaatctccagtgccgtgtgtgtgtgtgtgtgtgtgtgtgtgtgtatgtttttttttttttttttttttttccttgagacagagtctcactctgttgcccaggctggtgtgtaggagtgaagtggcacaatcttggttcactgcaacctccgtctccctggttcaagcaattcttctgtcagcctcctgagtaggctggactacaggtgcatgccaccgcgcctggctaatttttgtatttttagtagagatggagtttcaccatattggtcaggctggtcttgatctcctgacctcaggtgatccacccgcgaaaggctcccaaagtgctgggattacaggcatgaacaattgtgcccgaccccttatatccttttaataagtgttcagtaaatagtagttctatgataatgctcagcgtatatggttaactttttcccctaattctttttttttttgagatagagtctcgctctgtcgcctaggctggagtgccgtggcgtgatcacggctcactgcaagctccgcctcccaggttcacaccattctcctacctcagcctccccagtagctgggactacaggtgcccgccaccacgtccggctaattttttgtatttttagtagagatggggtttcaccgtgttagccaggatggtctcaatctcctgaccttgtgatccgtctgcctccgcctccgcctccgcctcccaaagtgcttggattacaggcatgagccaccgcgcctggccctttttttctcttaaaactgtagaattatattattaatacactgttagtatacagaaattgttttcaaggaatttgtttcagggtccagtgaggacaaagaaaggacaaaaagtagaacaaaggagatttggtgtaaagaagtattgactaggaacagatgattggctgctagagggtaaagagaactctaaagtaagaaatgaatttgggagaggcccttcagaagccccaagactctgagagattgggttcttgttggagaggttgtgaatggagcccactggatggcagagcagtttatagaagtgctgtagcttgggacattcctgccagtagctcttttgaagtggtgtagagtatgtgctttatcgtatctagatgaatggagtttccaagagaccataggacatattatataagtaattagcatgaccaaaaactgtatttgctttaaagaattgtgacaaatataactgctaggaattatatagtattccagtttcagagttctacttagagcacgtttattttgttttattagtataagggagtttatttttggattataagctaattaggcaaacaagtacagaaactagagatgcataaagatttaattggacaagagagctataataggaatctgattattagcatcaacaagttaaatacatattttatttaaactgcagacatagtgatttaaggatatgatttgattcataaaagttttgtttacctacttgttttccagaatataggcactctaatttaaaaacagactgtgttccaaaagattttgcaagttgggtttttggaactgaaaatacatgttcccatagaaaccatgtttcctggtggtgtgttcttatttagaaatgtaactctgtgtgaacttagcttatagtgctgagtaacagtattttttgggagaaatacatttagagtttctactcatgatgtatttattttatctactaattaatagggatggggaatactcttttacattgtaattaaaaaaattttttttaagacagagatttgctcttgttgcgcaggttggagtacaatggtgcaatctcagctcactgcaacctccgccttctgggttcaagctattctcctgcctcagcctcccgattacagggattacaggcatgcgccaccacgcctggctaattttgtatttttggtagagatggggtttcaccatgttggtcaggatggtctcgaactcctgacctcaggtgatctgcctgcctcggcctcgcaaagtgttgggattacaggcgtgagccactgcaccctttttttttgagatggagtcgctgttgcccaggctggagtgcagtggcgtgatctcgactcactgcaacctccacctcccgggttcaagcaattctcctgcctcagcctcctgagtagctgggactacaggcgcctgccaccatgcctggctaatttttgtatttttagtagagactgggtttcaccatattggccaggctggtctcgaactcctgaccttgtgatccacccatcttggcctcccaaagtgctgggattacaggcgtgagccactgcacctggcccagatggggaatactcttaagggtcataaacatgatgcagatatggttgaaaggttgggtgacaggtaggaaaaaggactctgtggcaagggaggatggaaaccatcatttatctaggactaactatatccattgttctttgctagctatttctcataaagtatctcatttcttttttctggattgcatgaatgcttaatgttttagctctggaattctataaaaagtaggaagagacttaaaatttagaattcttggcatttttaagctttaatggaaagggtataccttcagatttatgtgcccatagaggtatatgagtaatttattttaatgctaaagtgctgttaatccaaaaagattgagaaaaacttcaatctgtgacagtaggatatgcagcatacctgaaccatttgttacccgccaaaaacttgaaaaccaggattagttgcctggtgagtaataaacaactcttcaagagaatgcaggttttggtcagtaggagttttactacttgtcacaaataaggagaatacttggagtattctttagagcattgttgcctctagggaaagtgacagggaggttttatggggtgatggagaggggagagggtgtgacatcacatgtagaggaggggtcccagtggtgcaaatgcagtgagtcactatgtcagcaggtaggtcacgtgttatggtaatgaagctgtagttcccccccagggtgctgactttagcatgataatgaggaaagttcacttgggttcatctgcatgttgcgagggtctgtcaggagctggctccaactgactaggtgagagctcattcctcacagggtttgggaaaaaacaggtggcaaggtaggaggttgtaaacaggccagttacttaagttgattaaattcctatagtcccgggggaccctccttgtctgcttacacattcatgggactgtcatatagattatttgcaatagggaatttcagtaatattatattttatacaaaccttcaagtgagattgacaggaccagaactgggaaattctagatggaatgtaggagtgtagaaagtttgcttagtaagtgggcctgacttatgtcatttagaagaattcttcaatttagaagaattagaaaatgtgcttattagttggcctgatatatgtatgcttctcgttcctgtatgagagggaaaaaaaaaaaaaggcttctctttacctttctaagttctttggctggactagaaattaaattgacaagaggcagattaacaggagaaaacccattttaattacataggtacttacaggagtcccacaaaataagagacttgaagaagggtcacatgattgaagcttatgtagcatccagagctacaaaaagtgataggggtttggggcttctgggaggggtggcaacacaagttatgagagggtgggggaggaaatgtatggtgaataaagggtgtcttgtgtagataaaaagtcactcaagtaataaaagttgttgcaaccctcttgctgatacagatactttttctaatgtagatttcctttaaaaatggattttttttcacaaaaggacagtttttcaaggttactcttgtgtccgcagtttctcaaaataactacctcaaaatatgccaaagaagtatatttttgggtggcatattctagtcgcctgcagtcttatttggaggtggtgtgtcctgagccccagcattcccatctccaataattagttagtgcctcttttctgtgggataagcttgtcttgtgatatggcttgttccagctcacatctgcaggctctgctgtattcatttattcagtcaatgttgattgcttgccatgtgccaggcattatatgtatgtaccaggagtacagtgatgaacgaattatggtctcattgataactttgaaatgattaacatttggtgcctagcagtgctttagtgcacgtgcttctgaagtttaagagttcttgtcgtctttggatttaccttgtgattaaccatagtgtattattataatttgtggtgagtctcacagaaggcacctacatgtgcagagacctttgcattatgaaggagaatggtgttctgtagaccctgaatgaaagagagggaagaggaatgccagggggaaagcaaagcaagttagtgctggggacagaggtagggactctagcatgcagaggtcctttaagctgtgaggactatactataggaaaattcctcagacaagtcatagaatattacagttgagggaaatgaaagatccggcttacacattaacaagaaaaacatgactcaggagattttttcttcttctttgctttctggctatttagagactggtttggacttacaaacatgaaggatgtgttatgtacttgaaattcttggacagtgagtattagaggtttcttatggtaagagaacatgagctagagcagtgtagtgttagcaggtagatgcagaggtttttgcaaaatcaggtgtgtgtgtgattactcactttaaagacagtataatgaattaatcttgtcattgacaggtaactttgaaatgcctacatttggtgcttagcagtgcgtgtgattctgaagtttaagaatgtctttggagtttctatcagttttttttttttcctctgttcttagaaaatttggaaggtttttttagaggtcattctaagagttgcgccccccgccttacacctatccccaaggatggaaacctttgactttcttttcctgaaccaagtttcatttatatttggaaatttagctgaaggagccaaggactgacttaatgagtcacccaccgcttaacacaaactgtttttctcctttgttgtcagtggtgctttagttttcttttaccattttataagtattttacatcaacataatagtggatttttgcactgagttttcattttttattgaatctttaatctccaatgttagatatcctagagttgagaaaatatggcaaggacatggaatttgaacgaccaagtttcaaccctgtctctgcacttactaatgtcttgaagtctgtgttagctatgaaatgagagtaactttctagagggtgtgtgggtatgtctgtattaaatgagagtatatattggaaacattggaaacagtctggtatagggaagtttaaaccttcactctgaaagttcgattaattgagtgctgaaataaactgacagtaaacagattagcaagagaaagtgcatacaaatttattgacatggaagcatgggtgggagctacaaaaaaaatatgaggctctaaaaagggccagatgattgaagcctgaatcccctcttcataaagggagaagtggaggatgcaggcaattttagaggaagagtaaatgatttcaaggggagatgagtgtgcctgaagagcagacaatgacctggaacaaaattcttccgggctctgggagagatggtggcaattttttgggaaggtgaggggcagaactgtactgcaaacaaaagttgtctttgttatatagataaagtctctgaggtaagaaatagcccttagaagaatagtcaaaagaataggtgaaaagtctgtctgggtatggtatgcccaggtgcatggcaatttttagttttctttcctgctataggagttaatcttctctggtttatatagattccagggaattatccaagacaatttcgttccttctggatgaacgtccctcagtcagataagggaacttcagagaaaacctctccctgtgctttggaagggaaaacggggaggcaggagaatgttggagagagaccttgcttctgagtcctttcaattgcttttgttcagagcactcagcaagccagaatgccatactttggggcattgttttcgtaacctcaacattgatatacagcaagagtataataaattcatattttcttgccttgtcttgggccagtgatccctttttttgcatcctcaaaaagttatactgatgttaaatatgccctctttactgaaacagattttaaaaatacccagcattaagtggggtcacctgagaagggaaagaatttctatgaaactctcaggtttttaatttatattgaaattaccaatatttccttatatctgaagtgcatagtactgtattttgcacatagtagacacttaaggatgttattgtgcagtaaaaataacaggaaggaatctgaagacttgtaggtaatcttgacttctttgcttattaatttttgtggtgtttgcaagtaactgaatctctttggacgttgcatcttgcccctttggtttagcagtgggaagaggttgaacccacctccctgtacttaactagagaaaaaaaatccatacaaggagcatctcagagcccagaagaggagctctagatatggaagtggattggatgggaaccaccttggatttggaattgctggtcagggagaggaccatatttaggacatttccagttgaggatcagggcgtatcacaggtcagaagtttcataaatgggaaggtacaaaccttgaaaaacagactagggtcttaatcacaacagaaatggcaacaaaacccccacataattgcaggaaatgaaggttcagggtttcaaatacaggaaaaacacaactggaagatgccagtaacaaagggaaaaaaactttgcaaatgaggtggcttctctaacttaaacttaggatttttctcattgctcacctcttcccatttctctctacctaggtttagctaagaaaattctttcactttttttgttttcttttccacctggccttctccccgatcaccagttcttttcattgtttcattttcagtcaagatttatgaaaacatgaaccatactagagatacacctgatttttttctaggatatttgtctgaatttatagtaaaagataaaacagcaaaataacagtttcaaagaccttgctcttctccataatatactcagtattcttattgcactttatcaaaccaccataacaaaccacctcaaaacccagtggcataccaaaatattgtcactcacactcacagatttgctggttggctgggttgacttttttcacatgtgcctcattcttcttaggcaagtgggctaccaagtcatgttcttcttaagcaggttgcagaagttcaactgggctagcccagcgatgcaggtagtttcatgtctgcttgcatgctggctgctaacatgccattggtcaaatcccatcatccatgacaaaaggaaatacatcatgtgtgaggaagtaaaagtggcaaagagtatgaatacagggatgggagaattgggaggctagcataggcagtgtaatcttttctgggatttatattcgtgtttgtattttactttgtggttattaatttgtgtatatactattttgtattctgctttagcgtaatgtgattttgtaaggaaaacttctgtatagattatatatttttcacttaaatagttgtatgtgtaactgagactctgcttctaagttgatctgcatcaaaatcatttgaagtgcttattaaaatgccgatccctagaccttaacccagaccctctggaatcaatctctggggatgaggcctggacatcttcattattagcaaactcatggagtcatccttctgtacattaaagtttgagaactactttcttaatggaaggacatgcatttgtattagtctgttctcacgctgctataaggacatacctgagactgagtgatatggttagcctttgtgtccccaaccaaatctcatcttgaattgtagttcccataatccccatgtgtcatgggagggaccaggtggaaataattgaatcatgggggcagtttcccccatcctgttctcatgatagtgaataagtgtcacaagatctgatgattttataaagagcagttcccctgaagatgctctcttgcctgccaccatgtaagatgtgcctttgcccctccttcaccttcagccgtgattgtgaggccttcccagccatgtggaaccatgattctgttaaatctctttcctttataaattacccagtgtattagtctgttctcatgctgctaataaagacatacctgggactgggtaatttataaagaaaaagatatttaatagactcacagttccacattgtcagaggcctgacaatcatggcagaagggaaaggagaagcaacggtgcatcttacatggtggcaggcaagagagcatgtgcaggggaactttccttcacaaaaccatcagatctcataacccttaactcactatcacaagaacagcatgggaaaaacccgcccccatgattcaattaccttctaccaggtccctcccatgacacatgaggattatgggagctacaactcaatgtgaaatttgggtggggacacagccatttttaaatttttataattaatggccatcaacatttgtacaaatgactgatttccttgggtactaagtaatttttctctgagccatgattgaataattttcagttgaggaaaataatactttatatatgaaatcagatttggagtgctggtagcagtgacattacagacttataaaaattataaaggattttatattaactaaatgaagacattgaattgaataaagataatttctgtaaaacttttatgcctttaattcgtaatgttgggtattgcatggcttattcatgattccattgctatttattagtaattttctaaatgaaagtagtataaaccaaaaagtatcttaagacaagtctcaatcaatttagaaagtttattttgccagggttaagtacgtgcctgtgacacagcctcaggatgtcctgacaacatgtgtctaaggtggttggggtacagcttgcttttatacattttaaggatacataatatatcagtcaattcatgtaagattcacattggttcaatctggaagggagggacaactcaaggtctggtcacagggtggcttccaggtcatcggtagatttgaatatattctgattggcaattggttgagttattatcaatagaaaggaatgtctgggttaagataaggagttgtggagacctaggttttatcatgcaaatgaagcctccaagttgcaggctttagagagagtagactgataatgtttcttaccagacttaaggtctgtgtttatgttaatgctggagaggtatactgaggcatgtctaccccccacttccagtcatggcctgaaccagtctttcaggttaaattttagagtgccttgaagcttcagattttgtttttggtttacggtataaaaactgataggtttaaagataattttatttttctcaattcggctctgtaaatttggcagtttattcatccattttgatacttcctggcattttatatgactttgtttgtgtactttattatgtattttatttttaggtagcttggttatctcagctctgtaaaaccatttttatggaagtgaaattctttggtggcatggcagacactgccaatgcctatccaatgaacattcttttctttttgatagcagaaccctgatttcattttcacagcagcctttgcccacccaaaaaattcatttcccaatctcctttgcagctatgagtggccatgcaactgtgttgtgctttgtgaggcttttgtaagtggaagtttgtaggtggggcttgttaaagaagtctcattcatttgggagacaccttttgtcctttgcccttctctttatcctacctagaacttggacaggatgatggaggaggagaccatgcagtgacaaacattctgatgcatgttccactttaaagacttgatgttgggtgtccctactaggtctggactgcccattgtgtcttctaagttagaaaagaaagacactccagagtattgaagctgctgtttagttgggaatctgttacatgtagctgaatatagtttctatctaatacatatgatttctgtaaaagatacttgggctgcaatatctcttaaacctttcatgtaatttgtttaggactttttagacttctgaaaatacatattttatacataaattgtcaagcatgttttgaaatgcacattttacaatttgatgtcaacaaagctgaatgcagaacattttaaaactttttattttgaaatttcaaatttaaagttgcaagacttagtacacagaacttccataactttttttctccccaaaccatttgatagtaagttgcaggcatcatgcccctttagcacttaaattcttcaggatatatttcctaataaaaaagatactctcttactatactggagttatcaaattcaagaatttaatattaatgaaatgtcattactaagctgtgcatatttatatttctccggttgtctcaatatcctgcataacatttggtatgggatgcagtcagttccccctttggctcacatgcttctttagtctcctttagggtggagacttcacctgcttttcatggcatagacatttttgaagatgatagaataattatttttcacagtgtccttcagtttgggtttgtgtgatgcttcctcaagattagatttcggttgtgcattttcggcagggctatctcacagattatagagtgtcaggaggcacgcactgccattttatcctattattggtaatactaactttgatctcttggttaaggcagtgactgtcagggtttacactgttgttacagtaggtagctagtcagacatgagcagggcagaagggggcctcccccccaggaatgtcaggcaaccattaggcggtggtcaggctgttattaaccatctctctgaaataataattggtcgcagccggtgccagggaaaggcagtctcccaatagatagaaacacctgaaactggtgattagcaacttcctgataagattccaggatttgagtgaatgggctcaagcatatatgcactaagaggcaaaacggtggagtttaactgacatatgacctttgtttaggaacacccaactggtaagggaaaaacgccttaagtgagcacatgcacaatttcagtaaacacactgtgcgtgcagcccctccccagtgctggcaggccactgcacctgtggacagccatcctgtaggaagaatcaggggagaagaaatgcaaaccctggaagcatgccagtgtataaaaccccaagtcaaaggtcagctgttcacttgatctttcaagttgcccgcttggcccccttccaagtgtactttacttcctttcattcctgctctaaagctttttaataaactttcactcctgctctaaaaacttgccttgatgtctctctctgccctatgcgccttggtcaaattccttctgaggaagcaggaagtgagcttgctgtagacctgtacgggttcgccactgttaacacaataaagttattctttctccctttataatttgtggaagagaatttaaaatgatgtaaatattctgttcctgatcaaactttcattcagtagttttatcatccattgaagattcctgactgaattattgctgagataaatgtgaaacatctttttaaaaaagatttcaatagatcctattctattgactaggtttgcttttcctatcatatccattgtgattttttatttcatggtactgttctatagtgttgggaacttcaagaaatacagagatgtaaggaggaagttggtttttatttaagggccatcaggggagagtttgatagtgaaatcctatctctctacctcttttcccttccagtacaatgcagtcaattttataggccaatagcatataaagaactgaagcaaatgggggcaaatgatctattcaatttagaatcttttatgacagattggacagtgaaatgatcttctttttaaagtagatctgaagatctccgtggtataattacccaccgagttatgtcttgccgaaagcatgtcttttccaaaggtgtttctctccttgtgcttaccatcatggataaggccccttttcttgttaggtggcataaatgaggggatgaagaaaaggacagaaactgctaattcagtaagacttattggggagtaatgtagagaagttaccttttcgaaacgtgagaatgaaataagggttctccacagcatgattcattctttctaaaagaatgaagttgtttggcctttctcaagttctttttccttttttactctagtttactttattctgttttttgtttgttttggaaaaccaaaggtgatttgttttcttttcctagtatattttcagagttgagaatataatgattttgggtttttcctccctctagcaccagcagacgtttttgaatcaactgagagaaattacggggattaatgacacccagatactacagcaagccttgaaggtatggcctctgttttatgatatacagtttgtggtatatgctcatctctagtgcgtattatatttgatagttgattttttttttggggtataccatgtggtagttttagagatacaggaatggactttgtaaagtaaaatcctcagttaacacactgcggttttgaggatgttagctttcagcagtctgatgtccatgataccttagagtgacagataacctctttctatatatgaaatgctttttgtgcaagatagtgggatgtgaatcctaattctaatggatggttttacttacgagctgtgattttagagtttaaatgagggttcaaggtggggtgtattagaggatgaggtgtaagagaagggaaaagtagaaaattaatagaagtctgaaaacttacatttttcttctcctgagaagcagagatataaatttgcacccattcagctaattacaccctaagttaaacattcgatttcaaactcttcagtataggcaacaactaaaatgtatcattttggtcatatcttagttggaccttcagtttcacatcgacatccaaatgagtcatatcatatggatactcacattgaaaaagagtgaatgaaagctatttaagaaccagaactgtacagtattttaagcttatttgcatattactactataggctaaaaacaatatagcatttttgccactgcagtcatatacacagctccaatcctttggaacttgatttcaagcctagagttctttatttgtttttagaaataatctattagatgattataataaaagtcattataacaataagtagtaccgattaaacatttagtactaccaggcagtattttaagtactgtatgtgggctagctcatcctaataataaataactctatgagataagtattagtttcatcccctttatgaaaagatgagcaacagagaggttaaagtaacttgcccaggatcacacagcctgtatgtggagaagcttggaatagaaaccaaggcagcctgatcccaggtgccacacttaatttatgcttcttttactagaagctttgcttcaccttattcccccatcaggaaaatcatgaaatagtagtgtttagagcattaatgcggggtgtatgaagccactgtaagtatttggagaggaagcagaagtgctatacctcaatttttatgattatgacgtttagataattgctagtccctttttattctgataaatatcattactaaattccatgtttgttttcagaaactgcctttttcattatgtattactgagtgtgagaccatagcctatcaccttgccagggtaaatttggggaatttgcttttttttttttttttaaacttagaaaatatgtagctcgaatgaagtcttatccacatttcctttgatagaggttgtgtgagcataggtatttttaattttccaaaatttttgtttcagttaccagtagctaggggaaaagagtgtatttaaaccttaattgttgcccattataaatactgacgagaagtctacttttgagcactgtaatgtcattgattaatttcagtacttttaatttgagaacatatttttagctctaaaaagtaaatgaacttcaatttgtgtaaattcctgctgtgttgttttaaattattatatgaggtaatatatgaaaaacacttagcacatttcttggcatatagtaagtgctcaataaatgttagccatcattattgcgctttattttattgttagattacttatttaacaatagtgtatcttacattttggatgagtcacttaggaatcgtctaatgatcatgacagatagcatttttgaaagtggtggtgcctttgaaactgcatccttactccttttgtcactgactgctacaactggaattggggtaggtcttggggactttattctgccagctgctcagtccttaaattttggaatcatcctgatcctacttctgtcatgtcccacatttaataagatagcaataatattggatgctgtcttctgccctttctctcctctagtctattcttaatacatggagtaaactttttaaaatgtaagtcatactatgtcattcctttccaaaacactccactggcttcttattacacccgtgtgcatgtctaagttcttagggaacctacagagccttccatgttttggttttctgttacaaagatagcttcgttgtgaatatctgggtttcctatgttgttttggttaactgttttagagctaacgttttacttgctgtcagttgtgcagagaatataaagatgtaactgggcaagtctcttctcattttgctgttttaaattaaaattcttattctggcatctgctttcttctaaataaactttagaataattttattcagctatacttttgatgagaactatgcaaaatgtatctatttaatttgagcaggattgtcatcttgacagtattgagtatttctgtctagagttctatgtgtctttccataattccatattatcaagcccttcagtacattttgccattttcttcccatgagtccttgacattttgcttaagtttgcccctaagtatgtatccagcacccagattaaaaggaatatcttttattgtccttgtttgtagaagtactaattttaatacccattttgcactctttcgtatggcaagttccagaagaccttttttagtttatttgttcaaaagtataagtttgtgattcacttttattaagcagataggaaagtaatgaagactaagaaattagagatggatttttacattgtatcagtagttttaattagtaagaaaggtattactattgatatagtatactttatgtatgatgcatttacactataaaattagaatcacatatagattaattgcaaatttaaagcaattttgttctagagagttatggagaatattgtataactttttttgatggataaaattatttcaaaacacttgatactcctttcttgatatttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaagtaagttttctttcttttcttattattttaatagaaacatactgaaaaacttttcttggtgtaatatattaatgttgcttaaggagaggtaaagaaccaaaaaagaactctattaaccttggttctttttaatgtagttgaaaggaacatacattatctttttcagattataaggaaaagattttatgtaagttatatagtttttcatagagcatttcatatagaatttattgttttgaaatatggaatagctgcagatatattcataaaaggaagaactagaatttttagtgggcacagttattttgcagattttaagtgctggtagaggctttagtatttcttttgaggttaaagtattatttctaattactgataggtttaccatttaataaaatttcccttccctttccccctgcttccaaataaagctttggcaaagaagtttattattgtgtaatgaaattgcctttcatccaaaagaaaaaaagaaaagaaaacttggaaaaagtgttttggagatacaaatacgtacatgtggaagattctatgtgggacttaagtttttcttcataatatgaatactttatacttatgtagcgcacagtttttcaaactatgttcagttaccttcatatctcattatagtttaataattgtactacataaaaatagttacttttatgccttatggatttgcaaagtttgattattaacatatatttggagagaatttcttattttgtttatagacattctcaaagttaggaagcaaccagaaaagagttcgtttacatagatgtttattaatgtttattgataaaatattttaatttttagttttcaggataatcttagcatttttgctacatagatgatcttgtgtcagagaaaactagaatactcctgtctcacttagttaataggtgatgggagaatgtttgtagcatatataagatagacctgtttacttaacgtctaagttcaaggcaagctgtgactgggcccccatccacatttctagcctcattttccactgttttcctcctgtcattcaacactgtgataatacagaatggcttgaagttctcatgtactcagtggtatttaatttctctgtctttacatttgctgttccttctgtttgaatgcactctggccttttcctccctagcctaatttgttctggtcttgaaagatttagctaaagagctgcttgctggagaatgtttttcctggcctctagctaggaccaagtgtttctccagcatccagggcatgcttctgtcttaatgaatactctgttattttgaaattatttgcttgaacattattggtgctcaaaaaatgttcactgagttatgtttgataatatgtgcagtaaagctctttcaaaaccaatgaaagggaatgaagttgagaagcttgttgcaaaaagttgaaagagaagtggtataaaggtcagaaaaatgagtacttaataatattttggatatttcaaagttccaagactcgaggggaaaaagaaactagatgggtgataaaagggaaaaggataattttgactaaaatgctcctggtttaagtgaagcaagcaggaaattgactaaacagagatcattgttgttagttgtgaactcttaatatagatggtatacttggtgacatgacatggtatatttatagaaaaggggaaaattaggattatgtgtgtcctgcacaaaagaagatatttgctgtgcaaagtgagaaaatactgcataaggcaaatggttacacctgtttacgattttagatagggaatagtgaaaatattatggaggacaaaaaaaaattttgaataggttcccttagggagaaggcagcctaatttcaggaggcacgtgtctcatttgctgataattaaaactttttttgtgtgtttgtggatctcttgaaaaatattcacgaggtaattttattttccacttgaaataatgtagagaaatgaagtttctgatgtcatctcaaccgattgtcatattgagtaaattgcttgctgttgtggtttctttatccataaaacacataatacgtaatatgtatcaagtgctttccctctaatcagggtgccaattgagatagtgtgtccataaagttggttagaggttattgacagcaaacagttgtaggaatttaatgtggcaattgtactatgatagtatcaaaccagaaaaaaattaactgttggcgtaacagtaatacttttccattaaacattcctgccagtagtgtcataatgcagtgttactggtttaaaactgagaaagtggggagatgtcatgcatttcagcaggtattaaaaaaatactctttaagtgactgtgcagttactgttgagaagaaatgaagtcgtgtatttttaattcttggaagatgtggtaaaacatgagggaaggaaagacaaaataattacaaatggatatacattcaaatgcaggcctctatttaaaaaaatctacctaactgctgtaggaatgtagaagaatagatcagagtgtgagttttcaagggattgttgtagatataaaaaccctttttgagcactttctccattttgtgtgaaatacattgttatttaaaggttgaccacagtttcacttaattctttcaaatatggcagggatttttattttcagtttttttccattcttctttttgaggtataaaatctcttaaaaccagggctaaagcagaaacaaagtcatgctaactttaagtgatacacttggttgcagtgctgacaaaacgtctgtcttctgaaatcgaaatctctaataccaaatacatatacctctttgttgatattagctggaatatcactgtttacaatggactgtttcttttagaaggaataaattttttttttgctgactagaaaaatttagtttttaaactaatatcacatggaagttatatttggggcatatggagaaatttttgtttatgcatacctggtgtgtcagaggctaaactatattatgtcactggatttgaaaaacaatttgtgagccttcctttaatattgaagaagtaaatatattttcaatagttagtaggacaattatatgcctttttggtgtactttttacctttcacttttgagagaaaaaggagacatatcaaagaaatcttgtgctctgcataaaaaagaatttagaagtcgtacacctcatgtctttacttgattacattccatactgtaattctgttgaattctggaaaaaagcccaaatcatttgtactataattagcaaacgtactaggtaacattttttattatttggacctctgttcagatcagatcaaatattatagattgtcaaatgagtgcctgttgtccctggcttaaattgagaataaaattgttttggagttttgctgtcaaaaacacaaatgaaaatgagaccaggacacgatacccggtattgagcattataggtgtgattaatagtcagaggagagattctgccaagtttttgtgtcacggcaaactctgtcatagacatgaccatacagctcttttgcccaatttgaagtctaatagtaatactttttattttgtgaccattaaattctttcgaacatttttaaaacaggaaaaaaacagtatatgctctccagaacaagatgtgctacaattgagcgatcaaaagataagagggatttgggtaggtaattttaacacagaaagtaatgccacatattgactcaagttttagagaaattggtataagacttgaaatgagtgacaggtggtaagactcttcaaaaatttataagccgttttttttttctttttttctaaaacaccttgaatttgaaaagatggcatagaaagggagaaaaaccttgaggttctatcctagaattctagttatggctatcttgcttggccacagtaatagtgatttaaactgtgataaatagatccaattctagtgcttttattcttaggataattctcttatgctaaacagtttaggatattgttaattgaacactgatacttttcccattgcccaagtaacttcagtttttccctagaaatttctaatatgtaaaacgatttttgatgactcacagaaagtcaagatgaagcctaaaaactgagatgctaaatggtgtgaaaattagttccaactgatgggtgcaattaggagcttcagattgattagatgcattttattagatatgaactgtagaatgacttgtataacttgatgaattttctttagttttgggttagaatgatagccatggtctttgtacttttgttgactaacatgggagattaattttactttttttcacaataaaaattgaaaaacatagtagaattaatgacaaaactctggaatgactcccttactacttactcattttccttgcttaccactgctgccactgtgattttagcagctattattaaaaacagaactagaccatttaaagctgagctgttcaatatagttgccactagtcacacatggcaattaaaatgaaataatattgaaattcagtttctcagttgcactttaaatgtttaattctggtggctaccagatcagtgcacataatgctacatttccattatcacagaaagttctaatttacaacactcttttaagagaatctgagtttaacagtgagaatattgaaagaataggaacatctgaaggaagctgaaagcaagggaaaatgggagagtggagtgggaaacaatttatattgtttatgtcttctggcttttaagattcttgcaacatgataccttactatgctgtctgccctttcacttgaaaaaattttgaatatataaaagatatgttctcatcttctaattagtgccattatgaagatgactcaccagtttttatctctattctgtatttctttaacaaatatttattgtctaatatgtagcaagtacttttatagaccattaagaaagcatgcagagcctcagtttacatagaggaaagacagtacacagtaaacaaacagtatcagatagtaataagtcgttcatgaagaacagtagacctggatatagacaaagaagtgatgggggtgtgcttgtgggctgggcataggataatatgtgattttaggtagtgtggaagagctcatatttgaggaacagtagacctggacatagacaaacaagtgatgggggtgtgcttgtgggctgggcataggataatatgtgattttaggtagtgtggaagagctcgtatttgtacagatacctgagcgaagtgtgagcatgaacttttggctctctgaaggttgtgcgtcccagaccagggcctgatggggcagtgtgctggccctcgagatgaatagtgaggacacagccttgttgaagctgaatgagcgagggtaggaatggcagtattctcgtttctgatctcttgctgcacatcctgatgttcatatttgcctttctttcttaagggtatttccattcttctggtggtccagggtattttttttttctttttttttccttttaatagctcttctgtcaatctcccaaaacaaccatttggtttgcagatctgtcagtttttgtatgtagacttttcccttcagttactcctgccctgctacatattcttattgcaacgcttctcaaactcttcactacccagtttttttctgtcttgcactcccttgcttagaaatctttgctgacagtaaatataaacttggcttattttttttaaaaaaagtatttcctcttggtttagcctgtgtagataaggaaaaacaatggaagaactctttttttcttctgaattcaaaatatttacatatataatagttcagctagattatgggccaactaggcttttgtgaacttacttagaaacctgaggttcaagtaagattcacttacataattcacgttcctatttaatataatattttcatgggaaagtgaattatgagttataaacaatgcatatattttgtttgaagtctagttcattgataagttgatgactagcatatattttggagttagcagagaaatgtttggtagttggtgtataagttttactcatggtattcctttgtaagtgaaagatttagtaggatgagtatcacgttttgatatatatttctcactttacaggaaaaatgttttaatttggactctcataaaaatgtagattactgcttagatgcatttgtaacatgattttatacagtggcacccagctaactgttcccatgtgtgtgctgttgaattgtattcacgctaatactagagggagagttggttaaaaataatgtttttagtgttttaccaaggtcttgccttgacacagatatgagaatattaataatgctctggcattgagatggaagttttacaaaggctaattttctgtaactgacttttaccagttagaagttgtttatagccaaagttattctgtttcttttgtaagcatgtgagaatatctgagcgctagtttttattataaattgataattcgttacatgttttacacaaatcattattccactaagtccagaaaaagaataaattgggtttaaccagtctgttgaaataacattttattttcttttactggtcttaaaatcatgtgaatttggtatgtgaggtatctttcaggattgcatttgatatgtgaggcatctttcaggattgtatgtgtggaccgtatgtgagggatctttcaggattcagctatctttcaggattgtcatattgttctaaaataccctgtgaaaagaagcagttttatggattaataggaagatcatggaagaaaattgttacaattacaatgaaattaaaataataagtaaacctcctccattgcttaaaggaaaaagtcccagcttttcagttaaggattgttagtctctggtctcaaccaacttttccagcattaaggactactattcctctataccagggattggaggctcaaattcccagctggggtacaggtgtgcctatatgctgaaccctccgctattggagatgcctggagtggctggagccatttaatatggtcgttctagccacaagcagctttatccttttacacccatgtgaggtacaagatatgcgaggatgcaagggcaaggaaggtaatgtgaatgtgtgtggctggccaagttgggggcgggggcaaaatgaagagtgaatattctatctaaagagagctgctactactacttttattacactctggctttgtcacaatgattattgccatgcaggaatcgtgtaaccaggtcttctggtttttttttttcctcccagagcgtgagggaagtaatacctattattgtacacatacaatctcctaatctttatcttttgccagttatttcaaaaaattttgaatgacattgtaaaaaccaaagaaaaccattttcaattatgatttgtttcataaaaaacatgtctaagaacatggagtagatggtgattcttgttatttttgctctcaggacccctttacactcataaaaattattgagaacctcagagcttttgggtacataaaatttactattttagaaattaaaacggagaaaagcttaggctattagttcatattaaaatgtcagtctattatgtttgaataacatattttatgaaaaacacatttgctgaaacaaaatggttagaagattacgttgctttacattgttgcaagtcttgaatgtctgccatattagaggagaactagagtctccaatgtgcttctgaaggtttgcattctattgcaataagttgttttggttgaagtttgtgaagaaaatctggctttacccagataataatttagaaaagggaggagtattttaactgataatcagataataatggatattctttttaatgctatacccaaacttaacagatggtaatttcttaaagattagttgcaatgtggaattcgaaatcacatcagttattctatggtggtatcaacaaccttttcatgttatgttgcattaaaatccattagtgtttcttgctttttggatggatcttttacccatgcatgagtttgtaacactgtgcattggtaatttgaaaagatttctttttaaatgcttgaagaatgtctactataagaaaaagttgaatttgttaatatcaccactcatatacaagcctttaagtattgagaagatatcaagctcacagtggtagaaacaagtttttcaaagtttagatttttgcttgaaaattccatattaatcattgtcaacagatacatttgttttccttaaagcaacaggctcacttttttttttccagacaacatctgccaaatactgaagtctgaataattctagtttgtagtttgttagtttttcttttaaataaaaattgcattccatgggaaaaatcagtttagcttgtaactcattttacactagttgttagcaacagcatactctggatatatcgcagaagtactttatgtgtacttcttatgttagaattaaacataaatcaaggtttgaggtttaataaaattaggtttaatcttttcgccaagaacataattctaaaagaaactggcttggcttctgtttaaaacagtgagtgtgtatatttgtgactaatacaatgaattatgcaacttggtgctgctgccttgatttgtgctaagatgcagcagttttattcaatatcgttttgcatcattggtgcaaatgtggctacagtacaaaaggcaaataatatctgagtagtattatttttttatttaaggactttcctcccttttttcaaaggggccctggggaccccaaggatcaatggaccatatttgaagaactgctagtaaggcagaaagaccactggatttaagagttagaagacttaaattttgaagcctgtgcaccattctcgcgtcttatgatgtgcttcatttctcagaatttcagtgatttcatttataaaatatatttggggaaaaaacatcttgttttttgcttttttgttgcttgaattacaattgatgaattaggaaaagctgtaagtgtaagttgttgctatttttaaattagtttcggctatagcccatttgttttacttgtcagtcatgatacagtaaacattctagaaattttcaaataaggaatttaatacaggggattaggttctttaaaaaatcactggaaggactggaggaaagctctagctcagacttctgaaatgactcccacatcattgcaggactgaccagtcagggaagcgaccagtcagggaagcggctacttctgtcacaattaggaaagcggcctcttggactactgagttcaagaacatacttctatagctgcagcccaggaaacaggaagccaggattaggtactgcctctgagctatgcctggaaattggaatgcaaagtctagttgccgcttatattccatctcttgacattcttaaagctggaaattggagcctggaatactgtggaacaacttaaatcttttcaatcaagctagagaaaacagccaaaggcaacaggataatggttgccacccccccccccccccgcccccgctgcactctgccttccatgtctcgtgttagtgcattctaatggatgaggcctaagtttcatccaaaaccctaactgccagtgaataaggaagatagtttttctgtttttttttatgtttagtttctataattgaagaaagtaaacttaagagaacgagttaatggaatctgaccgctaattaatcacacacctaaaccctgtttttctgcttctctgtgattttcaaattttttccacttttcattatcctttctctacttagacctaagttctagccattttaataaccaagatagctttcatttttatgaggcattccatacctttttaatcctcactgcttcatcagtgtttatgaatgttcagttctgggttacactcatcttcagctgtggtctgggtggacttggattttgtaaccagacttgtaaaacctttggcctgctgttgcctgtaaagtgattcaccatttcaattactatgctatataaatctttcacattttacttgcctgtatttttggggggccctacttaatacacttttgtgaggttttattatactctctaaagacattaaaaaaaacaccaccacttccttccatgatcaggtattctttctcatattttaaatcttcttacaagctactatttggagaacgtgtggataaaaatagaagtagactctggaaaatatcaatatacattactttttttcattaaatatataatatgcttttctagtatttatgtaaaaccttatagccatatggtaaaataaagccaccttatcctccccatcctctatcctgtttgttttttttttcctcttctaaaattgtatgattacaaagaaaatatttttaacatgtctaaaatacaccaacctgggcaagacgcaaaaccttgtatctacaaaaaattaaaaagaaaattagccaagtggtgcatgcctgtagtcctagctactctggaggttggggcgggaggatcactggagctcaggagtttgagattgcagtgagctgtgatcatgccactgccctctagcctgggtgacacagtgagacactgtctctaaaaaataaaatttaaaataagcaaataactaaaatgaaggcaaaacgtgtccaaaatacaaataagcataatcccaaccatgcaaagataataacagatagtttctctttctgatcatattattttgtaacctgttaccacttccctacttagcaatataccatggtttctatcactgttgaaatgataatgggagtatttatcattggcatcatctgggttagggaaattgaccaatatatattgggaaattggattaaaagtcatttttattgaaggcggtattagttgtaaccttttttggaaaaagaattaatacttaatagcatcaaggctattttttattagaagagggcttgtttcattcacttgtatatttcatttttgtgaaatgagaatcttgttttaaattaaaaggactgcatatttattaagcaattcagattgtatagaagtatttaaatagaaagtgaaagattcttatacttcttcctcctataactcctttcctcagagttaaccactgttaatagtttggcacattctttcagaatttaaaaaatgtatgtgtaaatgtacatctctggttagtttctgaaacatcagtttttaagagttcactgttaattattgtaatttgataatgtctagatggtagtagtatggacagaatttaatacgtatgtaatcgggttaacttcagaaagcagaaatgtcaatgtttaattgtattgatttcaatttttgttgataaaccattctcagcagtctttctgcttattagcttttaataagagacctcatagtaaatacagagattcttctacagtgaaatatatttctgcttactgctttaggtatattttatcaaaaaaatcattgagttactgagtatgaccagttaaaaatatgtttgcatttatttttagataggcttttagaaatacaaaattagttggtactgactggtttaaagagtatattggatataaaatctccataataaaaatcctttcattttgttttacttttaattttgagaaagatagttttgcttttcagatgtgattgatctcactggagatgataaagatgatcttcagagagcaattgccttgagtttggccgaatcaaacagggcattcagggagactggaataactgatgaggaacaagccattagcaggtaaaaacataatttgtataaagcagatataagtacttttaaaaatagaaatcattaattgggttaaattaattttaagaggtaataagatatactttgttactctaaactagtaatatgcttgtgtatttttaaattttatgtaaccaaaatcttcatatttagttttgattgcaattgggtttagatttttaagattttgggatggtgttatgagggattacatttaggtgcatattttaatatttctttcattttttttcttcccctaatcttttttggatgcactgtccaatttgcaacaatttatagcaagggtcagcatcctttttctgtaaagggctaatagtaaatatttttggctttgttggctatagggtttctgttatagctattcagctctggtgtcataacgcaaaagcagctatagctgataaataatataatgagcttggctgtatcctaataaatcttgatttacaaaggcagccagttggttttgtcctctcggctgtggtttgctgacttctgatctatagcatgataatatgtttatatatattgttcaaataaatgggcagggctccaagatgtgtgctagaatgcagtttttcatttaataaccaaaactttgtagtttgaaacagtttgattcatctaaggactaaaaaatacatttggttttcataatacctctaaaaatggagatataataatttaataagccataaagttgtaactaactgtaatcctctaaacaactatttgaaggcagtggtaactctatgttactgaagaagaaatttacttgcaagaggttaaatgtgctttttccaaaggcacacagctcagatgcatcttaagacttaaatgttcttttcctttaacatagtcctttggtaacagaatgtaccaaatttctcaggtaatttttcttggcacaatatcaataggagatttctttccaaataatcagagattactatatggtaggaaatgtttcaaaatgctatgtttagcaaaggcatataattttttatcttagtgcgactttttaatgtctttaaatgttactttggaaactactttgtaagacattatattatgtaaagacttaattaaactctattgtccccctcattagttgtggctaatatttattgccaggaactttaaatgaaaaccaaaaaatacgtagttaggcttattttctgaagcatttgagaaattatatgaattgggctttttctttttaaaacgtgtattgcaatgcataattgtcttgaataattatgaaacaacaatacttaaactttgagaaatattttaaatacaaaacacatgagttggatttcatatgtaaggggcatggttttatgtgaaaagggttataaaaagaatgtatacttgatacaaatattatttttaaaattatatttttgtttatatgaatttatatgagtatatgaatataaaatatatgtgagcttatatacccaattagtatcagtcgttctattatgtgttttctaattaaaacaacaggtactaattatataataaaagtaaggtaatataaaaagggatgaaggctgttcctaatttgatattcagttcaatgtatatgttatattattgttttggatagttgtttttatccaaaatggcaaaagaaaatctcttcagataatgctgttttttcattctaggtcttttacattttaatataatttaaaaatagtaaatatttggtagatattattattgtagatgacatagagattcggcataatgtaacatgccataaagctatgctccctagaagtaaaagagtcatattaattatgtgtaaattcaataacccgcaatgagcaaatgggtgttcaatgcaaaatatgcatttaataaacttatatgtaaatcatattgtattaggaaaagaggatgtggagagttctagctaaacattatcagagatatatttgctcatatgggtttattaaggtatagaactctaaattcaaaagagaaaatgatgcattttaaaggaagacatttatatattatgcttaaaagtaaattaactccttcttcattactgaagttgatatagggaaaatctttgcaaataaaattccagaatcatttgcttattatattttagtagacataatttaatgtgaagttacacattaggatactacattgtgtgtaatttgatgagataaagcctgtctttttacgtcttagaatcctgtgtttaggcatttatacgtttcatgctaaaattttttaagtagaacgtttttaaagtatttctttatacactttttagtgtcagaattgggtgtatttattatctcttgattatcactgccaggacacaagtggagtatggacagttgaaatttgttaataaactacattgtgactggtttgtgtctatggcatatttcttgtgaaaatggcttgcctcatgaaataactttgaagtgcctcattagaagatagtgctaagttttctagctaaaattgttacaaagagcacgcaccttcaacaatttcaagaagtagtagactacagattctttttttcctcattacttctgtgtttcaactagttatttcttgttatcttcagcctggagttgccattggggaaagaaagaaggatcatgtccaggaatagtcagggtggaattctgaattattaaaataggtctgtataactcctacattttttatccttatcattactgaggaagcagctgtgaaggggaactgtctaaagatggtgtgtgaaacaggagtggatgagggaggcagagttagaaatcttttaaaattgatctttgaggaggatttcggtgctcaataattccagatacttgtggatgctaaggagcatggaagggccatcgaataaccatcaaaccatttaaggtgtgttatgtcagattatagatgatctggaaaagtaagaaatatgacacagattagtttcctgggctacaaggttgtggctgcaggtgactgatgaacagcagcagtgtaacttgaaaaagtatcagcaacagtgaggtaccactgatatccccaggaagagggatcaactggtcgatgtagtcaggctgtccgtgtggcaggagccacaccccatgcaatgtgggctctcctacggccagatacacaggtcaacttttggtaggaatcacatgtctgacaagtagtggtagcttctgtgttagaaacgtagagttccttaatttgtactctgtatacgattgtggatgtgattccattttgggtattgtgattgtggcagtggtggtgatctgggttgtgcaagtttgatcaaaagctttattctgttcatctcattgaagaacacattagagcactcatccatcacaatggctaaaattaaaaagactgatgggaagtgatgtcagcaagatcgccaactagagttgcttggctatcatttccctcacaaaaaaggaaccaaaacaacgaataagtttattttgtctggagtgactgaggaaatgccctggagagtaccaagagaacagcaaagtccctgtggagcatagagtcaagaatagctccacagggaggagaccaaagtatcctgcctctgccatactgtctcccctgcgaggattgaatcaaagccagggggttcctcttcttataggaagaaggtaagcggagaatcatcagtcctcatcaccaccacaggtgccagcagtcactgctacaagagagttccccagtcctcacaggtcccaagtccagcatgaacagttgctgaaagtgcatgtggctacattcccccacagcaggaacctctttgacaccctgcacccctgcaatccaagcagctaagggatgacacaactgtgaaaccaagcccacatctggagtgcttcctgacctggaggccagtagccaccctgtatcccagaggcattgccctcattccacaaagttcacacaagtgcctctagcactaataccttggctacttggagcctaggctcaaaggcacaactggggccctgatacctaaacccacaaggctccctattacccagggaagcaggtgggcctgcatggccgggcagccccatgcggccaccaggctagtgtacatctgtccctggctctagctggcctggaggtggccccaccccaagggagagagtagtatacagccagtgggcctgtgtgaacttgctcccagcttgaatagctggcccagaggttgtctgcctgtaccactggaggattgtgcacagctgccgggccacaatttcctgcctttagtccaatagctggtttggaggcactctttccgcagctcaaccctacatcaccagagtcatgcacagcctccagacctgtgtgcatccacccctggcctgatagccagcccagcagtaaccctgctgccattcaggagagacagtcgtacaacctttctggcctgctgcatcagcatgtgcctgaccagcaaccagcttggtgccaactccagaaaaaccatgccaccacagtcatgggcttctgcatactaagtcactgagataatcacggacatcgcaggtgaggattccagctgaataatctgtttggacaccacaatactgagtccaccctgaaccaaagccaccacacgccatttccaatcagcaccctaggacccatcaacaggaaaaaacctcttcctatgaaagctgctcgttaaaattggaaaaagcaattgtccattacatgcacaggtaccaacatagagacagaagaatcatgaaaaagcaaggaaacgtgtcacccccaaacctggcaccacaatgcatctttagtaatggaatccaaagaaaagaatatttatgaaatgcatgaaaaataattcaaaataatgacattaaagaaacttttgagttgtaagagaatacaacaatttaacgaaattaataaattcattagctgagtgagaaattgaacaaagatagatattatggaaaggaacaaaacaggaatcttggagcttgaggaattaagtgaatgaaattaaaaaaaatacaattgagagccacagtaacagactagaacatgcagaataatacatttctgaacttgaagacagatcgtttgaaataacccattcagaagaagaaaaaaaaaaaagaataacaaagtatgaagaaagcccataggacttatcagacaccattaagcaaacctatattcatattatgggagtgccagagaaagaataagtgaagagaggcatagaccacccatttggttaaatagattgcctgtgtccttctgcacttcttggaaggaagtcttggaagttatggacatctaggaatgaaaagatccccaataaaattcagcccctcaaaatcctctcaaaggtacacaattctaaaagctgtaagacaaaaacattacgtcacatatatgggaattcccattagactgtcagtacatttctcagcagagactgcacaagacaggagagagtgggatgacatattcacagtgctgggaaaaaataaaaataaaatataaaaataaaaactgtcagcagagaatatatccggcagtgctatccttaagaaatgaaaaagaagggccgggcgcagtggctgatgcctgtaatctcagcactttgggaggccaaagcaggcagatcacgaggtcaggagatcgagaccatcttggttaacatggtgaaaccccgtctgtactaaaaaaaaaaaaaaaaaatacaaaaaattagccaggcatggtggtgggtgccggtagtctcagctacttgggaggctgaggcaggagaatggcgtgaacccaggaggcggagcttgcagtgagccgagatcgcgccactgcactccagcctgggcgacagagcgagactccgtctcaaaaaaaataaagaaaagaaaaagaaatagagacgtttccagacaagcaaaggtgatggaattcatcaccactggactggtcctacaaaaacacttagaggaaataataggaaatgaaagaatgattaataccatgaaaatatgtgaaaatacaaaactcatcaatataggtaaatccataatcatattcagaataccccagtgctgtaatggtgctgtgtaattccttccgtcctctaatatgaaggtttaaagttaaaaatgtcagaaatatcaacagctacaattagtggctaaggaacacatgaaagataaagatgtggctgggcgtggtggctcacgcctgtaatgccagcactttcggaggctgaggctggcggatcatctgaggtcaggagtttgagaccagcctgatgaacgtggagaaaccccgtctccactaaaaatacaaaattagctgagcatggtggtgcatgcctgtaatccaagctactcgggtggctgagacaggagaattgcttgaacccgggaggtggaggttgtggtgagccgagatcacgccattggactccagcttgggcaacaagagcgaaactctgtttcaaaaaaaaaaagataaagatgtaaattacagcaatcaaaacactaatcatggtggggtaggggagtgaggggaaaaagtctagattatttttgtgtgaccaaagttaagttgttattagcttaaaatagtctgttgtaactgtaagactcttcatgttagctccatggtaaccacaagaaaaattatagtagatagacaaacaagaaaggaaacaaagcttagcattatagaaaaccaccaaaccacagaagtaaacaagagggaaagaatcaaacgaggaatcttcataatattgagaaaacaaactagcatgagtaaattattacttatcagtagtaaccttgaatgtaagtggattaaattccccaattaaaaaatatagagcagctggatggattgaaaaaaaaaaagacccaactgtatgttgcctacaagagacacacctcatcattaaatataaacatagactgaaagtgaaggaatggacaaagatatcccatgcaaattcaaaccaaaaatgagcagaagcagccatacttgtactagatacaatagactttaagtcaaaaactgtaaaaagagacaaagtcattatgtaataataaaataatcaattcaccaagaagcaaaactgtaaatatataagcaccgaacaccagaacatccaaatatataaagcaaatattattagatttaaagggggaaatagactccagtacaacaatagtagggacttcagcatcccacttttaacagtagacaaatgatttagaaacatgagacttaaactacaccatggacatttacagaacatgaacagccgcagaatacacattcttttcaactgtgcatggaatattctccagtaaagatcgtatgttagagatggtatcaagtattttaccagatcacaactatataaagctagaaatcaacaacaagaaaaacgttagaaaccaacaaatacatggaagttaatatgcaccttaataaccaatgggtcagtgaagaaattaaaagggtaattagaaagttccctgggacaaaggagcgtggaaacacatacaaaaacctgtgggacacagtgaaacctgttctagaagttcatggcaataaatgcctgcatcagaaatgaggaaagatttctaataaacagattaactgtgcaactcagagaaacctgaaaagcaagaacaaattaaacccaaaattggtaggatggaaataataaagcttagagcagaagtaaacaaatagagactaaaagagcaattcaaaagatcagtgaaatttttttgagaagataaacagaatcaacaaacctttagctagactaagaaaaaaggaaaaaaaaaaagactcgaataaataaaaccagacatgaaaaatgaaacattacaaatgtatcacagaattggaggatcacaagagactattatgaacaactgtataccaacaaattctagaatataggaaaaatggataaattcttgaacacacacaacctaccaagattaaattgagaagaaatggaaaaaataagcagaccacaacgagtgggagaattgaataactgctaaagcctgacataaagatccctagtttctgatggctacattgctgaagtgtgtcaaacatttaaggaacaactaatattaattctcaaactattccagaaaattaaagaggagggaatacttccaaactcattttatgaggccagcattaccctgattcaaaaactagacaaggacacaacaaaaagaaacaggccaatatccctgatcaacctagatgcagaaattctcaacaagattctagcacgtccgattcaacggcatattaaaaacatcatccactatgatcgagattcatcccagagatggagggatggttcaacatacacaaatcaataaatgcgatacatcacagtaacaaagagaacggaaaccatataatttcagtagatacagaaaaaagcacattacaaagtttaacatcccttcatgataaaaactctcaaaatagatatagaaagtatgtacctcaacacggtaaagaccatagttgagaaacccacagctagtagtatactgaatgcagaaaaaaatgaaagcttttccactaagatcaagaacctaacaaagatgcccacttccaccaatcctattcaacatagtactggaagtcttagagcagttaggcaggggaaagaaataaaagacatcaaaattggaaaggagaaagtaaaattgtctctgtttccagatgatatgatcttaaatatagaaagccctaaagagttcaccaaaaaactgctacaactcataagtgaattcagtaaaagtgtaggacacaaaattaacacacaaaaatcagcacttctatatgctaacggtgagttatttgaaaaaataagaaaacaatttcatttacaagagctacaaaaaatctagatacctaagaataaacttaaccaaagagataaaagatctctacactgaaagctataaaacattgaggaaagaaatataagacacaaacaaatggaagtagatcgtatgttcatggattagaagaattaatgttaaaatggccatactacctgaagtcatctccagacttactgcagtccatgtaaaaattccagtgacccttcagagaattagaaaagacaatcccaaaaattcatgtggaaccacaagagagcccaaatagccaaagcaagcctgaacaaaaggaacaaaaggtagaggcatcactacttgacttccaaatgtactgctagaatatagtaaccaaaacaatgatattggtgtaaaaaacagacacatagaccagtggaacaaaatagagagcccagaaatggacacacctacagccaactgatttttgacaaaaactgttaactggagtaaatctaagaaatgtacaagaacttccaggaagaaaatgattaaatatcattaagacacattaaagaatacataaatattttgaaacattcgctgtttcatgaattggaagaccattgttaaactggtcggttcttcttaaattgatttatgggtttagtttgatcccaattaaaaataccgttagttttgtttttgcttttttaggaaatcaaatgagatgtttcattacccgccgccccctttttttttctttgtagttgatctatacagcttaaagtgtatgcatgtttctcagtgagtgtaatacttcccaaaaaggggcttaggtgagctatgaagtgggatattttcagtattactgctataggcaatttaacaacacaaaaacaataaaataataacaccccctcaccccccccccaagtaaaaccaccgtgtaataaaatttaatggaaacatgatgatctaccatatgtaaatgctttaaacatttagcgtagtgtgtggaaggaaaagacgcagcaaaacattttgtcgtctttttatattgcttactaccaaggtcatgaccaattttgagaagataaagcaaggtgataggtcagactcgtttttggtatgtggcttgcgagtttacccttcaaacattttgttataggctatctctgaaatttgccttttttttttctcctctaccagctggtaatacctggattttagccactgcatgtcttatacttaagagcttgggtagtatcattggaaaggccaggggaggaacccttatgcaggattttgctttataaaaagtttggatttatggtgccagtactagattatagaaggggatcaggtggagcaatagagcagtattggagctagagattggcttttgcaatcagtcagtcaatcaataaccaagaagtagcagcatttaatatcttcatcatccatttactttaaaaacgtgtttatcactcatttataatgtttgctctagaggtaaagcaaattcttgtttctacttttcagacactgattggagacactggttgatatttttggcacagtgttaagtgtgtttattaagttctttaggaaccaagaggagatggtaggaggagacctactgaggcatgctgtaaaattctggtgataaaatatgtttaaattaagagggtcaggaaatcatggcattcccctttcacctacatgctttttttttgcaccacaattctaccatgtggtatggttaaggtgtattgtgataaacccatttctttaaaacccatacttttgttaacagtgaatgacaatatctaccatatgactgaattgagctacttgggaaatggctattatttttaaatcttaggtgactttgaggagcaatcatcaattacatgtatctcttgaactttaatcaaagttgttacactttgtgcctcatttgatctctgcaaagaaagttatataggagtgctgggaagatgttgtcttggttcgtatccctaactttcttgcccttccaacttcctttttggaatggtgtgacaaatggttcaggctttacttgctcctagaaagtacatttgaggccacacattcttgcaagtcctgtgtggggagagagaaggcaaaggaactaaaaagcttacattatctcagtatatcaatgtgatgtttacattaaatattttgtatgtaaacatgccaatcaagtggtgtatattttttggtagagcagaagacgggcgtaaaggaattgactatacttaaaacatttcaaaagaccttcctggggtttagtaatcttagcccagatctggaatgtgaaaaatgtacttagggtgtattgtgcagaaatcagatgtcctcaagttttctgtagctgatgtatgtatgaaccatttcctgcttattgtgatatgtgtgatctgctctgttgacattattaagaaggatttgtttcttgttataattagtagttaaatataacgacagatgttcatatgctatagattcaggattacgtctggttcttttagacttttgagcagtttatattttagaatatgctgtagaatcctctttttacatattgtctgtctgcactggtactagtcaattgctgggtacctcttctatctcttatataggatcactggtactatttgttttatggtatcgtttttatctgcctttcccagaacttattccatgttttagtctatttatttctgactaccaagatacaaataagtttgctgtatctcaacgtctaaatatacatatatattacaaaaggaacaaaattttcaaatgagaatactgccatttataaaagtcaataaaaagttaaatatcccctctatatagggcagtcttttgtattacagttactttttatatactgtgcattaacctttcttttttgagcataaaccagtcttgaacaaattcagtttgttcaggttattattattctgctgaactgcaaaatttaactgttagaaggtctttaggacctcctgggtctccaataggagagtcaagttgactgtctttctatctctcccttgtattcttgaaaacttgctttctggtaacagtagaatgttctagatattctttggttttcctctgccccagttcatctaactaaatgtctttcaaggagttctatgtcttttcgtgaaacaagcctagagtctggggttgcctgtgggagttggtttttgggcagagagtagtgctggccagtcgggtcactcttaagtgtgacagaagtagaaactgtttacttttcactatatgagtttacattttaacatatcatgttgttaccagtttttcaaaaatgtgtgttttattgattcccaaagactgacttctgtattcacatggatattttagatttccttgtatctaatgtcttgtggtaaatattgctgttaaggataaaataataatattttgacattaatctgataggataaaatctttaggataaaaatggtgtgaaatgaatgagattttcttgataaaccaaaaagttgaaaaaaactaatctttactcaggttctggtaattaacacaaagtggttaagatacctgaatgttatttatgctgatttagaataataagtaacaagtttctttttttttttttttttggctgaagccaagtagcaagtaacacatttcttgagcaggcaaaatgcttggttagatcctatgtgggaaccagggttttccagttatgattatacttatgttgttgcatgctcaggagcaagaaacatcattaaagtagcattacttttgccatgtttagatatacttaagatattcataggtgagtttattttggaaaggttaactatcttttgttattctaatatgtattctaatatttatttcattaaattttcccaaaggcaaacttttgggcaaggcagtgaacatacaggttttcttttcctttacttggctctcatagaggcatagatctcaagaattgaaaggaatcataaagtttaactcactgaactttttttttgtagaagaagaactaagtggtcggtgataaaagtgcaacttgttcagtttttaatgttttcttgattcagagtaattgttataaaaagtggtcatcatgttatattgtaaatatgtactttaattgttatttctcagaaaattcatctagatggtatattcctggtactaatatctaatttgttgaaatgtgatttattgtactttctattatataaaactgccattttatgtttgaaatttcatttttcttaggaaaaaagactatacttctctatgtattagcattgacactgctaaaacgtgtatttgagtaaagttagtattaaatattatttcttcaaatacattattgaaatcttatgtaatgaaaatgcttttagaatgtgtgatatgcctgggatatataccattatataatgctgcatttttttccaccattgattaagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcaggtaaggatttttctttattcagttcttatttgatgtgtgtgatagcaatggaaagtgagttggttgtgtttaagttgtgtactttaaagataagtacagataagtttttaatatactattttgtctaataaactagcttggggattgaagtatcctcccatccctctttgtttttcatttctagtatgtattttttaacagtagatcactacttatgcctttcacttatttggaatcaatttatcctttccttctgcttttaggaattgttggggtggaaagagttttgtatatatttccctgcaaatttatggaagcattgtaaccaagtttgaaactagaactggctttctgtgggtcagatcagatttatttgtatatactagacagtgttatttatagaattatagacacttagtatttttaataagcattttgtttgaggttggtatagatttgcaaatctgagtttgcatgtgaaatgatgtgatgaataaatattgataaatcaagaataacacattgtctttttttactaagaaatcccttaatgatacatttcttgatctgcttattctaaaataagagacatatgtatgtgtagatatccctcttttcaatttggaacagttttcttttacgtgtttaacaactgttatcaaaattctttatcattctcggttgacattgataatgttatccatcagattgcaaaactttaaaacaatttatgaataatatgtccttaatttttattactccttaggaaagttaactaatgttttgtgttcgtttttgtgtgacagttgaattatagcttattatttcatgttcgtgatgaatgctttttccttcattggacatgcatgctattttttgtattcaaaatatatcttcattttgtaactttccaaacctgtgtgtatgacagcttaaactttcatatgatattaaggcaactaacaggttatttggttcattttctacaagttaattgtttttgctaacttgtaattttaacttttttttatatacttcagtgctaaaattttcaccgttttctccctttttgcttctggtgcataatatcatataatttgattttctttgtttttctggatttacctcactttttaatatgctgtggtgcatcctaataagtaatatgctatgttattggctttcccaggacatgaagatgctaaggaatacctggattaacataaatctatagtagtatctttgcttctagccttgattatacgttgtttacttacatgccaaaaagcaatatctaaaatattgataccttagagattcttagatcatcttaataggctatctcactttacttgcgctatctattaagaaggtttgtgcatatgataatttagacataattttaaaatattaagtatagttttaaggctctgaactgagtgctcatgaacatgttttgctgcctgtgtttggtcaagtagatgctatctcagcactattatggcaaatacatgagggtcattgattagaagcttttcttagaaaggtataagaagaaagaaagtatttgtaaataatattgttagaatagttgctttttatttctctatcctgtatgtgtagggaagttctgtttgaaatgataaatgctgatatagggataatgaccttttgttttagtaggataaaacttctttcagcagctcagtttaatcttgatacagttacaatctgtttctaccctaagtttgctaatcttagcttttctagcttttctttttagcttagatttttttttttaagaaggagggaatgggctagaaaaaaattatcttttaaaaaaatgcctagcttatttaaaaactagtaattgtactagttttaaaattttatctaagtttagtggctgcttaactcctaacataggcaagtataagagggcttgagttatttattttttcttttggtgaaatctaaacatctaggagaagtaacctataagcttaaaaattcaggttataatggcctaataagataatggcttttgagggagtagaaaacactaagcatcagattgtggaaaatgatgagtgggcagaaaaatttggctagagatcacctgaagttttattttttatggtaattttaaaatctatcaaactattttaagtagcttttaacttttatctttggtagagtcttcttaaaaattttctaccattattgcttaactctaagctataaactgagatataatacttggccatcataaattgactttttacttgtgaatgaaaagttgggccaaaaatctaccatagtgttggaggttttgttgttttccacagtgagttggaacttactcaaattgtgatgtaaatgtactgtaaagttttgattacaaaattttctcggggatggaatttacttagtaggactaatttgaaacatctgggaattctttttcttgtaaatatattgaccagttatagaagtttgctagtaatatcaccctttaacttcaaagtatatagctggggtaggctacaacagttatagatagctttgcatacttattattttagatactgagaccaatattttggtagaaagggggaacagaatgtaagaaagggaatataaacaaagagaagattgtacagataatggcttaaataatcttttggctgctggcaacattagcctgtctttaggttagacatcaaccccacagctagtcaggattatttttgtcctattcacttggtacttttatgtagaaagtactgattgcagctgttccccactagggtgtcactgaatgagttagctatttggaggtgtatgttcttctctgtagctctgggacatgtcgttgaagtggtatgggtgctcatgatgatccttagccccttagcacctttccatttggatgccgagaagtaaggtgctcatacttctcagtttgcttgtcatagtcccttttactcctattgtagatctgttggcacctgtcacttagtcctaaagccctgctgtgtatgatggtaaagtatgtggttaccttactcataaatcatataactgcaggttgactaaaatacaggcaccctgagggcagagagcacatttagggtactctatattatatatataatacagggtctggcacattggaatagcccatcaagtaattattgcatgaatggatgaatgaaccaaaagggagcatgtatggagtatctaaagtagtacgtgaggatattttaaaaaatgatgcatattgtcagaacatttcaggatataatttaaaatgcttattcatactccttgctcttctctctttaattttcatcaaagaaaaaatcatgtggcactaaaatgcttaaacctgtctgcttcctagtcctgccccttgaaagagacctgtatctaatccatttcttctctatcttcatttttctaaatgacatgccttcccactgagatagatgaggaatttgctctttcagttcacctgcctagaattgccttttgtttcatctctcaacatggttataatacaaattaaaaatagtaggtagtcagtattttcattttttataactttgtaaatgttacagtgattcactaggtcctcccatctatagtactttgttatcctggagttgtcaattgctacctttttcccctattttctatatactttaatattttctaaatgcttcaacatgtttgttatggtcttaataatatattctgtatgcccacacatatttgcttcatttttttgtttgtttgtttttggagttctgtcccatagaccatttctctgtttcaaatttggggtgaattctgattctttgtggtttaagcatgatcactcgctttctaaaagtaagtctagagaaatgggattggtcgatgtgggtatcagtttacatgtttttacttaatcttgctgtttgtagctctcaatcatctctcctttgtactgtgacatacaatttgactgatttttctgaacctgagtcatttaagatctccaaagactaaatttcctatacacccacagaggggaggcaattgtctgaatgtgctgggtctggaaagcacatgggggtttaattgttctgtacatagacttgtggtttcaataatgccatctatttttcaatccctgcctcaccatgaaacttatgtgataccatgctaatttttttttaatcctccgaggagaatttatcacgcttctcagtcttctccactgtaggcagtttatgtttcatttcctctgcactcttgccatcacttctttctttttcacaaattatttgaactcttatcccccattatgtctttgttattagcaagaatctaaccaaacttcattttcgtaagtgcttttcaaaattcacatattagctttggactgaatgaaaggatggttattttcaggtgcattaatcaaaaacactcttcaggcagtaaaagttaccctttcttacctcttttgaaggaatacattggacagtcctcatatgactttggtgaaggatatagggtctttgggacttgaaaaacttaatttttatgatttgttgtgataatcaatggtgatgagtttcactgagtaatggtagatgaggttgttttagaccatctgccttgtgatgttttgctggattccaaaacagaaataaaaccaaccttttgagggcatcacagagtactaaagcagtgaggaattttgagtaaagaaggatagtcatagagtgagcttgttatttttgatggattttgtcctttaggcatctccagaactgactgctgcgtagttgaggaactaagaaaatttttgcacaaagtttgagccctagtaaaacatcttagactgtgagttggaattctaaatggttagaatgtagcattaactgagaactgaaagttaagacaggcttcctagtttctgaattatatagttttaagttatctcagaatttattggattaaggcgacctgagactgtgactctagtctccctgcctgccagagcaaatgtaaattctctcttagaagatagtattatctggaacctttcctcaatttttcatacacaatgtctagtactcaggtcagtcataccagaaaataagatgtgtgtgaaaactaacacaaaaaaatggacaatagaaaacagcacagggaaactggaatacttgtctgccataataataattaatatgttcaaggaattaaaagcaagattgcgagtctgaagaaaactaaaaactgtaaagaacaaaatgtaaatttcagaatggaaaaatataaatgaaactaagaagtcagtggataaatttagcagcattattagacacaactgaagagataattagccaactggtaaattaatctggagaatatttttcagactaaagctatgacataaagatgggagcatcaaagagatactttggatatggtgagtagtactaacagtgtatttgtagttccagagggagagtaaaaggaaatagggcaaaagcatgtttgaagagattactcacaatattccaaacttgagaaagatcaagccatagattcaggaagcaataggaatcaaatagtataaacataaagaatactgcaccaaagtacatcataataaaacaaataactatagacaaagagaaatcctaaaagttgcaaggtggaaaaagatacacgtataaaggagcaaaaacaagactaatagctgactttgatacctttaaacatcaagtcacacataagcagaaataatgtctttaaagtgctagaaataaataactggccatcttgaattttatacctagcagaagtctttaaaaatgaagaaaaactagctgaaataattcttcaccagcacacccacaccaaaggaagttctaagtatccaggaacaaggaaaattctctatctacaatgggagctcagagaatagaagtgggattgaaattcttctaacctgccaagattctctttcctctttaaattcctcaaaagaatagtccatggtttgtctcccctacttaacagtagtcccccttatctttggtttcactttctgctgtttcagttacctgctgttaattgtggctgaaaatattacagtactgagagagagaaggagagggagagagggagaacacattcatataacttttattacagtatgttttctttacaattgacctattttattattcgttattgttgctaatctcatactgtgcccaatttataaatttagccattataggcatgcaaggaaaaaaaacataatatatatggagttcagtaatatctgtggtttccggtattcagaggagattttggaatgtatcctttttggataagagggtgctactctgtaccccattttcccattatttaatgcctctgttcttcctctaccactccactgcaaacatgactttgcagttgccaaatccaaaggttatttctctgtccttaatttattggaagaatgtggcaacctttcatgatattgctaatcttgtcctccttgaaatgtgccagctattttttgatgtacagcagaatcttttgtggaactttgtatctttattgagagtcccctgacacagctattttttaaagctccgcagtttattagaatacacaagtatgtttgaaagcccttgttttctccactcgtttttcttctgtgatttcccttagtattcctttctctttttcaaaactctttttcttttttcctgtgatttttaaatggtgctttctccccaaggttctgatcttggccaactgttaatgtattcatatcccttctggtttattacttctactcttactgttttaaaaagcagtcacaagactgtaatccctacaagggcagagactaccttcttagtgtctggcatatagtagatgctccataaatatttgttaaatgaatgaatagatgatttattttatgtgcttatattgttgaataaatctttctagatcacaagataaaatttttttttacagtttctgttaccagctttatggttttacctttcatatttaggttgttaattgatctatgtaatctggctctatttctttatatgtagttttctcaatacccaactgttgatcaaaaccttgtttcctcattgatttgtggtgccacctttaccttctgtcaagttggctgactcaccttttctaagatttgaaacattatcacttcctgtatagtaattttcaaactttataaactgtgacccaagaaaggaatatactgtatattataaaacattttacacatacacaagtgtgtaaaatatctacaatgaaaattttgcaagaaaatactctgatgtatttactgagtatgatacattgtgatattttccattgtattttatctcattttaaagaaatgttcagtatgatgatagtaaatggttgcaaactacagtttaaaaaacatactccaggaagcctttccatgggcatcctgcatatgctccattagattcttgtgtaattattatcactgcatcttgaagtcacgacatttctattacatgtctgtctcctttctaaattgtgtacttccttgagcattgagataatatgtaatttctttgtgtctctattacctaggatctgatgagtaaatttatttgtactccatttttctagtattaatgatacatctagataattcatggtaaacatagcaggtctaaaaagttttggacttgacatttgcatactctttattttgaggaaactgcttaagtgcatataaaaagagctattaataatgagtagtatatttaaaaagttgtccaaatataatcttgtgcactatcaagtatcaagaatggtatgtcaaataaaagaaacttgactttttctcagaagtatgtcctccttgtgccagttgcaatgattctgagtataagtagtacacagttgtaaaaaataaacctccaagactagtcatttttacattctgctaatggaattttccctcaggttatgttaaattgttgttctttttcagtcattatttaatcttttggaatttagaagattagttctgaattacaagcctccatcaaatgctcaagatttaccccgaaaccaaaaggtaaaattcaaaagatttttttaagcagtatatatactctatatgttctcttatatgtgattgatttttgggcatttacttggctcatcaaatctgaaactgtcaatttgaatgtcaattcattaatcttagttaccatagcaagttcttatcctttgttaatatattataaatacgacttttttcctttacctgtcacagtaatatgccaatttttggtgtcgctttagtaatttttttgggggggactgtcaaatttcagtaaactttataggctatagtttacaatttaaggtctttcctcagttgtctcctaaaaaattttgtggaaatcgaaatttcttttcaattgatcgtcttgtgcagccctttaaaaaatgcgttttgcattcatgtctttgcagtacaaatctgtatctttcattttggaagtgactgtcatagatgggtaatataaagtgacaacacacacaccagggccagattgcgtgggttctagctagggacctagagctggttacttgatttctctctgttccatttactatctgtaaatcatatataataatagtaattatttcatagagttgctgtgagcattaaatgaggtaaaacatgtaaggggcttaaaagtgcttggtacatagtaagtactaggtgtcagctattgtcagttaaacaataaaaaaaattaaaaaaaaaaaaagacttattttaaaaagaaccagtttgcacacagaatttatacctaatggaaaaaattacttatggagatgatatagttgcgtgtagggctttagtggttgatcttgtcataaacaatctgtagtcctaaagtggacttattgccaaggcaagggagttagttttaggtttcagtaaactgctgaacttttttgacctatttttagtaggagtgatgaaatattaaattatgttttcgttttagcgtttaatttttaaaaccactttttctttttctgtaaacacgtgaaacatttataatgcatgctagtgggaagataacttgatttataaccagcttttcaggttataatctctgggctgtagagtgtcaggctgataaacaacccattttcaaaagggagtcaggatcgtctgacaaactcttatgtctccagaaaaattaaggaaaaccctttcaatcattatggtttttacatggaactttctgaactattgcctctgtcattgcaatttgttaatatcacagttcttctctcttctcatatctcaaagtatatgtataatttgtgtgaaatggttgagaattatcatttctagttaggtatgcatgtatgtatatgcatcttgaccatttatggtcctggattttaatgttttacagagctttaatttcttttgttcttcacagagttgaatgaggccatgttagtttgtattcttatttaaaaaacagttgctatatttatgcttatatatcagaacgagttgtgaatactagagaaatgtgtaattccagtcttcagcacctttctagagaagtttgtttcttgcaatgggttagcctctccaggtgtccctttagcttaaggaaataaaagaatttctcacttccattctgagacaattacttagaatactgtgcaattttatatgattattccacaaatgtgactctaatttagtatagtgacagcagtacacactataccttgacatctttgaagcaaatggatttatagatagttatcagccactgaatggtcctatattcacttgagatggtgacagcaggtttttaaaaaaggcgtgagtgtaacttgtcacttatttaataatgaatttaccgccaactcgtgacatgtctacagctacattcaatttgaacactttgtcttaagttgcagaatacatttgggattactttgatcacatcacagagatgccatttgtatgcacttttaaacaggatattttttgctagcaaaatttgccacaaatattacatacatattgagtgagatttgaaagaaatctagtatttgaaattagtatgtattttaagtagacttggcaattgcttgtagaaattgaaactaattttagacactcaggtttctttgaactgttggtaatttcagtgtctaggagaattgtgaggtccctggaaatataataatagatccttgatgtaatcatcccctctcccctcacacagatatacatttggtttaaaatgtttcagactgatggcaaagcatattaaatgttgagaaaacaaagatgcacatgtataatatttagtggaaatcatcatgtaaatagctaaagccttattaattggaaggttatattatttaaagtcttgatttaggacaaatatttcaaaataaagaaatttatcactttccactacttaaagtgaatgtcatcagaaggaaatgggtttagttgagtaccatactgtattcctggagcaaatacctgaaggaattttgaattttacaaataaaaggggcattctgagatttctgccattagtcatgaagaagtaacaggagctggatttataagtctcagtgcatcttagaggattcaaagcatacaaaataccttttctgatgaaaatggtagaaatcaaggtagaaatcaacaacagaaagatatacagaaaatccccagatagttggaaatgaagtaattcacctctaaatatcccaagggacaaaaaaacaaatcaaatgagtaatgtcagaatattgtaagctgaatgaaaattaaaacatgacatatcaaaatttgaggatgaagctaaaacagtgattagtggaagatatcttataagagacatcttaccagacatcttattagaaaagaagaatggttttcaattaatgatagcagcttgcatatcaagacattagagaataaagggcacgttaatctcaaagcagaagtaaggaaataataaaggtaatagcagaaatctgtgaaccaaatatcagaaaaacaatacagaaaattatggaaccaaaaactgcttcttgagaagattggtgaaattgatgaacttctaggtagactaagcaagaaagaagagggaagacatatattacaaatataaggagtgaaaaagggaaacatcactacatactctgtagacactaaagggagaatagtggaatattataaacagcagacaagtatcttgaaagtcacaagctatcaaagctcactagtgaagaaatagataacctgtggtagccctacattatattaaaggaactggaacctgtccaccaaaaaattcagcagctaaatagttttacttgtaaattatattaagcatttaaagaacaaatgataacaattccctataaatttgtacagatacttaaaaagtaaaacttcccaactcattttgtgagctaagcattaccctgaaatgaaaagtaggaaaatacatttcaagaaaagcaaaccacacaccaatatttctcatgaatttggaagcaaagaattgtagcaaatttttgaaaaattaaatcctgcaattatatataaaggataatacctcatagagaagtggggcttatccaggaatacaaaattggtttagctttcaaaaataaatcagtatacttcaccatatcaacagactaaagaaggaaaaccatattatcatctctgtggatgaagaaaaatgatttgaccaaagctaaaatctcatttatggtaaaaatcttctagaaactaggaagcaatttacttttcaaatatgcttctcagcagaattccactaatttccaaaaattattacttccaattttgttactgggaatgtctcaaaaaactgcattgacttaggtgcggtgataaagaaactgatctcaggaaattaagggtacttttgaaagtaattttgtggattaaagctcatagtctttatacttttaaaacctatgtctgagggcatatttggaaccagttttattccctcttacctatttctcaggactcttttttggaatctattctagaagcaattctttctatgtgggttatactattttgggcagcaactatgtaaagatacacccccatcccagacccctagaattttacagtgttgagaatgccaactgtgtaaatttggaagaaaattttcatgtttaatatctaaattttttccgttaaaattgttattataagaactaaatattataagaatggcttgcctggtttgttgtcatgaaacatttcactaagttatgtgaattatgttattttttaaaatttccttcttgttttaaaatacattgttagtgattggtaatgtgggttgttttaatttctttctggagattttgctttaatgagccagtaagaattgaatgctttgtgtagtaaaaagttggggaaaagatatagaaattcttgtctttgagaatcttatagtcttattgagaaacaaaagtaagatttcagaggaatattaggagggtgatatattagtctcctattaggatctggtctaattattaaattaataaaattaaataaatttaaatattgtgattgaattatattaaatataatgttcgataactttagatataaaataaatgagtataaaataattttataagtaatttttattaaatataaaaacaaatattaaatttctaataatcgggtgaggttctaatattagtctaataattaagattgtcacaccacagtgacagtcggtgattcattgctcagtgaaaggcatttatttcagtagatgtggaatttgaaggtatcgttgacttgaaggagtctggaaaggcttcatggaggagtggagatttttgctaaatgggtttattgagatcaagcacttagaacagtgcctggcatgtagtgaacactcattgaatgttggctgttattattgctctgagcagcagcagctgggccttgctgaatgggaagtattatgagaagcagtcttgaatgaggaagatattcttggctgagtaatgacatgatttgctgtgaatatgtggcattcatgctgaaattgtgagcctatcctaggtcttctgcctttttgtgctggacttctttgagtctcttagatggcaccaacactctactttcttcaattatgatagagtgctaattcatccctaaactatattggctagtttaatttttggttactgttaaaatgaatatttattagtaaaaattttcttaatcttcagttaaggtgtttttgtttttgtttttttccttcaataggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcaggtagttctgttgcactgacttgttcattaaccatttgtatttaatctgaacaatattaagcacctttcccaagaatatgagactatttgagatgcatgattctgctttattaaaaataacctggaaccatttaaaacatttgggagacttttaagagaaaagtgatcttgaaggtgttaaaataaagttttaatttatattatgattgaaatgaaaacgatggatacaattaagattatttacaaatacataattaaacatgttcacaaatgtgtgataacagaggatcattatagtacacatgcttttgatattcctgtgtttgctggcagggagtacttttccttaattacccagaaatggtttttgaaagatgttatctttgttattgttgcttttgtcttttattctttatatagtgtattgtggtagatttttatccattaccttaaaagaatattggtaattttcttataaaaaatacaaaatatctataaacaaaccagtattttcacatataattggaaaaatcagagaaattaaagaaggaaaacagaggaaaaaatacagtggcaaagaatagtaagtgttcaaaaagatagcggcaatgtgtaatggcagaagtttcaaaaagccactaagcttgcagcgttgttttttaaagtacatacttggatgtgtctctgttttgtgatgtatggagagggcgtttggaagaggaaggtctgagattctctcaccatcttccttgtgctttttgtttctgctttacatttaccttgtatggcaaatgtgaatgaacaaaaagggcactcacatcagagtttcttttatatgttgttgcatttttaaaaaaaattctaacaatgctccagtgccttttaggcttagtatctactcagctttgtttcttactcgctctgtcatggtaacactaacacaaatcaaaagaaagagaaataattttacagttgattccaaaccatcattttcgggcattcagcattccttctggttctaaatgtgttttacttttttttttcttctttagtatgcatagtatcttttccagtgattctgagtatacaattaaattttttaaaagattacttctgttctctgacttatctttccttctggatggctttttccttgtcttttttctggtttctttttttttttctttcttttctagagattcatgttgattttggggtatcttttcacatttaaagatgaggcagcatagactttgtctggagccatgtatgtacataggtgggcttttcagtttgagttagagttgaaatggatacaactggcggttaaggccacaatataaatgcttttgcttcagattagcagtgtagactaacttttgaaattagtgattctttttctttagaggccttttaaagtagatgtgcatcaattaaggttgataagtttgattctcttctgttccctaaacacttgaatttgaagtctacaggagtaatttagtgaatctgtaaatgtaagcatcatgatttttttaaaagtgaatttatattttcattgtatcttcttcctaaatatttcaaatacatcatcttttgaagtacacaggagtcttttgagacaccctttggtatgtgatactgttagttttttctttttcttttccgtgtttgtttttttttgagacacagttttgttttgtcacctaggctagagtacagtggtatgacaatggctcactgcagcatcagcctcctgggctcaacccttccccagacctcagtctcccaagtagctgagaccacaggcacatgccaccgcgcctggcaaataattttattttatttttatagagacaggatctccctatgttgccaagcctggtctcgaactcctgggctcaagctatcctcctggtttggcctcccaaagtgctaggattatagacatgagccaccacacttggccccaattgatactgtcaattttaatcatacctttaattgttttattttataattgtcaattttagattgatttctaagaaagatagggattaacttctgaaaaatattgtgttagctaggaaaccttattttttgttggatgtaatgtttaagtgaattaaagttatacaaaagtatgaaaagttgttttaaggtgttacaatagttcctaaggacagtcgtaacaaattacaacaaatggagtggttaaaaacaaaaggttattctctaatagttctagagggcagaggtccagagtaaaggtgttggcagggccacacttcctccattggctctgagggagaatcctttgcttccaccgtactctggtggctgttggtgttccttgccttgaggcagcatagctccaatctctgtcttcctcttcatgtggctttccctcatgtgtctgtctgtcttctggttttctgtttcttacaagaacactcaccattggatttagccccagccctaatccaggctgatctcatctcaagatccttaccttaattatattgacaaagaccattattctaaatagtgtcacattttgaggatctaggtggacatatatttttgcaggctactattcaacccgccacagatgttatgaatgtttacagctggatttttgcgttgcgtttagtcctatttaactctacagctttggagcagtttacttaagcttcccagactttagtttcaacatttttttgaggttaatataaagttggcctacatgctctttaagaaactgctggctgaaaaaatatatgatagtaagtttgttttgtatttggggctattttggtaagtaaggacaaattgcttactactgattcatctgcctgtaagcagcctcagtagagttgatttattgtttttcccttatgttctatttattattttctgtgttccaactcacgttattgaaagaattatggtagttgataacacaactgccacaacctattcctgtttttccgtgttgggagagcaaagaccaaaggcatggtgaaaggtgataaatgggctggttctgaatgatagtaaaggtagatatggcttaaaaagttgtgtgtgtaagttgaattaagaaaagtgaattgtggaaagagactagtcttccttctaagagagaagccagtcataattctttataaaacgaagaactgtttgctaagatgatttcttcattttataaagattcattacagagctctttgggtggggagtaatgattattttttaaaaatctcatttgtaagtttggtttttgattgtgtgtgtgtgtgtgtgtgtgtgtgtattttaaagtgaaacccaataattgattatcatataatgcttgttttttcaaatatcttatatcctggttaaattataaaagtttcttgcatttcgtgtgaaacatttcacttgttatctttgtaaggagttggtaattatatatttcaacaactggctctaggtttgatgttacaacatctagtattttttttttagtaggctcaaatatcaacaggcttttttcttttcacagcaagatgtgagtgagtttacacacaaattattagattggttagaagatgccttccaaatgaaagctgaagaggagacgtaagttaccgtgaagtttagcaatggggttttaggaattcattagatagcatgtattaaatgtcaacagagaaataagaaatcaagacagacttatgggaatcccagtattttctgtattattgacaagctgtttagaatttgcaggcacaaataatagtgtaaccaaaaaaatctaaaaagtgatccctggaagagctagtcttacatgcccagttccttttcttagattcaataatcacttttcatgacgaggaatgaatttgcggtggagaaagatgtcaggaatgtgaattgtgacaaaatccttttacgtagaagcatgaagacagggatatgaagtagcagtgcatgtgagcaagtggctctgttttatctgttcactcagggccccgaggtcacctaggtttctgggatcttgctggcagtgaaaattatactgtgtctctaagtttctgcccagaggtgacacacatcacttctgcaaacattttgttgggcagagctatgtggcctaacttcaaagtgagtaggaatatctcacactaattaggatggcggctacgaaaaaaaacgaaacaccccccccaacccctactgacccaagaaaataacgagggttggcaaggatgtggagaaattgaaacccttgtgcagtgttggtgaggatatgaaatggtacagccactgtggaaaacagtatggggatttcttaaaagattaaaaatataatcaccatatgatccagcaattctgcttcttggtgtatatccaaaagaattgaaagcagggtttcaaagagatatttgtacacctgtgttcatagcaacgttattcacaatagccgaaaggtggaagcaaaccaaatgtccattgataggtgaatggataaacaaaatgtgctgtatatacatacagtggaatattatttatcctgaaaagcacagaagttctgacatatggtgtaacatgaccccttgaagatattatgccacgtgaaagaagccagtcacaaaaggacaggtactataaatcacttatgtgaggtatcaagagttatcaaactcttagcaacagaaagtagaatggtggttgccagaggctggggggagggggagatgaggagttgtttaatgcatatagagtttcagttttgcaagaggaaaagaattctgacattggttgcacaacagtgtgaatatacttaacattaccgaactgtacagttaaagggttatgtacattttatcacagttttaagaagtgagtaggacagtgtatcttaccatgcacctgaacgtgaagggccagaattttttttcagtagcattaaagactgctatactacctactggggttcttgtaagaattaagagaagtacttatcaacattattctaaggattaaatgatgacccatttatcaagagagatggtatcccctctctccctttttaaacaatacttcacaaatcaattaatataaacacaaattaatacagaaaaatctgtacacaattgtggatacaacgcatttctatacagtaaggcaaggataaactttgtctttttaggtcacacaaaccataaaaagacaatttaaaattttcaacttttgtttgctccaagcagaaaagaaaaaaatgaattttggtattaaatgacttggaaaatttgtagatgactaattctaccagcagtgtgaaacttcacaaaagaatgaagtagctgttcagctactttgggtgaaaaactggtacctcgttccctccctggtgagggttgttgtttttggatttttttggactcttccatgtaaatacaggaaataacctatcaaaattttgtagaaatgtattctgattaaaagtggcttttcttccttcccatgtccaaataaacgtgcactacacagagtatgagattgaaatgtgtaatgatgataggaagagcaggcactttgtgcacaaactgtgtcaatttctcttccaagttcatacacgtagtagctcattttaactcctatgagagtcctgtgggtgcagctatcatagttatccgcagttgacaggtaaagaaatggaagaataagtaccttgtgcaacgtggcactgtaaataacagagctaaatgcaagtgcgtgatagccacataagtgtttttgtcttgtcatatgttatagttctttaatattttctctatttataggtccgaaaattgtaatcacatttatattttttaacatactttagggatgaagagaagccaaagaaccccatggtagagttgttctatggcagattcctggctgtgggagtacttgaaggtagagttatacatttactttttattgcaagtgaagagagattattattcattcattcgtctcgatagttactatttttttagtggactttatttttaatttgatatattctgtctagtaatttttgttggattgctactgttattcacataaagcacagaattgaatgaaggaaaaggaatgtacagagtgcattatcacatactaattaatactttattttatcctcatgttttttccagtgagagggcttccatgatacaattatgttggaatacagggattaatgggatggttgatagatcctttgaagataatattggagttaaatactgggcttgatatgatgctcactttctttttcatgttgaaagctgaatttagcaacttagcatagtcagggtattatagagttctcactttttcagtgattttaaatgtagatattagttttcaggaaaagattgtactctatcttttgaaaaatcagtgaagagtgatactactccatttaagctaaatacctgtttcttaaaatttggcctaagtagtttctgtttgggttccctaacaagggaggagactctttaaatgtaacttcatgtaataatattaggtcccaaagcataaacttttgaaaaattgtttttctcacatcacccaatgcatcaacttttgaaagttatctttttccagatcagctaaagtgtaaaatttgaaaaaatgctttttcttcacgatcttaagtagtggattccctgaagttctgtttgaacgtaggtggtttgggattcagaaaaagacaatactaactcagatgttggccctttaaaaagtcttagtgacatgttcgtacgtttttgtttgtttcaagtggtaacaacttatatataagttgttttatatatatatgcacatatatatgagttaatatatataagtttatatatatatgtagaatattttacatagtacatttacgttgggtcattcatcttaatcattctgattttatttgaagtagaacactatctgatgcagcgagtaggtctcatcaggtcatgactaggcactgtttataataccctgcatgagcatttctacctgtattatattgattcctaaaattgattgttattaaaatatttaatttgttggctgggtgcggtggctcatgcctgtaatcccagcacttcgggagcccgaggctggtggatcatgaggtcaggagatcaagaccatcctggctaacacggtgaaaccctgtctctactaaaaatacaaaaaaaaattagccaggcgtggtggcaggcgcctgtagtcccagctactcaggaggctgaggcaggagaatgacgtgaacccaggaggcggagcttgcagtgagctgagatcgggccactgcactccagcctgggagacagagcgagactccgtctcaaaaaaaaaaaaaaaattaatttgtcaatccagtgttgaagtctttgtacttggtattagtaagttgctttagtgattgtgttatataaaggtggccttaatacgttttcacttgaactatgtgtttgcttcagtaaaagtaatttatttcagagtactttcttatcactttttacatagatcttcctaatactttctttcaaaccaatggttcttcattagggatgatttttagtttgtttgccaaagtacccccactgcaaaagtccctcaactttttgagaacttctagttcattgtcccctctcagcccttctctgtacttcactccttcctttttcatctaaaacctaaaactctctttccccccttcccttctggcaccccctccctgttctctaaccttcattaagctgttcatcttttctgtgtctgtactgagtacctgaagattgctggcaaaaagtcacagaaatgggctaactgtagtggatcatgaatttgagtgatactgagcttccgtgctcccaatcctataacccaacttgttctgtgtaatcaccattctttctctcatttactgcaataaatattttcgttttttccactcatttcagatctaacttatctcttcattctctgagaaaatctttacctcagatttcatagatttactgtcacattaatgaaacttaatcacaggttttgcccagtccccgaatctaattttacatttgtagttttgtatcatattctaaaaacacaacattcccaaatatatgagcctcaggctccataacctagatctatcactacctctactatatttttacctgctcctacatataataaaggaattacccagttttatatcaaaagactgttctttatacgtgctcagaattccctcccttcatgcttttactcagaccttacttcattcgttttttcttggcttttgagcttctcccactctttctttctcatcaatatttacacattgtctggtatctcaaaccttaaaaattaaaaacgttatcccctcccatactctttttcagttaataccctctcttgattcttattcaaaattaagcccctttaaagagaggagttagtttcaactgattactccccatttattaaacctagccccagtttagtttctggcttcagaacttgtctaaaagggatcttgctaaggttattgattttctacatgtggttaaatccattagatccctttcagtttctgatatagtttggtcatgtcccaaaccgaatctcaacttgattgtatctcgcagaattccgtgtgttgtgggagggacccagggggaggtaattgaattatgggggctggtctttctcgtgctattcttatgataatgaataagtctcctgagacttatcatttattaaaggcacttcttccatggcggcgacaagagaaaatgaggtagaagtaaaagtggaaacccaggataaacccttgagatttatctggggtttccacttttacttctacctcatttcctcttgctgctgccatgtaagaagtgccttttgcctcctgccatgattctgaggcctccccagccatgtggaactgtaagtccaattaaacctctttttcttcccagccttgcctatgtctttattagcagcttgagaatggactaatacagtaaattgggtccggtagagtaggacgttggtgaaaagatacctgaaaatgtggaagcaactttggagataggtaacaggcagaggttggaacagtttgaagggctcagaagaagataggaaaatgtgggaaagtttggaacctcctagagatttgttgaatggctttgacaaaaatgctgatagtgatatgaacaataaggtccaggctgaggtggtctcagatggagatgaggaacttgttgggaactgaagcaaaggtgactcttgttatgttttagcaaagagactggtggcattttgcctctgccctagagatttgtggaactttgaacttgagagagatgatttaagatatcggtggaagaaatttctaagcagcaaagcattcaagagatgacttgggagctattaaaagcattccattttgaaagggaaacagagcataaaagttcagaaaatttgcagcctgatgatccagtagagcagaaaaccccattttttgaggagaaattcaagtcgtggctgcagaaatttgtgttaagtaacaaggagccaaatgttaatccccaagacaatagggaaaatgtctccaggatatgttataggtcttcctggcagcccctcccatcatagacccagagaagcctaggaggaaaaaatagtttcgtgggctgcccgtggtactcatgctgtgtgcagcctaggaacttggtgccctgtgtctcagctgctccagcttttgctagaaggggccaaggtgtagctcggcccattgtttcagagggtgcaagccccaaaccttggcaccttccacgtggtgttgagcctgcgggtgcacagaagtcaagaagtgaggtttgggcacctccacctagatttcagaagatgtatagaaatgcctggatgtccaggcagaagtttgctacagagttggggtcctcatggacaacctctgctagggcagtacggaagagaaatgtggggttggagcccacacagagagtccctactggggcaccacctagtggaactgtgagaagaaggccactgtcctccagaccccagaatgttagatccactgatagcttgcattgtgtacctggaaaagctgcagacactcaacaccaacccgtgaaagcagccaggagggaggctgtaccttgcaaagccacaggggcggagctgcccaggaccatgggaacctacctcttgcatcagtgtgacctggatgtgagagctggcatccaaggagagcatttcagagccttaaaatttgactgccctgttggatttcagactgtaacccctttgttttggcctgtttctcccatgtggaatggctgtatttacccagtacctgtactccaattgtaactcttctcaggaaaaaaatcagtcagtgttacagtttttaggttcaggtgagaatccttacataatcttaattttagtagccaaaaggccatgttgaggatcattaattttctcccttcttatagggagtaactagcttgcttttgatattacaggcttgtaggcggaagggacttaaccttgtcttagatgtggtttggactgtggacttttgggttaatgctaaaatgagctaagactttgggggattgttgggaagacatgattggttttgaaatgtgaggacatgagatttggaggggctagggctggaatgatgtggttcagctgtgtcctgatgtaaatctcaacttgaattatatctcccagagttcccacatgttgtgggagggacccaggcggaggtaactgaatcatggtggggcagtctttcctgtgctattctcatgatattgaatacatctcatgagatctaatgagtttatcatgggtttccacttttgcttcttcctcatcttctcttgcctctgccatgtaagaagtgccttttgcctcccgccacgattctgagggcttcccagccatgtggaactgtagttccaattaatcctctttttcttcccagtttgggatgtgtctttatcagcagcgtgataatggactaatacactttccatattgaattcttaccagttgttaatgctgatgactcttaacctcttcttcctcctttttcctattctttccttaaaaacacatttctctggcttttgtaacaccatattcttgtggcttttttcctgcctcagtgggtacttctaagaaaagttgtatttatagtctctttttgcatataaaggtagcagaaccttaggactttgtttaggcccatttcttcttcctgtcccatcccctaggcatctcattcagtgccttaatttcctgctgtcaataagccagcaattctatctttattccagaatgttaatcttagttacagattcatattcaactgtcttctcaaattgaaatctcatggatcataatgaaccagtgatttccactgctacctcaaaactaaagaaaaaaaaaatcctgtgttcttacttaagtggtgccattttcagtccataatctgccaggcatgatggttcatgcctgtaatcccagcactttgggaggctgaggcaggtggatcacttgaggtcaggagttcgagaccagcctggccaacatggtgaaaccccacctctactgaaaatacaaaaattagtcgggtgtggtggtgggcgcctgtaatcccagctactagagacgctgaggcaagagaattgctggaactcaggaggcggagtttgcagtgagccgagatcacaccactgagctccagactgggtgacagagcgagactctgtctcaataaaaaataaaatgtcatcatcatcatcatctagttgttcaaaaaaaaaaaaatagtaatcattatcatcatctagttgttcatgccagaattctgttattcttgatattttccttcttacctatctcttatcctgctcagtcaagtcctgttggtgcccttccttgcatatatgtataaatgtatatgtatgtaattttatctcttttctgtatttttacttttaacaaccttcatccatgctacctttatttctggatagattctgcaatagtcttttaacagatgaccacccacttcacacagggactttaaaggtgtttcagagacataaacctgagcctgttattcttagatttaaccattcagtgactgtattagtccatttacatgctgctgataaagacatacccgagaccgggcaatttgcaaaagaaagaggtttaatggactcacagttttacatggctggggaggcctaacaatcatgggctggggaggcctaacatggcagaaggtgaagggcatgtctcacttggtggcagacaagagaagagaacaagagccaagccaaaggggaaaccccttataaaaccatcacatctcatgaggcatattcactaccacgagaacggtatgggggaaaccgcccccatgattgaattatctcctgctgaatccctcccacaatacaggagaattatgggagctacaatttaagatgagatttgagtggggacacagccaaaccgtatcagtgactttgcattatacccagaatgtggtggggaaaaaaattcttaataggaccacaagaccttgtagattttaactcactgcctgacttttcattgtaatctctcccttggttccccaagctacactaacctcctgttagttcctaaacatatcaacttctttactgccttaaagtcttcatcatgctgttccatggccaagaatactctatagtcccccagcactctggcatggctaactcccactcattattcaagtctgagcttaaatgtcctttgccatggaggtcttccctgctctccccaccacctccaagactaagctcccatttttatacctctcacataattctgtctcatcacaactttctttttataacaattgtaatataattatttgtaattatttgtttataaatatatgtgaagttaatgggtataatgttttttaaatgaggctgagaattttctcagctcagggaccatatctctcttgttcactgctgtatatattcccagtgttcagtacagtatcttgcccttagaaaatgcttcttgcgagaaaaaatatacatacatatgtgtgtatataattacatatatgtggatgtgtaatatctatggctgggtataaatgtacatttgcacatgtgtataaaccaacaggaaaattaacactaacacttctcaggaatgaaatcagtcagtgttacaattttcaggttcaggtgagaatccttacgtactcttaattttagtagccagaaggccatattgagtattattaattttctcccttcttataggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagaggtgagtttaacattttcattgtcccctttcttccctaggtctttcttacaatgctatagcacaatgtaaggttctaattatagagctacctaataattgagagagaatactcagagagtatgtttggatttaattggtaatttagacattcaggagacctgtccagtcaatatggcctataatctatgtcaaattctcacttaaataatttatctcagaattttaaaatcttaggacattgttcagtctttttagacctttcaatcaaggtaccagccattagcagcatgctagttcctcgatataaagaagaaaaatcctgatattacagtggattttaaaacagatatatgctacttatatcaactgttattggaatttgtccacgatgcccagattccttttcttgtaaaattgctatgtgattgcataaggtcagatggaagaacttcccttctcaaggaagaaatcatttttataaaatattgttaacttatatgtctacctcaactagtttctttctttccagccatctctgtttctttatccatctctgtagctgcatctgtgtagccattcatccatgcattcatctgtcagggagttttggcactgtaatagtaagcaaaggacatacgtgcttccccaatcagttactgttaagaaattgctgatagttgtctagctgttaaactccatgaatgtggctagaggtctttatctgtgtcattcactattatatccctagtggtaatatggtaactgcatacataatacttattgagtgaatgaatgaaatgtcttggtgcttatcaaacaagtttctgaggtctttatactgaataggtgcttaataaatattaagtgatacgatgtctctgtgtttatctaaaaggagactttgttcttgtgtttttgagaacaaattgcttttgtctaaattttaatttttttttcttaaagatgcagttaaccctttcctgtttcaagtgcatactcatttttttcctcttcccccccacatacataaacaaacaaaaatatgcttttcctgttaagaggaagagatgtatttgaaatagtctttctctctacatcgtagatcatctatttcagtgattctcaatagagaatagccagacttcaaagttatccaggcagggtctacgatagggatgtggtatatggacacaagagctgcacaagtaattctgataaaaacctctaaataagaatgtttaaattcagcttattttattgattgggaaacagatctcttaagagtgggactttaccagtatcccacaatggaataagaaagcagactcttaaaatccgatctgtttgctgttaaatgaaaggatgattggggtagtaaggcagggatggtacttgtttttatattatcagagtagctgaaatacactatggtttattggtaatctttctcacatattcccagcttttaaaaatttttattgtacacagaattgaaattttattgtttatttaaaatatcttagatttgtcctccatctttttattggttttatactctgaatgcccctatgttgcaatataaatgttctgcctaggttttttcatctagcctagggaatataatgatttatgatggttctctattttagcagtttctaatctccactactgtggcaaatttgattgcctgtgattcctgctaccatttttctagatttgctggaggctatagtttcaataataattcagcttgatttaagagactgtcactgactaaagtatagtatcagtttttaaaaaataacatatttaaattatagtcttattatatcctttagaaaaagtattcttgaatctctaaaagccagtaagtaacattacagactatttctaaattggcataatccctgataacaatagctttttcctcaatctattaaaaattgttgattttattttggcccagagaacatcttatttgctgaaatagctgtggccaactaatatataggaagacctccagtcttccaagctaaaacatccaattggctataagagtttaaattttgtggatgatatactaagagacaactgaataagttaaacatgattatatccaaaataactgcttaaatattttttaaatgatacattttaacttttaaatggtatgcaatttgtagatgagtcagactctccaggaaacatggagatattttttgattgtctgttggaggaaaaaaatttcagatagtaaatacttcacttgtagtgtgagtattcactactaccagtgtgtgctgtgtgttcttttagactattgctatgcacatataagtatttgcatctgtccacactgccccgaaagttgcatttttcactcagcagtatatcatgagcatgcttctaagttagtgtagagctttacgtcagtgtttttaaaatctacatagtgtcacatagtctgtatttataaaattaaattgatttaattatcctgtaaggcagtaactcgaaaaagaactattctgaagaatgtctttgtataaatacccttgcgcacttaggaatgaagtatagttagaagtagaatctttgggtcacagggcatactcatttagatgtgttggcactgccaaatttcccttcacaaagttgtaccaagttataataaagtgctagaaggagtttttacaaagctttaaaaacaaaattagagaaacaatatcgacatgtaccatattagacatctgtagaggttatatggggaacttaacttttgaaatcaaagggcaaatgagtcaaggcaattaaatgactggagctaattttttaactggaataaaaagtttttgcttcttgtgcatagtttacatcctggcttggtttgatattccgtggggaatttgaagtgataggtgtgttttttctgttgtttttttctctccacatttgtgtaatcctctcataaaagcaaggtatcttatacactttaatagaaaaccagctattaaaactcataaaaatgacatactctttaggaactacttttgttaacaggtgagatttctagaattgtgatgaatttagaagcacttgtgctgccaatactgattatgtaagttctttattcactaactgcagaaatctattcctcctgtagtttcattatctagtaaaataataatatgtttagagatatggagaatgacctctgtctcacaagcatggcatactagttagattgtagacaagtagatatagttttttgttgaatggaaatatttttttgaaagaaaaatttctcatgtttcgtattatttaaaattcaaattatgtactgctatactacaatccaaatattgcagagctagacataccattaatattttaaaacatgaatttacagaatgtctggttatctcatcttgtccccatcagctttagaatgagaaagtgaaatccttccactcttgtagtaggaaaaacctgccatcgctgatagaggaaaatgcattcataacagagacatattacataacatttttgaacatccttttgtaaggtatggaagctatttatatttcctggacttttcatggtctacagaaaagtgtaccccagtttgggtcatttcatttcttgtggccattgtagatttccatgaattaaaatatgtaactatttaattttaatggtgacatttaaagtattgcaataaaatatgaaagtgatagttcttgaaatctactttcttgtttgagtatcataaaatggagcagagaatattatcctaaagaatcaaaagtgttctttctgatgtgtctggggtaatgttttaattcttaataataattttatatgtggattagaactaactcaaaaattcttgccagttccatgtgagatcaaaatgagtaagcaaactttgctaatcaaattttaaaacttgagatgtttcttatatttttcataattttatttaatccgtttcaggtattatccatataaaacaaattccttaaactttagctttcagtaaaagataaccatccagctcaggaaatctcagttcaagtaattatagcattttgaaagagaaatagtattgaataccatttgcttttatttgctgtagagaaaagtagcaactttccagatcctcctcagattcagtttgccagatgtgtgccattcatgctttttttggatgttcaaatttaaatttggtatattcttaacttattgacagatgtgtggtggcattttgtgacacttgaaattatcacacacaatagattatgcagcagtttcgcatattgcagtttataataagcacttcagaactattttatacttctgttctttgttgatttacatacaatctttctttctctttaaatacatatgcttatgtataatttgaggttgtatatgaaaataattttcttttaaaaatgttgaatttcatgcttaattgaacagttaccaaagcatgtatggggattaggggctgggggtaggggaaggaaattacggctatactcattatcagaatttggctcatagcaatgagacattcaattctttaaacactagttattttaaaagattttaagtaaattactctaagtattaactttttgttagtgatatgtctttttcataaattagtatgaaatccagcagaggagctaaagctaaaacaggaaaacaccattttttcatttttagtatgagagttgtgacgatttatgatataaatttttttttgagtactccctctcataagttattttatcacaggattttgatgctttggttaagtataagtgccattcaacatcacgttgaagaagacagagaagacttgagctactaagtcatggttttaaccagtgtctttttctttgggctagaaattctaatgtaaagaattattttcgaaggatagttgtgagatttctttttttcctgatcatatattatacccactcttggaattttcaagaggtgtggaaaacttttagaaagaggttgagttttaactaaactgtgtacccagttacttgtcaggtccgcattgtggtgatacatataacaatgtcagtgcccacatcctgtgcctaagattgcagtgaagaaaacaaaggtggtattaaagtttttgttattgttttatttcctttcagcattggtttactgaattaccacctgtgttaacatttgaattgtcaagatttgaatttaatcaggcattgggaagaccagaaaaaattcacaacaaattagaatttccccaagttttatatttggacaggtatggtttgatatactgcatgacttagtttgaaacagtttagtaagggagaaaatattgtttagaggaaaattctgcataattttcttagaattaatttctacttttgcataatatacctaataccatttgtcaaggtagatgaaatttactttgtattagaaaagtatagtttttgggaataatgttataaggaaatttaaaaaagatgaattttgtaatcttaaaattcagaattttaaaaaataccattttgtattatctaccttacatcttatacaattttgaatgaattgatgctttgtggtgatgtctgtacttaatattgtatctatctatctttctgtctttctttctgtctctctgtcttcctgtctttctgtcttcctgttttcctgtctttctttcttttgtttttttctgtctgtctttctgtctatctttctgtctttccttcttttttgttttgagacagagtcttgctctgtcgcccaggctggagtgcagtggtgcgatcttggctcactgcaaacaccatctcctgggttcaaatgattctcctgtctcagcttcccgagtagctgggattacagacacccaccatcgtggctggctaatttttgtattttagtagagacgagatttcaccatgttggccaggctggtcttgaactcctgacctcaggtgatcctcccgccttggcgtcccagagtggtaggccgggtacgctggcatctggccatattgcatctactttcatgatattcggaaatgctaatgattacctttttctgatagatacatgcacagaaacagagaaataacaagaattaagagggaagagatcaagagactgaaagattacctcacggtattacaacaaaggctagaaaggtattttaacttttatgaaattaggagataattatcagaaaccatgtatttggtgactagatttttaatttcaaatttgctttgagtgatttataattttaggagtagttaatattgtgtgaatagttttgagttttgcttgaaactaaaaatctatagtagactttaaaaaattattctagtgtttaaaattaaatatctcattgtcaacaggtaatgttcctactgctgaaaatagatacaaagttaaatgaatatagttttgaccttcctttttgcatgaaactaaagattactcttgagattttcattaaaatgaatggtatctgagtttttctccttaaaacaggatacaaactcagctgcctaccaagtcttctcagcagcttcgtaaaggaggaaattgtgtcaggtgtaagatggtatgtgccgggagcctagagagcaatctgtgtgtacagggaatgaatgccattccataccagtggatggtaccatgtatgagtatggcctcactgttgtctattgatttggatcatttctaaaagacgtcagaatctggactgagaaatgttctacaggccagacagaaatctaaaggctgaaatgtcacaagtcatttcagtttgcaaaccccaatctgctctgcattcccctattttaggaattttcaaattagtagtctaaaacttcttacatcaaatagtatattgtattttaatgatttttattcttaaaaagtatgaataatcatattgaaacatgattagtggtaaaagataggaggatagtacacatcactgtcttgatcatgagaccagatgccagatctaaaaataaaaacagtctcaggagatgtcagttttcatcttcctattgagttacaatttagaacagcatttacagattataacagtatatactcacattcagtcccaatcggccttggtttcctgtctttggggaacttttaatgtttttcttaagtgtatattcagttttaccatcttcgttttaaagcaaatgaattttattgctgaggaagttttattgaagtatcgtatcacgttttataataataataaaggcccaaatatgctgtatatagaaataaaagcatttgtacattttatgattaacagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaaggtaaaaagtaatcctgatgcaagagacagttgttacctttattacacaataatgtaactgctgcctttaaagacagtttctataaaatgtatgctttgatttacttcagtgaactcctaagagtagattcacttagaagactgtatgtcctctgggagtttttttattatttcagtagattttatggttatggattaaaattttaatcacattttttttcagttcagaattatactttagcatgttttggtatgtacatatataagattcagcattttatgatccataaaaatagtactatcaaattagaatttgtttctgtaatgtaagctgataagccagggaaaataatatcaccatgcgtaagattttcttgttttttagaaataaatatgattaagctgttttaactctaaagctacaacttcatcttataataatttagttcttatgtattaaaaatctcatttggatgttagatcaatccacatatttctttaagattttttcttttgaattacaagccaatttaatactgtgggtttggcacgatctttgtcaagagtttcagcttgaaaggttaataagaaatactctatgctttgatacagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagaggtaagaagtgtctcatagcatggttactgtcacctcagatggatatgtgtaatgttaatattgagaagggaaatcacgtctggattttatatttaaatattatagtcatttttcttttccagaaagggttttaagataaactagtttggctccccatttttataatctcaatatcaggttcacagggaccaaaagattttccctggattgcttagctgattaatgacatagcagatggcctgattttctagtttgctgctctaaatttatatcaaactggtattcacagttactccattggagaaatgtcatacaatatcaatgtttgtacatatcaattaggtactaaatctaagtttgcacagggagttccggtgattaaaaaattttctttgggcttaagaattagaaatgtgaattttaatttttaatagctctaacagatttatgagtatctatgatcccattactagtctgtaacagagtttttactggcatgcagcaaaataagaaaaataaggacagtgctctgggtggggtgtgtgcacttgtgtgcgtgtgcgtgtgtgtgtgtgtgtgtgtgtgtgtgtgtgtgtgtgtgtcaagttgccatctgtcctttcttggaaggaactctcttttattcttttctattctattttttcttttttttcagaataagttattctgaacttttctctttcctactttgctgctgttaaagtgtacttaaaaaaatggattatggtagattttattacatttttttccttaaatgtgaaaatataattccctattatcattccccaattttatgctgatttattgatttttgaaaaaaatgaactatgtgacatggttggaattatattgaacaatattgattgttggatattatatgaccaacttaactctttatagacaatatttgaaaaagaatggccctaatttagtaagaagtacataaggtatgatggtgactaacagcattagtagctgtcaagattttctttagtatttttcaaataagagggaatttttaaaaatatttgaactcattaacaaacattaatcaagcaaatagtgttgatgaagcactatattaggcgttgggtaattttctactcctcatggcaggttgtttttaaaagattacattcagaggagtggaagctaggaagcttttgacacctaagtagtggcattgagggagggaagaagtgaatgtacttaaaatactctttggagacaactgacagatgtgggtcattggctagaggtaagagagagggacgaatcgaatgattctctcagttcataatggtatgaataaccaaatagaatgtattttggaaaaaaggtaaagcagtgggcaaagaggttcccactcaggggaggaaagagaaatatgatgagttctcttttggccattttaagtttgaagagcttttttgagacggagtctcgctctgtcaccaggctggagtgcagtggcatgaactcgggctcactccagcctctgcctcccaggttcaagcgattctcctgcctcagcctcccaagtagctgggattacagttgtgtgccaccacacccaactaatttttgtatttttagtagagatggggtttcaccatgttggccagggtggtctcaatctcttgaccttgttatccgcccacctcagcctcccaaagtgctgggattacaggcgtgagccaccatgcctggctgttaagatttttatatgtaatactatggatcaggaaagaaggttttcctcaggatattttttttctttctttcatccatattgatgttagcagttagcattattttgtaaactattgtgtaatattccaacacacgggtatgatgtaattcatttaattcccatattgatatttcctaaatagtgctggtcttcgatatacatatttatacacttctgtaagtaggatatgttcttttttatgttcaggggtacatgtgcaggtttgctataaaggtaaattacatgtcttgggggtttggtgtaagattatttcatcatgcaggtaataagcacagtacctgataggtggtttttccatcctcaccctgctcccaccctccaccctaatgtaggccccaatatctgttgtttccttatgtccaccatttctggttcagagtgtgtatattttaaattttgacgactgttttaaaattgtcactccaaaacattaaaccagtttgcattcccactgtgtgagagagcctgtctcccagtatcctccctagccctggacactttttagtagtttttcacaattgaaaaactggtattttagtgttttgatttgcattcccttagcttcgagtgaagttggatatttatattgttctgtaaatttcttgtttgtgacatttgcccattttttaagtattgagctatttgtatttttcttattacttaatagaaagtttaatgtattgtggatattaacactttacctataatatcacatatgctgcagatattattttcccagtttttcatttgattttatgttggttttgttttctttttataatgtagattttttaaagtgttgggcagggaggatcttatcttttcctataaggttactagttttctgacaggcttaagacaggtctttccccactctaaagttagccagtttcttttatagtttttcaaggtttcttcctgattggttcagcagcttcacaatatgatgtggttacaatctaaccgtttccttattgacagatatttaggttatctcttttttaaaaattattgtggacaatatgactgtgaacatccctatctgaacaattttgtaggattattttctactagaagtagaaataattgtcatgggagtgccataattttattttcactggtgattatagtcgatttttattcagttatgtgtgtgtacaagatatgtggtgaacatgttttactttgttcttaagtttacttgtgttatagcaatatgtaaggaagcttagctttcattttcattgaaactctcctttatagatttgaacaaaattcacttttattggctctgcacattttctagataaatcatatttgtgttgtttttaaagtatgcatttgtactgtgtcttttattaagaataactataattcattttctacagatttcaaatggtaatgttttttaagaaaagttttaggaaaattttcctattcctctaacatgtttgtaggaaaaacattagtccttatcttataagtagaaacacatttgctgttaatcattaaatgacaccttatatccttagatttgcaggaaagcatatccagaatccatcgaacaattgaattaatgtactctgacaaatctatgatacaagtaagtgaaattttgagctagtaatcattgtcaaaattatttacatatattttaatttacctttacattatcttaatctaatttttctttacatgttttgttttaaaattttggcaaatcttattgtaaaataataagggcttgcaatatgtacaatgtgacagttcatctgaatggggaaacttttataacaaatttataacaaaattcatgacaagttttccccattcagttgtattttcacaccgtatgtgttgtgtacccttactattttacagtaaaatctaccaaagtttttcaaaaggctatagcatctttaaaaagtcttatgggagaaaatctatggttgttaaaggatattaagatttgggaagaaacttaaggactccattacattttaacttctggtgtatatcatataatctattttgttaaccgtcaatttagaattctgaagatgtagacacatttgctatatgtaaaactgcccactataagctttttattcaaataaacaattaggccaatgagtatgtacacaataaatacatttttagtttttcaaaaatcatctttttaatctatcaactttgcatatctttagcttattcagattccgtctttttaaagttttatagtttagtttttttcaaacttttaagcccagccagttctctctcatttaaaaaaaaaaatgctcttatggttttctccaaacaggttgtttgtggatttcatggaatgtggtatatagtaaactacataattgcagtttaactcttctttttttcacatttaggttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaaggtaagaatatatagggtggtgtgtatttttaaatagtcataaaagtggctctggtatgtggtgtgattagttaagtgtaattcactcagacgatgaaggatgtggttaggaaatgctactgggttttgacaagactgaattgaaaagtaatgtcgtcagggctaagaattcgtatatattttgtattccaagtcaactattaaaggtaaatatgacctttttcgtccttgctaaaaatgctttagtgactgttccacagattgactcacatttaatatttaattccttagcctaacatatatggcctctgttcttggcctctgattatctccccaccttcattgatcaccagtgttccttttgaatttatatccttactgaacttcttgctgtatctgctcatatcaaaccatttcacacatttatgtttgcatgttcgtatatgttttattttttgctagtaattcttttgcctaattcttgtttatctgtcaagattcaattcaggtgtcatttcccctgcaaactatttcttgatctgccaaaaagtatctctccttatgctgtcctggcatctgtctactgggcatttactgttgtgtattggaactgtgtgatgacttgtcttgcacatttctctcttatctgctcagagccagagatcatgtcatactatgtctgaatctttttaatgctgatattctgatatatgctttgcatatagaaaataataaaggtttattgaaactgataaaaataatctttttatatttagtcattcagaatcagctaggcagtccacttctgactaaaaaaatgaagttatttttctgtgtgtgtagtagaagttcagtaattcttctgaatactctattgtttttaagatcttgctatattaattttcataattgcatatttaagtctacttaatttcttcatatgacaaacaattttcattttattttgagctaataaggttaacatgattatgagttgtttacattttgtgaaaagttttactttttaagtgatcaaacatctggtattttccaatagtggcagaagtagtattacatcactgttagagtagcaaagaaaaaaaaaaatggccgggcgcggtggcttatgcctgtaatcccagcactttgggaggccaaggtgggcagatcatgaggtcaggagatcgagaccatcctggctaacacagtgaaaccccattctactaaaaatacaaaaaaattagccgggcttggtggtgggcacctgtagtctcagctacccgggaggctgaggcgggagaatcgtctgaacccggaaggcggaggttgcagtgagccgagattgtgtcactgcactccagcctgagtgacagcatgacactctgtctcaaaaaaacaaacaacaacagcaacaaaaaacttggctttggctttgtattttctgtcacttctactcttaagataaaaaaaaatctgagaccattacctatgatggattatcaaatattttcatcattgtttttctgagcatttgtttgagttttaaaaagttttgtagataataattatttgctaagcaatagtaattcttaagtaatatgattggctgagtggtaataattcatagtttaaattctatttgaaatgcagtctattttgagctttgcattttccctttaattcttaattttatactagtttttgaaatatgatttgcagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacaggtttgtccatttttattaagttgtgtttgattatcaatattatttttataataagatatgctcattattaaaaagttttagctatcttaaagtgtgaggaaatcagtagaaatcatttcaaattccatcactcagattatcacagttaacaatttagtttacctttttgccagacaccactgtatatatttatatgtttttcaagataaatgagataattctgttgactttccctctacctactctgcctgtgttgggtgggcttgaattttcttggcaagtagcagagaaagctgtgaaatcagcaagaaacccaaaccaattcactaaagctatcaagagtatcaattcaataaagctatcaagagtatcaattcaataaagctatcaagagtagtaattttaaatttggccaaaataatactaccggtatattcatatatactttgtgcaatagtaaaatactaccattaataactatttgatgtttttcggaattcttaagattaagagaaaattgaccaaaactatttagtatatcacaggtaaaaagtaagtgtatagacctgtaaaccaaagatataaatgcataaacatataaatatttaaaaacattattctgaaatgaactattagctgatgaaatcaataagtcaaagtaaacactgtataggaattaagaaaatagtttctagtaaaattgaaaatatattgtctttttattttcttaaaagattactcttcactgagttgcaaatatgttttagggcaacatgttttctggtatagaaaatgctatttctcagagaagctataaattaagcgcatatattttcctcaaactcatttgtctctttttataactgctagtggatattattgaataactttttttttttgcaagatctgcatgttttgtgttttaaggaagtagttccagcttttgtttgtttaatttcatctttcgcagacagaggtttccttgcagcattacctggttgggcttcagcattatcatttgaactttagaaggaattattacttcaatagaagattgttttacagtgctacaatgtagtattgtgactgtcgcaggcatgcacaaatctgtccagatacttaacttattttcatgtagatcaaataattgtcgttgattttgatcctgagaggcagataattcagcattttttaaaaagataatggtatcacagcaacatttggatactacagtgctatggagaataccaccattatagtggctggtgaactctaccattatgtagggctgcacttttcccccacgtgtacaaggctaccgcgtagagcaggtgaagctatgtgggtccacaacaatgtagtttttagtagatgtcaagaggtatctaagctcaaatcacagtgtagtaactatattatagttcctttcatttttaaaacatttctgtccctttgtgatttcatgctttgcattctgtacatattctttccaaatcactcctcagaacctgccccaagatggagctactgtgttattgttcccttaacatttacttattccattcacatgtgactattcttgttattagtgggaggaaggggctgcatagtgtactataagcagttgtggtacctaagctcccagacacaggtgaatcctccattcattggttaagctccagttttattcttggctcacctatattttgtgataccaaaatattaagttctatatatcctcctcctcttcatcctgtctgtttctcatctctccaaattttcagagttaacatattttatttctgcttagtcaaacgaatacatatttccaactaatattcctatctattaaggactagccttgccccatcctcattttacatttgtcatcttttttctttctctgtgaaaagaccatgtgtgcataactgcatccattttcatgatcaatacatctgaccatacactttacatggtgttttgtaatttttaaaaaatgcagtactaggtattggacatatattttcatgtctgtttttaccatgcaaaataatcttagaatgttgatatatttctgggaggaaccagaataaaagatgaagagatggaaatggtcaattcctattcctagataacttttatagttacctttcagcgtgggttatttagaaagcagtggtaatactacttctgtaggaaacattgtatcctccatagacttgacggaaatatgcacttggtttgaattagtagaagtagaacatgccaagtccataaatttacagagtgagattgttgtttaaaagattggtttctattactgttatctttgagattatattaagaaatttgttctctgttgcaggatagtttcacatatcataattgaataagactaatgtttcattagaaccatttattccctattattaatagggaaattttattttaatgtccatgccatcctcttctgattcttctcatggttttcaaagtaagtaatttaatttggtataatacttccaggatctcaaagcaaatctgtattttaatctctcaggtgttcactagtattaccagtgactagtggaaataataaaaggaaatcttgttcataaaatccaacagaatgatttttttcctccctgcaaaatcttctcgttaaagctgaaacataagacctcataaaattcaatttctactgagtgatattccaattaagagtactaattcatattatattaatcaaattagtatttgttcctcttctgctaaaatgtgatcgagaaattcatgcgtatcagttcaccagcaccattcgttccctactgagataataaatgatgggaaagtattttttggttcatttcatgctgcttccctagatctgcttactgcaaaggcaaacttacctgaatacttttgttgagattttcagccagccattctttgctgtcagtgtggggatcagaatgagtaggggagcaaacttacctgaatactgttgttgagattttcagccagccattctttgctgtcagtgtggggatcagaatgagtaggggagcaaacttacctgaatactgttgttgagattttcagccagccattctttgctgtcagtgtggggatcagaatgagtaggggagcaaacttacctgaatactgttgttgagattttcagccagccattctttgctgtcagtgtgtggatcagagtgagtaggggagcaaacttacctgaatactgttgttgagattttcagccagccatcctttgctgtcagtgtgtggatcagaatgagtaggggagcaaacttacctgaatactgttgttgagattttcagccagccatcctttgctgtcagtgtagggaacagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgcatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtggggatcagagtgagtagggtttttttttctgagtgtgaacagcacaccctacctaaggccacttaagagacactggagtcagaatctctggagaaaggatctgatacagtgctatcttaaagagatcttcagataattctgaggttaagcagcatggctctaggctgtatttataaaacagaaattatgctggagagaagagcgttgtccgagttactattttacttatattactcttgtcttatccaagaagtatctgaagtccttacaatatagcacacccagatttctttaaaaaataaggaaacactagtgaagattggaatgaagtgtattgcgtaaggttttataaatttctctagaggaagcaggcagagttggctctggaacttctctacactgtctacaagttaaaaataagctgatgttccaggagagtacggttggatcctgagagtaagacctggtagaataaacagtatcgtcagtgttctcagattccttgaaagcaggaactaggtgatattcttttttttttttctgagacagtttcactttgttgcccaggctgaagtgcagtggcatgatcttagctcactgcctgccgggttcaagcaattcttgtgcctcagcctcctgagtagctgagactacaggcatataccaccacactgggctgatttttttgtattttagtagagacaaggcttcaccatgttgatcagtcttgaactcaaattcctgagctcaggcagtcctcccacctcagcctcccaaagtgctaggattacaggcatgaagccaccatgccaggcctggtggtgttcttatttatatctccagcatctagtataataaacgacatatgatagatgttccttgaaagttttctgttaataagttcattccctatggagatttccaataatgaatttcttaggggtgatcctcagtgtaggagaacataaaattttaaagtagaaacaaaatagtcacacaataaggaggcaggccaaatacatggggtgaggatgtagctctttgtcccggataaatttatggtttgactctggtttctaaacctctctcccccacacccctcagactttcttcggaatggggcccaggaatctgaagtttcaaaaattccaccagcgattctatgcaaccacctaagcgtggctctttgtaggctcttacagggtattgtggacttttaaatacatttctagaaatggatgcactgtgtatctctcaagcagtccgctttaaatcttcttcagtgtgaacgtaataagtattgacttactagtaagtcaaaaaaataaagacttctgaaagatatcagagatgttggtcttatttttatagttaagagcaacccttactctttaatagaaagccaattggtggtaaagttgaccttcttaaaagattgaagaccataaccaggaaatatgcataagtaaagcacccccaaacctcctcaatagcctgtttcaacatgaagatggacaaaaggagcagactcagagttccctcagaatgttgagttgtcttctataacagctagagaagcatggccggaaaatcactctgtggaggccagtcatttgaaaatcctagagaaatacccatagaacagatgagtgattggagagagactttaggaataaggatattatttacctccatagagaactggtcattcatggtgaaatgagtgcatttaaattttttgtttgtttgtttccagtctcccagggtttcaaaccattgtgggtttacctaccgtgactacaacaccactcatctaagttccctgggaggtatatacacagggaaaaccctagagaaaattgttctgtatggcatttagggaatttatagctgtgggccactagtgatggggtttttaatagggttagaggatgaacaacaattgtattatatggtaaaagccgaacttgttctgctgttgttcctaacacagaaatagaaattactaaagtgtatggtagggtattagttgcgtgagccttccatacagaacaacacaatataaccagtacatgttacattgaatagagagtaattctttttgtttaaaaatatgagtaggtaggtacagtctggaaataatgtatcagaaatattaatagtgcttatctctgagtaatgcaaagagttttaaattttccacatttttcttgtttgttctagtaaacatttttattctttggtttgataaattgaagacaaaacctctttttttgtcttctttgacagtttttttatacggactttattttataatctgattcccttgtaattcttctaagaccacttccctgtgagtagcctgtgtttcatctacaccagattactcatcgtttctattgcatataggaaattttcctgtcattatggcatgttcatgaagtatccttcatcttaaaaatgttcttttatctttagtgttcatgaattttttcatattctttaagatcttcctcatatcccagagtctttgtgagtttctctgagagcacttctctagtagctattgtcttttccctcttaattccaaccttttcttactaccaaatgtattatgttcttctctattgtacttatattttggcttgccttccagtgtagagtctcatatatagcagggattttatgaatctttgatcagaccttacaatgtgctattccttctgcctggaatcttttctattcttttctccaagataatcctctacaaatccttcaagactcatctaagttagcacctcttctagaaagtgtttcttaacaggcagcattatctcaagtatgtgtattgggtccacagtgcttttataaaaccttgtgcgtaacttttattgaatttagcacattgtattataatagaatgtatatttatcagattttactcagagttccttaaaattagtgaagtatgtaatcttttttgttttttatatttttaatacctaatatagtactgaaaatggcacaggttcaataaacatgttgggaatgcaatttgaattttttgtttccaatctcccagggtgtcaaatattgtaggttcaactcccgtgacaacgaaaccactcacttaagttccctaggaggtatatacatagggcaaaccccagagaaaattgttctgtatgacatttagccagaagcattcagtgttactcataacgtttttgtactcaaactcctttatggaaggaaaccttggccctggtgacctaaggtggatttgacatgtgttgatcagataacattactcttggtcctaagaaccaattttacaaagattctaggtttcagtgggtcattagaccaatgtcagaccagatggatttattgctttaagttcacatccaattattaaccgttgacattatctgctatggtgaagagaggaagagtgccaaacacaaggaaaagttttatcaacaaggagtttctctcccagccctaaagcagctggcatgagccacctatcatgaagtcttccagaagcagaagtattgctaagctgatggtagccaaagattttctttatctattactcatgggcattgaaaggctattgcagtccaaaatcaggaaatgatttaatgaggacattaaacttcttttaacttctctccttcctttttgtacacattgtaagcatcctcacctctggttttccttatcacatagttttacctccatgatcttagttaactctgtcaaaaacttggtgtgttcatgtgcagtctccacacctttgtgtccaaaatatgtcttgattctagccaattttgtgtccccctgttgctctctctcttaatcagaaagcacatttatttctttttcatgttgctctactgccttctattaccttcaccgatctctagttttactttcctctctaattcgttcttcacaatatccccagaataattttttaaaaactgctatgttgccattatattatgtactatattatatacctgcatcatctcttgccatttctccactctcatactgtagtccagtcatattattcttttttttgaatgtagtccatgcttactgcatggactctccattcttccacctggaaaaacagctcattcattattcagcttaataggtcactttaggtcacatccaaattgctcacatcacttcactgccattgttcccatataaagtgttataatattgtcaaaatttatatatatgattatttggttagtggtgttctccacagatgactgtgagcttcatggagacagagactggctgctttgtcagagactcactgagataaaccctttaggtcatgtaaggattttgggcttgtctcatctagggaacacccagtggatgttcattgtacattgttggatatataagtctggaactcaaaagatggataggagatatcgtgaatttttattggtaccagtttgcctttcctctgacaacactcagctactggggcaagtacagaaaagatggaaggttaggttcattcagggttaagattttgtcaggaagtgtgaaggaagatgctgtggccagagaaaaatagctcctgtgcactctatggaaagtcagcccaagattgctgttcaaaccaaattcttttggtaaaatgctggcaattttccaaaatgagcttttgttatttctcatggcagaaaaatttactgtgaattccttaccataaactataatgagagctttctttcataattattggagtactcttagttctgggtttttgttttttaataaattctgggaagaagtgctatacgtggaaagatatattttactttgaatggaagactaaaattggttcttacataacttcagacatagaaatgaataaaagatttatcttagtatagactctgtggtttatattagatatataattgattcttttctcatgaagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggtaagaacttttcttttggctctctgaacatagccatggtcacgacatttcctccagtatagtggagagggacctgtcagggagtcaggagagacggggcccagtgatggctctgccatgggcatgatcagtgaccatgggcaagtcatctcatgcccaggctgtgatttcctcagctgtgattttaaagacacttttctcttaagtttctgtctttctgctagagaattctaatgaatcataatcatagattaaattgaccatttgatctggaacttaaaaagagaagtgtaaaatttagcagtatttctcctgtctctcacccattcctccatctgtaatctgattacatgggaatagttgagaatttaagacctaattgtcataatttcatgaaatgtgtttaacaataaaactactagatactgtagattagagtattatttaaaactactagatactgtagattagagtattattagaaggataagtaggatgttgcaaaactgtttgtgaatattttaagaacgtcctgtgcaaaaacgtcattaggctactctattgtagttttcaactacatctttttatagcggtaaattgagcatgtttggtgttatactgtgttatcagtgaatatggcattctgagagaagctatttcaagaatttgttactactaaaccttttagttcctgtagtcatttatcttttattagtgagcataagcagctctaatgcagattttgtggtagttccttttaatatttgaagattccccttgacaactaaaaagagtacgacatatcataattttacaacacgtaattttctgcttagtaagtgaattcagtgccagcaataacctgctaattgcaatgaggccttaaatatataataagacttcctttagccaaaatgttcaagagatatggtactctgttaattttgttttgatgaactaaataacaatacaaattattttttgtttgaacaattttgaaaatgtattaatatatcatcttattaaaatgtattaatttaaatagatatttgatgattccaaattttgcaaatgccttagaagctttaaatgaatttgatgtgaacatcactaactctaaagcttttcctggaaaatgctttgtttagtggatctgggatgtctgcttcttgggtgatggtaagaggaaaacctagggaaggagaaagaacagaggagtaggtacaaggggaaatagttttgtctgacaaaaactgcatttgcaaggcctctgctaattagaacttttatttgttaaaggcctaaattatgattaatgagtgtcactttttaagctggtattagaaaaccaaaagcattacttagcttaatgtagaatcctgattttaagtttggaaaatcatatggaatttaaatttgcagaagtcagctaaattttgattgctcagcttcataatatggatatcgtcttataaggtagcaacctactacctcatctttacttcagaaaggaggatgacagggagactatatgatatagacaaatacactatttgtctattcatttaattgttttctggagtggcatccacagttagccccattgcatatgtaaatcctgaagcaagtctgagaattcattaaccgtggcttgatcttacagtcagttgcttagcgtcatggtaactacttcatagcggtttttttcatttaaacttagcgtacactagaagctaaattgcacaggtgaaaagtatcttcagactttgggattaaacatttctggattttggaatattagttttatttattatgaatgcaaccttgaataaattgccaaatttctccagatagacctcagtcttcttttccataaaatgaaggtaattgtaggattagtcaagagcattatttgtaagtgcctggcatggcatgtagtaggcactgagtaactgttggtttccttctgttacatcagtcctagccgcttttcaaatatgcaatatattaaaatcaactttaatataagaaaaatttcctggaaagcgtagaatcatggaaattagagaaagtcttcaagtgtttaggcaccctgctttttagaaaaatgtctttaattttaaatggaatacttaggatattttcaatatagaagagtagaccctgagaaaaagtcatgcatagtcccactcactactcatagttaattattgtaaatatgttggtatttatttcacttttattttaatatgtagatttgggatttatttttatagttgagttgcatacaaaattttgtgttgccttcttttaatcacttaccttttataaccatttccccatgttgtaaactcagtgaaaacatttagtggctgagtattattccattgaataattaacttcttgtttatgtatctgctactcaatcgtatatttgtgtctacttttacattataaataggctgctagaaatgaaaacttttttcatatttcaggttatttccttagaatagatttcccatgctagaaatgaaaacttttttcatatttcaggttatttccttagaatagatttcccatggttgaattactagcttaaaaggtaaaggcacattaatgtggccgtggacttagatagcttttttgtcacccttcttatgagaccactttttaagaagtcatataattaatggatttcaggcaagtcataaaaatcttcgtattttaattatttttgcagcatattaactgagaaacttatttttaactcttttcaagtttagcctttgttaatgtattcatataagacctgaaaacaatagaaaaagataaataaacatgtattttactctagtgagcccttaaattctttacatggaaaatttttatggtactttgggatatctaaatttggcaaatgatactacagaattattatatgtggcaaagtttcttccccctttcagcttttacccatgtatttaatcagcattatgctgttgaaattcttcaatagtaactgaaaaggtttataaaacatttatgttccctaagtgcaatttttttcccccaaagggaatctgttttgtaaggattaatattctaagtgataaccatttgcttcaaatttatattttcttttcctaagatagaattgttttggattggtttgctagtgagaaatcatcaccacaaactccgaacagatttctgaatttacctgtttatatttcactcttgtgtacagagacctagcacagttcgtctcttatatgctagaaagattaaaaatccttaattaaatgtcatggaccaagcacatctctgtagaatgtgtgtgatagtagtattaggttaaaattattcaaatataaacaatttaaagtagcacaacaaagtagtacaatgactcatagctgtcattttatagaacagccgttacatacctggtgttggcttagctgcatattatctctcatgatcatgatacctgttcatgctgatcatttcctgttgaaaagttgtggattttgataaattaaggataagttgtggattttgatatatgtgtgtgtgtgtgtgtatatatatatatatatatatatatatatatatatattttttttttttttttttttttgagacagagtcttactctgtaacccaggctggagtgcagtggtgcagtctcagctctctgcaacctccgcctcccaggttcaagcaattctcatgcctcagcttcccaagtagctgggattacaggcatgtgccaccatgcctggctaatctttgtatatttagtagggacggatttcgccatgttggctaggctgatctccagctactgacctcaagtgatacgcccatcttgacctcccaaactgctgggattataggtctaagctaccacgccatgccaaaaatagtgtttattttaaaaggggcagtaccagttgcagctattggttttgttttgttttattgttcagttaaactctttttctatatatgcttccaggaagccaggaaatgttcacattgctaaaatttacccatatttctaatggaaatgaaacctctttaattgctgttataaaaatgttttttgtaatatcaaaacaaaagtttatctttgtgtatgaaaacttatgcaattcagttacttaagttgttttcaagcaccttcagtacttttggcttttttaataggtaaatagtggatatgctagttataaatatgttgaataagataaataagtatgtaaacatctgtatggtattttgaatgaatcatattagtgtcatgaagttttgaatgaaattttctgaattttacactgacttctgtattagtgtagattactgaaatacatagaatttgttaacaataaaaagaaaaaaaggaataaatctgattgagttgttaaaaatgggtatcagcttccaacagctttttcttattttcagcaggtgtttgttgaacacttaagatataaatatactggagcctcataggctgtatataataagttaaacaaaatagaatatggatattaactggatacacaattgattaccaaaaacaatagaaggataaaattataaggaaaaaaaccctacaaattctgatgagtttagaggaggtcatatcttattttggttgagatatcaagaaaggtttttgggagctattggactttttaaaaaattgtcagctatacagacaataatagaaaatacaactccactattttttatcttaagtacttaaagttctaaatactttcagggaaaaatgtaatgatattggtaatacccagtttgaggatgtaaagggaaaactgcagattttgtattactacttgatgaatgcatttgcttctgatgttcagttttaagtggtttcatttgataccaagtcaatgcaggtatttttaaaagatttaagagtatgtgcttaaacagtttaatagtgcatgtgcgttggaacttttaaaaataagtcatatggatacagggctgctgcttagggatgtgcaggttatacagttgtgcaaggatgccattgttctccactgttctcttttctaatgtttatattaatgatttccttctgcagaaacctgaaaatactacaagccaaccactttctaatcagcgagttgtagaggtggcgatccctcatgtagggaaatttatgattgaatcaaaggagggggggtatgatgacgaggtaccttttacagccctctgcaccattgctacttaacttttgctatttaatacaaatactttgggcatgcctgcaccctcatacttaatgtctattgccacataacatacagctttgccccctcatagtccaaaattactttaccaattattaacagaactttgaatttcaaatgaaaatttaagtagaaaacttatggaatttgtcaaaagaattttctgtttgtggagttaattcttttatgcagaaatagtaccagtttacttccaggttggcagattacaataagatttgtttaattagtacaaaaattttttgcatttaaaaataattttttatattccattcttgttttactggaattacttataatccttttcccactatctcctgccagaaaatcccacagcatgattgcaggatggataattgatatttttgcttctacagcctctccatgtgactgtgagtggagtaagtcatcaccgttactgagtgcctaccgttaataggacctccatgtttattcttatctcttcactgttaattctcatttacttagttttccaacagtatggaggcatttttgtttttcatgatttagttctttggaatccagatgaaaatgatctattgtcttattctatcagatgattttctccccttttccacttttctcttgagacacttaatattactctttttgaggaacggccagtaaagctgtttttgaacaggaacacagaggaggccgtaactattgggtagtgggggaggggggtgatttggaaaaatgcttgttggattctagtttttgtgggtttgtataagaattgcatttatgttaagttttttttcacgtaactttttttctgacttactccaatgttactatcatgctagagttaatcaccaaagtcagaagtgtcataaagacatatcactgtaccagtgtaagaaatcacacgccataaagagaataagcagatttgtgagataaactggtcagagagttttctcaagcaggtgttagatatattgcaattctcagtatataatccaaagtaaatacaatgagtaataggttcagtgaatcagaggtgacggaggcaatctcttgatttctgtaagatagcttcatagggctttgagtaatttcactttgcagatattttaaaatgtaaacagctaaaaataataagctattatgaaaacaaaaaaaatgcttaagtatttgtacttaatggctctacattgttctagttaactattttataaacatgctggctcttgaaaattatgggaactggcatgtttttaataaacctatcaatttattgattaagcagttaagtacttgttttaggatgtgccctctctcatttaaaaaagttgaattgtgattaatcatttaacactatcttttttgcaagtgcttatgtgacagagttgtgtgttttgtcgttttttaaaatttattgcagtgacagtttaacagtgcatgtgcattggaacttttaaaaatgagttgttatggatacagggctgctgttcagggatgtgcaggttgtacagttctgcaaggatgactagacaaggggcagaagtgggaagcaaattgagttcatgatgagctctctgaggcttgaggaagaggtaccttttttaattggtaaaaagggatgttgctttttctaaatagttcactcagaggatagcacatttttctaatttgtttgtctagaagcagggtgcctttttcaaattctccaattcagagaggatgcctttttgcagtttgcacaaaggctccgtatgagccagctgtgccctgtatggatgatcttaaaaggtgcttacatgcatattggattaaatttggtattaaaagtgcaacatttgatttataaatatggaaaacaaaagagtttcagcttgcatgtgaataaattattttagtttaaaaacctttttttaatgttaactatcttctgtggcagatcatgatgacaccgaacatgcaaggtattatcatggcgataggtaaatccaggagtgtatatgacaggtgtggccctgaagcagggttctttaaggtacaatgaacattttcattttcgtgtcttttctttttcaaaattaaacttcttaaaatattttatttctttgaattcagtttggttttctgtataatttctcttttcctatcttagttatggccaccggatatcctagggttttattttatgtattaattaacctaatactgattgtttttctcttaatccaggtaattcaagaaaaaaatctttttatttgagtcactctaatagtgtgcttttgatttgtcagcagaaatttgaattgtattttttatttgaagggaatgaggacattaatgaacaataataagaactgagtaaattgccctggtaatagtttattttatcttcattgttcatattattggtcaatatcataatattctttaattttattatcattaggtactaaattgctttttcgtttataaaatgatttatttattatattatttttgttatgtttccccataattaatttttgataacctagtcagttcaagacatgtgagaacatcaagctgaacacgattccatgatttacccacatctttttccctctaatatcagagctttacaatgttttgattacaattttttccttttacagatttgaaagatgaaaataccatgtatgttttgtcattttatttacattaactgaaaatcttcaagtttttttttttttcactcttttcaaacccttcttagtggttttaaaaagcagcttttttgaggtccagtttgctacagtgaactatgcatttctttctttttgacattaaaaatctaacatttttcattttctgtattttgccattatccaacttggtctttcaaaaactggttcttttttcactgtttctttcagtatacagtacaaaacaaaagccttgtacatagtagtagacctatcaataagcatttttgagtttgctaagattagggtgactaactctcctgatatgcccgggactgagggatttcctggactacaggatttaaagtgctaaactgggaaagttctaagcaaactggtcccaggacaagttgatcaccctattatgatcccataagaaaggttgaaaatctacttctaaaaaaagaagaaaaatgtattttttatagttttctgttttaatacatttctttatagtttctaggtttctaactggcttcctaatttttaccattagaaattccttcttatgcccagatagtctacattttcttttcttaaaaaaaaaacactgaatatatgtcctctaaagtatttatttcttgtggaaaagttatttatgatttacagtgccattgtcatttctgaccagattgggtcttcttatgttgaattgcaaatctcatttttattaagttaatatctgcatataaataatcacctaattgtatatattacaacagttagtaagcccccagtggataatgactttcagttatttaatctgtttggcattaattcatatctttaaatagaatatttgggttttttattcacagtttacacattacctgttgaatttgcttctgtggaatatgaatgatgagctctctttcttttcctgcgtcgcatacatacactgagagacacagctcctatcccccatacacacacacacacacacacacacgtaaaatcttgtaattttgattatatcagaattctgcatttgtaatattattatgtatgctatatgtgattgagttatattataaatattactactttctgtttttcccttaacttttgttttccttaaacttagttgttttgttttttggtttgcttagtttatgtgtattactgatttagttcaaagctgtccactgcttgtttaaatctcctctcattctgcctttaccagttttatcttcttgggacatctattctggagctttatgacctgccccaatctgtattggtttttcttttctcctgatccataactagtaacttgagatctcctttcaccatcattctggggattccctttgcatcctttcctttgtgtattttccatatttcatatatttttctttattggtttgctctatgattttgatagtacagcaagaaagcatgggcaagaatcaagtttgtggaagagggacagagcattttcttaaataagttatgttatattgcaactctcagcacataatctaaataaatactgtggttaataaacttcagtgaatctgaggtaaaagttttcaagttgctttggagattgagtcgaatttgacgttttactcatagcataaggaaactgtgctctttgtcagatgttaaaaataattactacagaatttctatttcactaaccattctccttactatcatcatactccctttcttgcttttttttttctgctggaaaaacacttacaagaatagtgggaatgtacattaggaaggaagtagtttatatgttgatattagcagccagactgcctgggccgactgctttctagctttgattttgggcaaattattcaatctttgtatctcagtttcccgaggtgttaaataactatttattttattgagtcattgtgagctttaaataaattgtatcaatgttacgcttttaaagtagtatctggttgatagtaaatgctcagaatttagctgttattgttgttagtattatcacgaagcttatcttatgtgtccagttctggtccacatatagtcggagatgaaaaatgagaaaaatgaatgtgccatatctgtgtcaaggacctttatttgctaatagaatttttttaactcatttgttagaaattgtcagtaccattttggagtaacaaaattagcagttttgtttggcttaacctaataattactatcataaaaccctctttctacctttttatgtctttagtgtgtgtatatgtttataaaatttctgaagtttgtgtacatttgcacctatctgtgattgagtaatacatgagtgtaacccctttatgtaaacatacatcaagttgtttctaattaatgcatgtttttggtaaaggtagaagcatttggacacaactctagctgataatatgtcaccttaaaaattttttcgtataaaaaatgaaagtaatgtatacaaaatgcagttgtattcagtaatatagaggtgtctaaaataaaactaacaatgacagtctctgccactgccatggccctattgtaaccattcttagcactgtgtatcttgtttttttctttttgtttataacaatgcacatatacagagacttaaaatttttttaatgtagattttactgttcataatattttgtaacttatatcactcagaaatctattgtgggcttaaagtttagacagtatcacattatctttactagctgtctgtatacacacatacacatgtgtacacatgtgtacacacaggtacacacatgtacacgcacacgtgtacacatacatgtacacacacatgcacacatgtacacccacacagtattccatgctatagatatattctcatttcttgtatcttaccctctttatggacatgtgtcctatattttctcccagtctaccatttctatttgaattagtttagagtactttttcttaaacaggttttaaaatagtatgttcgttttcctactttatggattttttttgccatattaaaagatctactcttacccaaagttatataaattttcccactacttacttaaaatacttttcttagtaaatttttattttttaaattcaaatgcttactgtttaactcattagcattttatttgggctttctgcgttctgtattaaatgaatttggtgtttttctattttgtgctgtcttcatcaagtttgcaattagggttatgttagctttggtaaatgaatttgagagctttcctgttttttttaatacttaaccgtgttagcgttggaatgatctgttctgttagttagaactcactcgtaagatcatacgagcctagcgccttcttgcggggtagatcttttaacacatttttttggttcattccatagttattggcatgtttaaatattcttcctttttttgattgattctaatcatcatcatcattcagtattaattcataaaatatgtacacaccatagaatctaacatatggttgctgcttctgtcttcctgtttcccctcaattagatatagtatttttaaatttttgttcttttttgtgcttagtgtattataaattgagggaaaagttgtttgttttgttttgttttgttttgtttgaggcaaagtctcactctgtcgcccaggctggagtgcagtggtgcgatcttggctcactgcaacctctgcctcccaggttcgagcagttctcctgcctcagcctcctgagtagctgagactacaggggcccgccaccacacccaggtaatttttgtatttttagtagagacggggtttcaccatattggccaggctggcctcaaactcctgaccttgtgatctgccctcttcggcctcccaaagtgctgggattacagatgtgagccaccacgcccggccgtgtttttgtttttttttaatatctcttctgtcctgccacgtcctgaaaaaatcttggtcgggtctattttacattagctttttggctatgaaagaaagctttttaactctgtgcctgtttaggtacttctgaatatggatttccttatgtattatgattagaccaactttttaatactctgaatgtttgctagtgataagaatagtgatgccactgtcagccttgttataagaaacttaggtctgagtaagtggacttgctaaagtttaacctccgaattaggaagttaccaacccagtcataggaactctttcaaccacaggccatcatcccacgtgaacgtctacccaataagaatgcagtatgaaaaagttaataggcaaagttgatctggaaaaaaaaatgcaatgggctacactacactaacttgagtccttcttcaaattgactttaatggttaaaactagtttctactatagaaaatccccaaataatagtggcttacggagagaagattctgttgtgtaaaaatgaaattcagaggaaagcaatacaaagttactatgataagcaaaaataaaagccagaagataaaaacaaaatattttcaaagtactcgttgcttgtatatatgtgtagaggtgggagggtcatattataattacaattatgggattagtgtaagttttttcatttattttaaaagacattaaaatttctttttttgtaaaaattttgtcggtatcaaagtacccttagggttttattgaagtaatacttttgtattataaaaattttttcttaatagttgtttcattgcttcataataatggtgtccctacttgccgtaactttatcacccttttttgcttttgaaatgtctcttaatcaccttgtttattcaatagatataaaaatgtttattagaatataaaacatgttgaaaagtacaactcggtgaatttttttttgagtgatactttccttatttacatggcctttaaggaatgtgaagaggaagaattatttatcaacatggtattaatgaaatcttgttccctaaaggtatacgcaggcctaaatcgttaatgcaaaaaatatacttctccatgcatcttgttaaattcaagacagcggtccaacatttccatgcttagccaaagaagactcttttcctcttggttgtgtacatttgtagcctgagttttaagtgccacatctttcaagtcagttacacatcctgcctttaggctctcagacttgtacttccaactctgggttatcacagtgtgtgtttacccatgtgaccaccaactaggccaagaggtagaacaggagtactccagaagtaccttttttccgccttcccatcactacagtctgtccgtacccaaaagtagccattatctggacttctaacaacatacgttagttttcttgttggcctttatacacttggcatcttttactctaggtccttttttgtctgactgcttttactcaacagtgtgtttggagcttcatccatgttatacagttgtcatttcttccctctcatggtattttgttgtatgactataatttttttctatccttctgttgatggacatgctaaaaaggtattgcctgtttatatgcagggcattgtcctaaatccagggatgtagctgggataatgatggactgagttcctaccttaatgaacctcattttctgctagggaaagaaacattaattagagttattagtatgataaagaaccagtgtaatgtggaaaaagaacataaaataagaaaacagagctagtacctagagggcttcttagaaaaagtgacttgtaaactagtaatacataatccaaaatgtagaatgtaaatgtttttctctcacttcctaattctcactccacagtgagcatctattcattgtttcttgtatatcctagagagatagatgagactggcttacattcaggcattcatcctgtatttataatttaaataaaagtaggagtatactctttctttttttttctttttttttttgagacggagtctcgctctgtcgcccaggctggagtgcagtggcgcagtctcggctcactgcaagctccgcctcccgggttcacgccattctcctgcctcagcctcccaagtagctgggactacaggtgcccgctaccacgcccggctaattttttgtatttttagtagagacagggtttcaccgtgttagccaggatggtctcgatctcctgacctcgtgatccgcctgcctcggcctcccaaagtgctgggagtacaggcgtgagccaccgcacccggccagaagtatactctatttgcttctttttcttgagtttatttttcatgtatatgtaattattcatatcaggatttgtagatttatctcagtatttttcctttgtttcctagggtttatcaaaatttatttaaatattctcctagaatagggtattcatgttacaacaaatttgaagaaagttaatacatttccacccaccatagaggctgatgggagcagtatgtcagcacactgataacttactcatactctaatttaggaaactgtctcctactagctgttaccagcaaggtctccatagtcctaggtttaaatcctaacattatcatttaataattgtgacctcaggcaatttattaaattatcagaaccagtttattcacttatatgagaagttatcttgagaattaaatgagataattcacgtggaactcttcaggcagtgtctgtcacataaagaacacctaagttgttacctattcttattaaatttatcagcattgttgttgctgaatatttgagttattttcaatatcgtgaacatttttgtgcatatattattgaacacttgcgtgaacatagcagagttgacaagtcaaagtgcttgcaaattttaaatactagtattatcaaattgcctacatgtagttatattgatttattctactattgatatttgcctaaaaaaagacattaaaaatgtaatctcatatttcaaaatgtatttctttgatctttgtgagggtcagtttttttcataaatattttggcaattggtatttatgttgactgtcattcatctttatacgtttattacactgagtttcttttagttaagtgaacattgatcttctaagacaattgattcatctgtaatttgcaaattatattttgtggtttataatttgtcttttaaatttattttttgtgtcttactatacataattttttagatcttataaaatacagcaactctttttatagatttggtcctgtgatcacttataaaattatgcaaaattttaattctgctgctttcatggttttataatactttttgttttgattacaggatagaagattttagttttctctgaatagtaaaatatccagatagtctaaacataaaatactgactaatgcctccttttcacgctgacttgacacatatactaaatcatacctatactaaatcccttatcagggatttatacttaatgatatactaaatccctacttataagtagctctaactgggtctctgtattccactgatctagttttctgtttttggacaatacactgaataccagtgatcttattgtagatcgtttgtaatacactttcacattttgttagaagaacacttagtaatttttgttcttttataaacaggaagtttggcaagcctcatttttcttctgatgatttttaaaatcaattgccacttcctttccaaatccttttagaattgtatttatgtattaatttaacatgaagcagataattttttttttagtattttgagtcttgcccaaaaggaacatgatacgccttttcacttttattgtcttctgttgtgttctttagtgaggttttataattttatttcataatagtcttatgtccttttgtttaatttattcctacataattttttttgcctttatgaatagggtcatttacttccattttttttttaaccaggttattgaaagggtaggtaacgggataattaattttacatgtttatgttgtatttagttaactttattgaactctttgttttctaatggtttttcattttattttcttgattatttcagtaaactgtctcccaaaaattattttctatatctttatttcttatttcatttctggttttattgcggtgatcagaaatttttattacatattctcaatattgaaataatggtagtaggtgcctttgtctagtttctgattttaatgtctccagtgttttagtattatgtataatgtgtagttttggttccgctttatgaattttaaaatactctcaaattagtagataagggtttccagctaaactgattggtattgaaatttagaaattttataatatacctattaagatgctgaatagatttctccttcttaatacttgtaaacccttaattcttaataattgtaaaggtgttaactttgatctatgtttaaaaaaattattgtaaacactttttgttatctcatatattttttgtacaccacactgtttgtttaccaaaagtgggtgtgggtgttggcatctgggtacatagacaaaattgatctatagtttctttctttatatttgtcaattttggatatacaaattatatatatataatatatctatattatatagccttttataaccattaaggaggctttctcttgttttgttttgtgtttttttttttgagacggggtctcgctctgtcgcccaggctggagtgcagtggtgccatcttggctcactgcaggctccgcctcccgggttcacgccattctcctgcctcagcctcctgagtagctgggactacaggctcccgccaccacgcctggctaagttttttttgtatttttagtagaaatggggtttcaccgtgttagccagggtggtctcaatcttctgacctcgtgatctgcccatctcggcctcccaaagtgctgggattacaggcgtgagccactgcgcccggccgctttctcttgtttttctggctctgtggcagtttagatatcacagaaattatctgatccttgaagatttgacataacagcccagctcgaaaacatcgtgggcttgatatctttcgtgttaccagatttctagggcaaacttttaagttttacagagtctgttcagtttttctgcctctgaaagcagttctggtagtttatatttttctagattattatctgttgggatactgtagtctattaacaaagttatatgtgttattcttcaagaaattttaaaacattttttctgtattatcacctttcttatttctaccgatgagttttcttcccctttttggtcttccatccaactttttggaaagaaaaagcctttgactatcaaattgttacattatattttatttctcctactttatattttatttttctaaattcttgaaatcttttctatatttaaattggatatatatatgtatatatatatatatatctatattttttttttttttttggatggcgtctcgctctgtcgcctaggctagaatgcaatggcacagtatcggctcactgcaacctttgcctcccgggttcaagtgattctcctgcctcagctcccaagcagctgggattacaggctcccgccaccatacccagctaattttgtttgtttgtttgagacggagtctcacactgtttcccaggctggagtgcaatggcatgatctcagctcaccacaacctctgcctcctgggttcaagcaattgtcctgcctcagcctcccgagtagctgggattacaggcgcccatcaccatgcctggctaatttttcctattttttagtagagacagggtttcactgtgttggccaggctggtcttgaactcctgacttcaggtgatctgcccaccttggcctcccaaagtgctgggattacaggtgtgagccactgtgcctggcctggaaatttttttgactaacagcccaataggttttgatatctgatattcccatattagtatagttttttatttctttggctcaagaataatttagagccatattttaaattttctaagtatttaggttggaagatatctctatttataattcctatttgtattacagtgtggtcaaagaatatggccaatattatttcagtcctctggaatttgaagtaagttttcttcatttcttggcactgtcagtttttaaaaaatagcccataagcattttaaaatacacataaactctcttaaccaactttattttagagataagagcaatcagacttagaagattatgtgccttattctatgtcacaattaattataaatgatgtatctagctttttgaattttaatctcatcagtttcccattagatttaactgcctccagaatataaatgtttatatttttggtatccacatactcacatatatatatatttggtatcttcatatatatatatatatatatatagagagagagagagagagagtttacataaaaaattaagtccataagaagttataaatttagaatatggttttacagtattacttagaaaagtagaaaaaagtctaggtagaaattatttgcatctttagaactgaacaaggtctcaaaagcatgacttaaactaattttgctgatgggtcatctgtaggtagatggggaatgaacaagaaaggatatcacacatatggagaacttaagaaacaaaggcatgtgtgcatttgtgaggagacaagcctaacctagataggagggagatccttgttgcaggatgataggaaataagattgaataaatggcattaagcctgattaaaggtctagtgaaaaagttaaaaaagttaaaaaaattaaatagcagttctgtcatctaatgactagtatcacatttcattttgcacatgcgtggtgatttcattgcagtgtctgtgataattaacttaaaataattagcatagaccgccaaaaaatatgggcaaatataattctagaacaggattctgaggaggtagtatgagacaaatataatgttaatttactcataatggcagattgtgtagaactctgctaaatatactagcatggaacatctgttgagaatttgaataaatatgattccagtatattttaaaagccaaaaatttcttaaggaagtgtgtaaaaaatagttaaggaatgcatttatgctagtgaaaatgtttttttgtatgtttgaaaaacagcttctagaaatttagaaggtaatttcttaagaaggaagtgtataaaaaatagttaagaattgcatttatggtggtaaaaatgttttcttgtgtgattgaaaaacagctcctagaaatttagaagtgtctttctacctctgctggtttaaacacctatatactgaaaaatactgtgactttggcaatttgcttgtgaaaattaggagagtcttaaattcagcaaaatcaagaggtgaacatataatcttagagtataagaggttatatatttcagttctataatagaaatctgctatttattaaaacagcttctattttgaaagtaggtaggggaatgatgaccatttagtggaatcactccgtgcatgtaaacctgcaatattaatttaagagactcagtacaaatttgttttattttggtcatgctattttgtactaaagtatgatatacgaaatatttgaatattctaaaagtctattacaggttgagtatcccaaatccagaattcaaaatctgaaatattgcaaaatccaaaacattttgagtgccaacatgatactcaaaggaaatgttcattggagtatcatggattttggatttttggattcggaatgctcaaccagcataatgcaaacattccaaaatctgaaaaaaatctaaaattggaaacacttctggtcccaggtatttcagattagggatactcaacctgtagcctgtgacaatcattatcgaaggttcatatcaacaagaacagtaattgaattgttaatgttttagatttattctcaaattcttcctactttgattattatgtttggtctccccccttccccgtttttttttttttttccgaatttggataataggaagatttttaaagagctctaagagaagcttatgtgtgctacctaggcacacagtaagcgttgataatcttaaatattaaaatacagttgatatttatggctgttatttattcacataagactttggaatgacatgtatatcctcaaaaaaaaaaaagtcagttttttcaagggaaaagtattttaaaataatttgttctcttattctatttataatcttatgctgcatagaaagaacatattagccttcctttttaatgagtatgatattacataactagaatatttcatttaatgtttatcagttattttttctcccatctgtacaatacaaccatatagatcataacatctagacgtcaaagaattacttaagaaaggcatgcattttttaaattaaaaaaactttttaattgaatggattttttgtaatcttgcctgaagcccaaaatgtttatgcttattagagctagaatttacatataagtataatataaatgaatataaaaagctttatcttaatcatatggtcctcttgtacatagcaatatgtacaatatgtgtaaatctatacatatttctatatggtcagatattttctagattttgcttgtatattaaaacatgcattagtatttgttatttcccattattatttgtatattatgaggtatttttgtttataaagaaaaactaagtttaaaccttaaggtaataatagtgataatatattatcattattattcttacattaataaaatgtacgtactgttggagcaataaatacttctttttgtgataattataaccccggggcttgatgttgcattccttatttgtgggctattcagctaaaagttaattgcaataatacgactatgcatttaagaacaattttctttcagatttgagtattgttgggagctatatatcaactctagaattttagtgttcaaactgatgcttagaaaggtaaaacagaacgggaaaacttaccatctccatcttatgatgtctgtgaatagactttgactaggctctgataaattttacagaattactcacattgtaagtttagacatattttaccgctttcatgtgtggaagcaaaaagaacgtttatatagtgaagggataaagaagggcctttgtggccaggcacgtggctcacgcctgtaatcccagcactttgggaggccaaggcgggcggattatgaggtcaggagtttgagaccagcctggccaacatagtgaaaccccatctctactaaaaatacaaaaaatttagctgggcgtggtggtgggcgcctgtaatcccagctacttgggaggctgaggcaggagattcacttgaacctgagaggtggaggttgcagtgagccgagatcacgccactgcaatccatcctgggggagagtgggagacttcttttttttttttttttttttttaaaagaagggcctttgtggtcagttattcagaaaattccttgagtctatggaacatgggactgtgttcttagttgtactgccttgtttgtgatactttaaaagccaaaaaaaaaaaaaagatttaaatgcaagaagaattaaactcataatattgaaggattttttggtgttcaaataattaaccaaaattatcattttcattgcattttccaggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtaatttgaaagtataaaattcatatgctcaaatcgttctttttttttttcctgcagattcccaggataattttttgagtatttattttatatatgcatgggcacatattttaataaatacgtaacaaaatttgaactcaatgtgactagttgctggagtctgtggccttttgaagtttgaactgaaaataacttagatcattttaataaattttaattgtgaatcaagtaatcactgcacttattacactcaatattttagaaacaaaaatgggcttctcaacctctgtactatatagacagtttaaattagataaatctttgttgttggggctgtcctatgattgtaggatatttaataatatccctcatctcttcgttagatgacagtagcagctcccaagttgtggcataccaaaatatctccaggtattgccaaataactcctaggggagcaaagtcacccttattagagaatcactggagaaaagttttcagtcttgcagataaaataattaaacattctttgacataaagaggaggcttagaagggttaaattagattcacgcagacatattttctctggaaagagaaaatattctatagaaatttctgtagaatttctgtagaatatagaaaatattctatagaatatttccagagaatgttttctctagattatattagtagttttataaagaattattcagaaagtcctattaaactactaatgttaaaaatcacaatttaattagaatgagtgacactagaaaataatttcagggcccatgtgaaattttagagtattgaaagttattttcatatataaaaacatttatgctgttgcagttcattgtaattttaattctgaaatgatcatccttttatgagtgtctcaaaaatactgagttaaaagtgtatagcaaagaatatgaggggaggcaaagcatctggattgatcctaccttattagatatgtgccgtgaaatgtaggattctgtgcataatacaaataaatagttgtgaacaatatctgataggtggttgaatgctcagtgaatgttggccactactgtttatattagtagcagtgtggacatcatttattttgatacatgcgactgcagagagttcagaaacagggttgttgtgaccctcgttatctgtgctatcagtgtactgagttccattggatctatgctgtttaatttggagaagatattaatggagtaatcacattgacttttcagtcttttgcagttctctgactataactagttaatctgttttgataacctgacttgtgcttgaaagacagagttatgcacatgtgaataaatacatttcgtgaggatttctttatcactgattctgatcataaaatccagtgggatgtttccatttttacctgagatgataggcacgttttagactctttagtatttaagaataaataataccatgtggggggaaaagaagatgcagtgtctcttgagcttgcttaatagatgcacattattttttaaaagtttcatttttttcctatgcaaactgtgttaattagaatgtaatttaaaagccatatatcaatacaacacagtaaatttgaattagaattattgctcctgtcttctttgtaattccccaacattggtcccaaaaatgtttttcacttaaggttatttaggagttgtttctatacaaaagtactgctgtttttgctcagtgtttatggattttgcttttgatttacaaatatatatatatatatatacacacacatacacacacgctcatatgtatgtgtttttttttaaggtgtcacaacataatgaaagttgctcaagccaaactggaaatgataaaacctgaagaagtaaacttggaggaatatgaggtaatgtgctttcttagaggttaaactacagatttagggattctgtaattcactgatattcctttcgtttcagcccaactgaagttgaatttgttatgaatgatgagtaaaaaaattaagtttccaagtcaatgctcaagtaattaataattttatatgtgattttaggattaacatgatatgatagcatgtagaccaaaaagtttaaaatcaaaaaaggaagatttttggttttttatttcaatactaattctcaagtactttttaaatgaacttttctagcttaaaaacagaataacaaatgcattgttaattttgaaatcaacttagaaattgctgttacataataccaacaagtaatatttatcaagaccctactatatgccaggcatttgtctaagccctttacatatattaactgatttaattcagacagtaacactgtaagataggtagtgttcttattcccatttgacacacgagaaaataaggcatagagcagtgaagtaacctgcctaaggttttcacagccacaagtttacagcttggctaatagaacctacattcttaactgttgcactacactgtgcaactgtaccctgtgggctgtattttttccttcactttgattcatcagatatattttggggaagttaattcattttagtccctatatgccatatatgtttgtcatgagacagtgttgtgtgtgagagagcacttacataggtacttgtacatgtgcttgtgggatttttttgtgcacaaaattattttttgtcaactttggctttaaaatattctttattttaattgatgaattcatacacctagtatttcttcacatttttaaatttaatcttatgcattgtcttttttttaatttataagtctagtaaattttaagttgttttcttgggtgcctttgcttaatatttagttccatttacaaacttaattatggtactttagattccctaaataattagtgtaattcactacacaaacagggaagaggaaagagagagaaaacactcattattgatgaaaaccttagctagtttggcgtataaggtaactaccttaattcactaaagagtgtctctaaaaacaaaaataggaaataataaaactgcagcaaatatatagaattgtgagcactgaaagcttaaaatttttgttgtcaaaagcaaggcaatgaaaataagcgaaaagtaaaatactggaaaagaagaaacaaagacatcattatttgtagttttttttaccttgaaattcaaataaaatctacaactgatgtattagaactagtaagacagctttgcagcatgcaaacttgtgtcagacatcaattttattcccttttgccagtaaaaaaagtatgagaaagtataaaagtgagaccatttacaatagtatctgaaactatggagtatatagaaataaatttaacaaaaggtgcgtgtgacttctgtggggaaaattataaaacttattgggagacattaacaaagacctaaataaatgggcatacatatggtatttggaaaacttgatattattaatatatagatatcacttttcccccaaatgctttataaattcagtgcaggctgtatgaaaattccagcaagatgttttatggagcttgataagccaactgaaaaatgttacggaaatgcaaagatcccagtccacctcccatctctgacaagcaagttagtgaacagtataaagactttttaataaatggttctgggaaataaataaaatttgatttcttctttattccatatgcaaaaattcatttcaattgtgaaagactcctgtgtaaagctgtttagaagtcaacataggtagaagcccaaagacattcatttatccataagaggcactcactgaccagatatttttgaccaggatatgtaatctagagccagagaaattcaaaatttgttttctcttgaccctgaggagcaagtcaagtcatcttttagctaataatgactccaaatctgtgccctccacattgattgagagctcttcccttgtccccaagattcgtgttcatggaacttgatttttaattgtgacttgattctgcaatgcttccttcagtttgcttcaacagattggactcattatgttttttttcataaaatcttctcatattctaactgcagggctgttaaatcatacaagtatttaaatgacttgtttttagattctgcatattcctcctatctttgtcttgctctaagttcagggttcagtaaaccatagcctgcagaccagcttaccacctgtttttgtaaataaacttttattggaacatggccatttgtatacatattgtctgtggatactttcacactgcagttacagagttgagtaactgaagaagatgaggcttgcaaagtctaaaatattatctggccttttacagaaaaagtttgcctactcacaacttctaaggtgattctaatgacaacaaggaatgacagtttgaataccttccccagaaaagctaacttcatacttgcaggacaaattttacctttatttgttatgaagatctactaatagcatgaaaattatgtcttgaaaattaaaattaagactggatgtggtggctcatgcttataatcccagcacttttggaaatcaaggcacagggagttgtttgaggccaggaatttgagaccggcctggccaacatagcaagaccctgtctatacaaaacagattaagtaattaactggaactgggagcatgcacctgtaattcaagctacttgggagacagaggtaggaggattgctggagcccagaaggtcaagtctgcagttagccgtgatcgtgccactgcactgcagactgggcaactgagtgagaccctgtctccaaaaaaaaaaaaaaaagtttatattcaaggagaatatcgttggctaataactatgtttcttatttttgtttataatgtttatataaaagccttaacacttttgttatcagtattcactttccaatttatcctacattgaatttcagttatttttcttgagtcaattattataaagtaagctaagaaaatcttgactttggtatcaccttagaattatttagtcctattacatgccctatagttgttttgggggtggggaggggcattgaaatgtgaactgcagttattcttttaccatatctcatgtaaataaactattcgcctacacacttaaagtcaaatttaccacatatttgcgaagttaaaaggttaaataaatctaactttttttagtttcttaaaattatgtattaagtatgtgtccaagctttgattcatactcagcgtaatatttcattttcttccatcagttgatgtagatataataatagttcaataatatgattttatactgatgaatttttgagatgacctgattgattatcctgcctttatatttctgttatctgctagtaaaatctttattgtttaaaacatttcatatccatgcctaataatttttagatttaatgttgtattaataaatagtcttgtgtgccagaaagtaaagtcttgttttagttctgatgtatcttcattttgaactctttatttctattaattcagatagtagcgaaacagtgcattactttttgtacagtttcatagtactttttaaatcttactctgaacatttttaatattttctttcacctacaggagtggcatcaggattataggaaattcagggaaacaactatgtatctcataattgggctagaaaattttcaaagagaaaggtaaggcaaagtggacaaatatgaaaagagcataatttttgcacttaattctattcaggtgtgacctcatccatggaaaagattttattcatactctgtatttttaataaatgttttattttagatcagttttaaatttacagaaaaattacacagttgatatagagacttcccatataccccacataaaatatattttccatttaaaactccgtaaggttggcattagtgtctgtgtttattagctctcaaacactacccttgaagctgagtctgatcttgatatcaagtcagagatagtgtttgcagtctgtctttgtgaactttcaggttctgtaaaaagtgtagctgtagaaaatttttgtgtactgtgactttaaacaaattttggattaattttcatttaaattaaggatggtcttaaaggaatatctacttatttaattatactattattttaattgttattaagaagaaaggatacattttgctttacttacattttaggttatttactagtttgcatgtatttctccacatatttcttaatgcgtgttgttgaacattaacttccctagtgattgttttttgagaaaatgctttattttcaatgcagtgtatattgcagccaagtaaaagggatattgaatttttcctttcttttttgttttatgaaatttaagaagctcccacttaggtaatgatgcttctttttcaaaaaaagaaacaaagatcagtgtttaattctggagctatgctgtccaacatagcggccacctgacaaaacttaaataactaaaacttttaaaaccaaagttcagttcatcggttacaccggccacgtttcagtagttcagtagcctcatgtggttagtggcctctatttttagccagcacagaacatttccataatcacagaaatttctattggacagtactattctagaggacagtactttcatttttatattaatagttatcaaaatttttagttatcacacaaaaggaaaaattaatgttttacttaacaatttgtcttaagtacttaagtacaaattatttaaagtcctagtcattgtgctatttataagataatttcactttagtcattgatgtagaaaacttactttgatcaatacctccaatttatgagttatgtcaatcaagattttatttctttaataggaatattcaaatgtactattagaatttatatttgtgctgatttgagaaaaataatgtgatcgtataattcaatagagtgagatataaaaaggcatttcagtgttacagataaagaaatcagacttcacagagatgtagtaactttgtcaaggtcacacagctaactaggagaagaaaaattaaaatagagacctcgtattcttgtataatttaatgaaatcatgtaagtacaaaatgtattcatttatctcaataagaattaaaaagatgaaactgtcactttgtacctatccggatagcttctgtattagttgttcccagttaacatacattaaaggaatttgagatataacttggaaatatgtttaaatattacaatttgcttgtcagttttcaaatacatacttattcagaaagttaatattctagtatagtaaatacttaccaaattagaaggattaactagaaaatcaataatggtgacagatattacttgtggaatatcttttaaagaaatattggtgtgtgtgcgactgtgatcccagctactcaggaggctgaggcaggagaatcacttgaacccgggaggcggaggttgtggtgagccaagatcgcgccactgcactccagcctgggcgacagagcgagacactgtctcaaaaaaaaaaagaaagaaatactgttttttttttttttttttttttttttactttaaatctttaaatatagcagttattgtagctagctgtttgtaaaatattgccaaaagattctgtcaaaattgtttttaatgaaaatgtaaacatttaaaggcttgaatgaaatactgatggacccttgtgagtcctgagaacagtgaagtgaaatcatggttgcaagaaccataattttatagagtgtaccaggctacatgatcttattttatcttagataagaatatggtaattggactgctaaatcttattctaaatttatttgaatatacattcgtaagcactttaaagtttgataacatatggaacattttgcgtacctcagtagagaattggaacaaggtcatggtttcagagcaattctcaaagaggtgactcaggtctagaaagccagatgtcagtgtcattcaggagagatcttcttaacaggaaactcagtagctataaaggaaaagatagatgtgctagttacttattaattaacgaactactacaacttaatgttgtaaaacaacttttaatattatcacttccttcgtttttcataaataacatctttaactgagaatatgtttattaacctaatatcatttcaaaataaaatgttatacttaatctcaaaaacaaattcctagaaagccgttttcaaaaaatgtataaaatagacctatttatcatgacaccttcaggtgtgtaatttgatttgccatgaatgtatacattaatttttaaataattttacatttaacatttgggatgtggaatggatttattttgtatctaagtacatgaattaagtaataaacagtaattattggcaggagcgtctagagtttaaaattgtgtttctttacaatatttcattttttaaaatatatttttccatattaatctgtgaaaaaatatattaatgaaaaactgacgcaaaggaaatattttaaaataatattttttatttcagttatacaaatacttggctagatatagtttttattttgacatgttagaaggatagttttgaggtaaaagtaattctttattaaatatttttttcttccatttttgttttgttttgtatttttgagttggggtcttgctctgttgcgcaggctggaatgcagtggtatgatcatggctcactacaacctcttaccttctcagctcaagaagtccttcctcctcagcctcctgagtagctggtactacaggcatgtaccacgatgcccagctaatttttttttttttaatgtttttgtagagatgggggtgtcaactatgttggccaggcaggtcttgaacttctggcctcagctgatcctgtcaccaccacctcccaaagtattgggattacaggcatgagcgactgtgcctggccccttttcttccctttttaaaacctaatttgaatttcataatatctagacttacattaatataacacatatgcctaattctatcacttcttttttttttgagacggagttttgctcttgttgcccaggctggagtgcagtggcgtgatctcagctcacctcaccctccacctcccgggattctgctacctcagcctgccgagtagctgggactacaggcatgtgtcaccatgcccggctaatcttgtatttttagtagaggcggggtttctccatgttggtcaggctggtctcgaactccctacgtcaggtggtccgtctgcctcagcctcccaaagtgctgggattacaggtgtgagccgccgcacccggcctctatcagcttttttatgtttgcaggctttttgtttttgctttattccactaggtttcccagatttagaagaaatctttcattgtccacttcctctatttcctttagatattcttatttctattttttttttacatttttctcagtaactaaaactgtctgcacatagaaaagaacctgtctaagttgtcattgaacaaaccaaatgatgtttgtgatcatttacttcatataaatgtgacattgcgttaaacaattagattgttggctttcacattagctccaattttgagtttaaatggaagacatcaggaaaataaataccaaggaaaacagaactatctgactttatcagttattgcctcttttcccagattttttcttaatttatagctcttctttttttacttttaagataactatctctgggtttcagatgttgctgttgctaaaaaggcgctctcaagcatacactgcgtcagatgatattttttattataatgtagattatcaaaacttaagcatatacttaaaatgtttcataattatagctgactttgtttctacaaaggtgaaatactaatgttatatgtttctttttaattttcaagttatatagattccttgctgttcctcatctgtgcttatcagaataacaaagaactcttgtctaaaggcttatacagaggacatgatgaagaattgatatcacattatagaagagaatgtttgctagtaagttgaatgcatatagtatgatcttatcattttgtctgacattgggcaagttttccagactcatatataagtgattgactccataaactctgaggggataagaacatgatgatgtctataaactggttctagtcccttcagatggaaaagtacactcagtactttattcttttctctttatgaatcccaagtactataggtgataaatgagaaatgttcttaaaatagcatcagtttgtttacatttctgtatttagatttcgtcatcacactaccactcctttttttggtgggagaggaagggatgcatagataagccttaaaaaatgttttatgtaagtctataagaatatgcaggctggcgcagcagctcatgcctgtaatcctagcactttggaaggctgaggctggtggatcacaaagtcaggagatcgagaccatcctggccaacgtggtgaaaccccatctcgactaaaatacacaaacacaaaaattagctggatatggtggtgtgcgcctgtagtctcaactactcaggaggctgaggcaggggaatcgcatgaacctgggaagtggaggttgccttgagccaagatcgcgccactgcattccatcctggcaaccaggtgacagagcaagactctgtctcaaaaaaacaagaatatacatagaatgtattagagtaatttgtttaacttaaaaaattgaattttcaggtacaagaatagtatagctgactttaaacatacatagaaccaaaacctgatggttcctctgaaaccttcaaaaaatggtataatgtttctcatcattttttgtagtaacccagccacatttggttatttgttttacataggaattgaaatgaaacctcgtcaagattactttagtgttcctttcagattttttcacgttgtatatttacaaagtgtcaggttctgagggatacaaacatgagtaagatgtacttcctgtcctcagaaaactcagtctggtaggagacataattgtttgttctggaataagtgccattatgagaaatatgcacaatgatatgcctgaaatatttgggaagaaccttaagagacaaggtaaacctcgtctggatcttgatggataaatagaagttttattcatgatagagaagggagaatattccagtacacaacagaaaatcaagataaattcactgtggctatccaggttatgaggaagtggggtaaggtggaagtgatgaagctgacaatacttgtcgatgtcagatgatgaagaaacttagatgacattcaaatgagtttgcaccagtgtaagtttgattaggtttggcataatgaggtttgttttcagaaaataattctggtaataataatagcattctagaggatgaacaggaaagaagtagattgaagtcaagaaccttagaggggaaagtcaagggacggagagtgaggacctcaactcatgtagtacggtaggtatgatggtgaaggaaatgaaatcggcatgtcatagctgttgggtgagtgggaagaaggaaatggaagagtcaaagctgccaaacttactagtttttcgtttaatattagggagtctaataggaggaacaaggttggctttgaacatgttttatttaagagatttccaggacattctttgattcagtgaacttaacattaaacttgtcattaaattttatatatcatttaatgcatacttccaaaaattgtagtaaatacttgaagatttatctcattttattctcttaacccctatggttggaagataaaataccctattattaatataaagaaagtgaagctaacagatttagctaatctgttcacgattggtgtattagtccgttctcacactgctataaagatactacacaagactgggtaatttataaaggaaagaggtttaactgactcacagttccacatggttggggaggcctcaggaaacttaaaatgatggcggaaggtgaaggggaagcaaggaccttcatcacatggtggcaggagagagaagtgcaagcagaggaaatgccagatgcttatgaaaccatcagatctcatgagactcactccctgtcacaagaacagcactggggaaactgtccctatgatctgatcacctcccaccaggtctcttcctcaacacctgggggttacaattcaagataagatttgggtggagacacaaagcctaaccatatcaattgggtaattgattcatggccaagttggacttaatagcacaaccatctttccaaaatcaaaataaattgcataagaattatgtggtgtaaatctaaatatataactttttttatttgaaattcagcttaaaagtcatgtttatcatgctgtaaacataagattttaaataagaacccttaaatattataggtcttatacctgtatttatctcttatgtttcttattgcatggatttctctgttctactagatcagtgatcagcacactatggcttgtgctccacctaccacttgtttttatagataagttttattgaaacatagccatgcacattcatttatatattgggtattattgtctttgtactacaatggcagagttgaatagttgcaacagaaacttcatggccttcaaagcctataatagtcctcgtctggcccttcacagaaaaagtttgccaatccttgtaccaaattgtaagctccatgagagttttctgtattaatcacttgagtgcccctgcatctgcagaaatttctggcacgtggtgttgactctgtaggaagtttttgaagggaaaagtgaattgattacctttatatttctgtatcaaggaatacaatagtatatattcagttgccattaatggagatgagtttttcaaaaattaatatggattctgaatttctttatttttaaaactattttgagtgcttatacaattttataatttggggaagttaatctctagagaagaaaaaatggcccctgtgttgatgatcggcataagccaaacatgactgaaaaacacaataatgttttctccaccgctgttgcttttgtttctgttgttgccatatgcatagctttttctaaagagagattttcagttctagataggttgagattgttttctctaaataccgtttgttctaatactgtttgtgaacatatttatgttgtcttccttattaatacttacagatccttaatttaaaaaggaaacaaaaacctattcttttttttttcctgcattgcattaagaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaacgtaagtttaaacaatggtagtaggcacctgagatgtccggattaaatgcagttagaattagatgttatttattcttgccattttttatattaaatacaatattaagtattaatattttcacattcacatgattactctttttccatattgatgaactaagctgtgtgcattgcagttgccatttatgtttttgtctccccaaaatggcaattatcttacctattagagtaagttaatattagtaaatcatgttgacaatgatcgtgtaataatttctatctttagttagatttaattgtttgtatttgcagcacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattctaccacagtggtaaagttgtttgtgtttgtgtataattgactgctgagatacaaagtgcccaaacactatatggaaattattccttcaaagtcacatccagagaatcatgtcactcttgtgctgaaggtaagtattataattgtatttactatgtacttaaaaaccagattatttattcctagtaatgaatttgaaataacttatttaaagaaaagtgacctttttcaagacctacagaaacaacttattttaatattggtttttaatctaattgtaaggtttagatcattgaaatttctttttttttttttttttaaatttccaacttttaagttcaggggtccatgtgcaggacatgcaggtttcttacagaggtacatgtgtgtcatggtggtttgctgcacaaatcatcccatcacccaggtattaaccccagcatccactagctattctaactgatcctcttcctcctcccagcccccaccctctgccagacaccagtgtgtgttgttccttccaccattgagtccaatatgttcttatcgtttagctcccgcttatgagaacatgcagtagttggttttctgttcctatgttagtttgttcaggataatgatctccagcttcatctgtgtccctgcaaaggacatgatcccattcctttttatgactgcatagtattccatggcgtatatgtacgttttctttatccagtctatcactgactggcatttaggttagattccatgcctttgctattgtgaatagtgctgcagtgaacatacacgtgcatgtttttataagagaacaatttgcattcctttgagcatatatccagttacgggtttgctggctcaaatggtatttctctctttaggtctttgaggaaccatcacagtctttcacaatggttgaactaatttacacttccaccaacagtgtaaaagtgttcctttttctccataacctcgctaccatctgttgtttttatgacttttaataatagccattctgactggtgtgaggtggtgtctcattgtggttttgatttgcatttctctaatgatcagtgatactgagctttttttcatatacttgttggcctcatgtatgtcttcttttgagaagtgtctgttcatgtcgtttgcccactttttaatgggttttcttttttcttgtcaatatcataagttctttatagatgctgcatatgagacctttgtcatatgcacagattgtaaaaattgtctcccattctgtaggttgtcttttttactctgttgttagttttgccatgcagaagttctttagtttaatcagatcccgtgtgtcagtttttgcttttgttgcaattgcttttgacacttcgtcatgcaatctttgcccattcctatgtcctgaatggtattgcctaggttttcttctagcgtttttatagttttgagttttaaatttaagtctttaatccatcttgagttgatttttgtatatggtgtaaggaaggtgtccagtttcagttttctgcatatggctagtcagttctcctagcaccatttattaaataagaaatatttttcccattatttgtttttgtcaggtttgtagaagatcagatggctataggtaggtgtgtggtcttatttccgagttctctattctgttccattggtctctatgtgtctgttcttgtaacagcaccatgctgttttggttactgttgccttgtactgtagtttgaatttgggtagtgtgatgcctccagctttgttcattttgcttaggattgccttggctactcaggtttggttttttgtttcgttttgttttgtttggttccatatgaattttaaaagttttttctaattctgtgaataatgttattggtagtttaatgggaatagcactgaatctataaattgctttgggcagtatggatatttctacaatattgattcttcctatccatgagcatgaattttattttccatttgtttgtgtcctc

SEQ ID NO: 16920 - DNA, 9295 bp, Human
tacttatatctaatttctatattactttagaccaataacatagtttgtatacttccactagtcctattataacttagtagaagtccggtgtcaatgtgatgatgacagtattgctattaggaaatttggggagggcatgggaaacatgttagcatatcagattttcacttgaagattcagaaattttaccagccagggcaatatggcaagacctcgtctctacaaaaaaaaaaaaaaagtaaaaattagcctggtgtgatggcacacaactgtgctcccatctacttgggaggctaaggtgggaggattgcatgagtccaggaggctgaggctgtagtgagccgtgttcattctgggcaacagagtgagaccctgtctgaaaaaaaaaagattgagaaattgtaccaggctgtggtgcattgtgagccttttgtcaccgttccaatatggggtttggcaagccctgtcagtttatagactcggccttaatctgagaaaaatgtattctactaattatttatggtctcttttaatcatttccttttttttctttttgagacagagtcttgccctgcatccaggctggagtgcagtggtgtgatctgggctcactgcagcctccgcctcctgagttcaagtgattctcctgcctcagcctcccaaataactgggattacaggcacgcgctagcacgcctgacttatttttgtatgtttagtggagacagggtttcaccattttgggcaggctggtctcgaacctctgacctcaagtgatccacctgcctcgggctgaagtgctgggattacacacatgagccaccgtgcctggccctctttattccttttcttctagaattcctgtttgtacctatttgttgtaatttggattattttttgcatttgatctttaaatcactaaagtaaatctcaacaggaattgtcctctactgaaatgttttagttagaaagtaatatattttagcttaaggaagtctagggatttgaaagtctttaagtctttttttttttttttttttttttttttttttttttttttgtgagacggagtcttgctcttgttgcccaggctggagtgcaatggcacaatctcggctcactgcatcctctgcctcctgggttcaagcaattctcctgcctcagcctcctgagtagctgggattacaggcatgcgccaccacgcccagctaatttttgtatttttaatagagacagggtttctttttgttggtcaggctggtctcaaattcccaacctcaggtgatccaccagcctcagcctcccaaagtgctgggattacaggcgtgaaccactgcacctggccataagtccttatttttaaaattcagacttccatctccttcaccaatttatttcactgataaagttggactgccggatcctccccactgtcatgcacagctcatttggactggctgctgtttttctttgctggttcttctggactttgatttagttgttacagtattcttaaatggctggaatccatttgtaacaggcagagcagtttctccctctgtgggcctgtgaagtacacattttcaggttgtcatgcccggctgaggtatgggaaaccttgtacattagtttgggggccagtgtacttttcctgttaggagcggacagtgttgcaacagtctacctctactgttttctctgatccatgactaagttcaagggggaagaaatacctcacctcacattttgtgctctaaccctgatgaagcttcaggcctgagtttctaactgttccattatcccagagccttttggttaagacctaaaaaacttgcaatggggaataaggaggagaagggaactgtggtcaggtatagactgagatctgatatgatgtaattctgtagcaattagtagaatttgattctcatgatatatttagaggtgatttataataagtatattaacgtttctgctgcttgttttctgtaacagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagtaagtgaataaataactacagtgtaaatataaatattcaaagtatgtaagtttcaaggtggtaataaaaatgacttggtatttgaaagtattagaccttcactgagctcatctctgacatagaggttcattaggtgccctcaaaaaagaagataaggatcttgatttttttaagtcagaaactgtatctttatatgagttacaagggaaaatcctactaaatttattgctgtttaaaatacattcttactgtcatgtcatgtattataaaccacatcaatttatagaaatacatagggtcttggaaatcatttagcagctaagtttgaaaaaagtaactcccttagacattgattagccgaagatcataaaactaattggggaaaaatatattatcaaagtatattttagcctcaatttagtggcctttctgtgacattgtaatttgggggaaatgtataaacacagctcttttttttaaaaggctatttccatagttacagatctctgagaatgtatattaaaggacaaaagactctgaaatgacataatgtaagtccaagaaaaacaattgtagaaccatagttttggaaaggaatgaccaccttagctgtcatcaggtccaaacccaaatcttaggaacagtgaggcgcaccaattcatagttccattttctttcatatagttgtctactgtgtgtaaagcacttggctattaaccgtgatgggccacagggcatttttacaatattcttaaagtccgataggagtagaaagcttctaagcaaataaatacaatataaggtaaaatgagttaggtgctaaggtagggaaacgctgggtgcttggggagttcataggaaagaatactcctttccagctagaggcattttagaggcttcttggaaggcagtgtttgggtactcatccctcttgagaatctcatggacaactgtggatcatcttcccagtttaaagaaaaaaacgtgaagaatttactcacatcattttccttatagcatgaaacagttctcaaacccacaggaggccttcagtagacctgtacacccaggggtttactctaggttttaaagatcagtgtatgaaggttggacagataaatgagggtaagaggagagtatcttttaggaggaaagaatggtgtgaactaaggcatgaaaatgccttagtttgtgctagaaagcacaaaatatatttggtgaatggtataattctatttccctggagtatagggtatatgaagagtataaggatggtatggggttagaatgagggattatggaaggccttgattgtagactgagcaagtaagatatgtggtaggcatttgtgagaaattacagctttttgaacatgactgtggggatggaagattactctgaattaggaggataattttaaccagggtattggaaggattgaaatgagaagagagcaaagacagacatgttagcaaaatgtaacctaagcattagttgatgagaaccttgactttatagcagtggtaatgtaaaagtgacagagtcaagacattgaaacactgatgcctggttttggtgagctgctggagaggaagaagagggaacaataaaagaaaactgacttttgaggcgaggtaactaacaaaggtgttaccattgccaaaactgaggaggagaaatagtgaagggattaaaatgtagtaagttactctgtgctttgtagacatggtaatgaaactctgacaacaaccctatagatgttaccccaattttatatatgagaaaaccaaggctgaaagttagaatttgccaaaaatcatactgttaagtaaccagatgtgcaggactcgtcagggaattttgagtgtcttctgtccaaatgtggtgttatattagagtattgatgctgtttgcatcattttaactgtctttaaaagcctatctagtaagaagtgaattcttaggtgtaccctatatctaaggagtcttgtttgtgggtcattcattcgtttgtgcaaacaaacacatggagagttctgagggtagaccctgggctggcatccagcactgccactaattagctctatgaccttgggcaggtttaacttctgtaggacagttttctcatatgtaaaaggaggatgatggtagtacttacccatttcataggatattataaaaattaaattattcaatacattagcatgcctagtatttgctagtgaaatgaacaagtatcttctgagtgactgctttgtcctaggcatcatgtgagagcctaggaatatagtaataagcaagataagcagcaagacttacattcagttgaggaggtagatgatttctggcctctttttatcacaagagtgcatattaaagttaaaatagccatcatccatctgtaaccagtattagagtatctagttgaaggatctatttagaaccgcagtgtccattttggttgccgttatccatgagactattcaaattctaattacaattaagtgtatttataaattcagtttctcattttctcattcatgttagctatatttctagtgctcaatagccagatatggctagtggctgccacactggacagcacagacagagagcgtttctaacatcacaaaaaggtctattggacagtgctaatctaaaagaaaattgggtctctaacaagaaatattgataacaagttcttaaattggagccacctatgtattttttgtgcatgttctttaacttaaataagactgtatactttgatcataggcatgtgtaaaaatgttattacccttgaaggaattttcatgtgtacatttttttacatttagaatattgttcattgctaggtaggcagtagtatttatgacaaaaacagaagaatttcttcaaagaattaatgagacccagttggccctgctgctggtccataatgctatatttattttcccaaaatgcacaagtctaattttgtcattttattgcttggcaaataaaatacaaactcccaggcttaacattccgggcctcccatgatctggggtctgctggtttttccatctagactccttagcattccccacatacagccaatcccttaccacctctatgtctttgctttttccatcttagaaggtctcaaaataaaccctggccccagatgcctgatgtttctcaaatgccacctttttaaaatgaaattttccctgattagcttagcaaaagtaatctcttcctcaacttgaatagctttttgttaaatcatgtctttgaagctcatcacatcactcctttacagcataaatgtttgtaaacatgtaatttttttcttcgaaattgcaaaatctctgagggtaggaaataatttgcttctttaataggacccctatggtagaaacttaaaagtctaaggtctttaaaagccatttagtgatggctgacttaaagcagatgatattagtagataataattgagtactcactgtgtgccaggcactgtgcttagaggtacgtgtgcatttacaccctcgtttggtagaaccttcatatttagttgtggaaactaaaatttagagtgctctgtgccttactcaggtttacgcagttgctgaatagttgaacttacactcaaacaggaccagtctttgactccagagcctgtagacttaacgatacaccttttgcaacttagaccctgagaaattctgacttagtgagtgtccgtgattctgagaaaccttgaatgttagagattggtttgaggatacctcatttatgtgaaacctcatcgtaataaaatagtttgaattgaaattgaagtagaaatacttattttctttctgaagtcttttctttgactacatgaatgctttaaaaaggtctattggccgggtgtggtggctcacgcctgtaatccgagcacttatgggaggccgaggcgggcggatcatgaggtcaggagatcgagaccatcctggttaacatggtgaaaccccctctctactaaaaatacaaaaattagctgggcatggtggcgtgtgcctgtaatcccagttacttgggaggctgagacaggagaatcgcttgaaccagggagtcggaggttgcagagagccaagatcatgctaccgcactccagcctggcgaccaagcaagactccgtctcaaaaaagaaaaaaaaaaaaagatctgttggaatgtggtggtgaaaagtaattttgtttttgtaagctagtacacaaaattaatttttgtttgctcatttacttaacaggacatctggaggacctgttgatgctagttcagagtatcagcaagagctggagagggagctttttaagctcaagcaaatgtttggtaatgcagacatgaatacatttcccaccttcaaatttgaaggtacgtcttataaatcacagattcattcttgtgggggataagtgaagaatatttacacttacctggatttttagagaactgaatgacagtgttgacatgtgaatttattaggaccatgacgtgtgcctgagaagctgccggctaaatgtttgctgttagaataagagcagtataggagatcacataacatagtgattaaatggtggggatctgaaatcgaactgcccaatcttgaatccttataatcactttcagctgtgtaatcttgagtaattaactggtgcatgtctcctcatctgacatttggggagaattatagtatcttctgcatatgtagttaaatgacataatatatgcaaagtcaattaatggaatgcatggctcatagaaagtgttgcataaatgtttagctatatttctatgtaaatgtttacaaacagtgtttactaaaaaaatcagaaaattgatgagttaaatcttgagcattctacataatccattttattgcaatttggctaagcttgacccttttttccccctcttcttagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgagttctgtgtgttagagttgtttttagatcctttcatttggttataataaagcagatggagaccttggatgaactggacacaacttgcacataaccctgcttgttgtggagggatgttacccttcctttagaacatgaagaaatggtttataaattcttggtcatagctttctcagaaatctgagtgtaattttttatatgtcttggaacatctattgtgtttaactttgatctcctcaaatgttaaataattttctcccagtaacccaggtccctcatctttgcttgcagatcacagagtctgttacagttctgttcagattgatgagggaaaggtagggatgacgggggttctataaaggaacttactttaaaagagtaaactttatggtgttgttttgtcctaataagaagagttccagcagatacattctagataagtggcatatcagacatggtcaaaattttagtgactataactgtctctcaaggaagttattttaaaaaatattttaatggtcaaaatcaggcttaaaaaaagtaaattttaaaggaaaagcagccatgtctttttagtatttgacaatatctctgatatgtgttaataaatataggtctttaatagatttttaagattttctttaaaagtgtaaaagtgtgaagccaacagtgttctttttttttttttggagatggagtctcgctctgttgcccaggttcaagcaattctcctgcctcagcctcctgggtagctgggattacaggtgtgcgccaccatgcccggctaatttttgtatttttagtagagacagggtttcaccatgttggccaggctagtctcaaactcctgacctcaggtgatccacccacctcggcctcccaaagtgttgggattacgggcttgagccactgcgcctgggccaaagggaatagatttttattatggcatactgtagctgaaggcaaaacctgctagggaatacctttttgaaagatctacaaatatttcctaatgacatagatatgattaatacgatgtgtagagacggaattggggagggcagtacagtaggaagaaacagcccacttttcttcaaatgtggctaagcagtgacagaacagttgaactacttttatttaaataattgcaggctttggaacagagaatcgggtgtctaattatggcactatctaaaggtaatcgaggaagtctagttgtcccagggtcttcctttaacctcccctgaaacagctctcctccacctacctgtggctgcaaagccatcttgtgtcagctggaactgccagtcagtagagaacaaactgaccttttctgcatatgcttcctctccctgtctctttacctccttcttcattcaaagtttagttgaattttaccttttatcagctaacacagttatctcataacacattttttacttgtctcacaactgtggaattgcttgcatgtcccagtctctttgttcattattgaaacagggttctgtttgactgtaagaagcatcctattctcgtgccctatattacagggctgtgcatttacatttaaattttggtcaggcaagcactccctgttttccaactgaacctctcgtggtgctgtgagtcacagatcttaaccaaggcttcgtcttcctcagagccccttcctctttttggctaggctgctccaaccctgcaaatgctggcctttgtgcagcacttcagcctgccaggtcactccttgtcctgcacttaaccattcagaaccaccttatgtgattatgacaaatgatctcagccttgtggttatttaaaatggctattttaccccttgcctggtgttatgaagaattgtgtttccccaaaattcatactttgattgaattgaagcccaacctccaatacctcataatgtgactttggagacagggactttaagttaaaatgagacctttagggtaggtcttaatcctatct

SEQ ID NO: 16921 - DNA, 57936 bp, Human
acacgcaattatatccagtagaattcctgtttgctcaaatgggaagtccctagccgttactcatgttgtcttacgtctgtattgaactcttattagtttgtaaaagctttggcagaactttacaatcagatggtatgattttgcaaagccacttcctcttactaccactggtcatctgtcatttattgggctgccgtaaagcaggattccccttaaatcaaattaaattggaatcacttgagtaaggctcaggtactagtatatatatacatatatagatagatagatagatagatatatttttttttttttgagacggagtctcgctgtgtcgcccaggctggagtgcagtggcgcaatctcggctcactgcaagctccccctcccggggttcacgccattctcctgcctcagcctcccgagtcgctgggactacaggcgcctgcaaccacgcctggctaattttttgtatttttagtagagacagggtttcaccgtgttagccaggatggtctcgatctcctgacctcatgatccgcccgcctgggcccccaaagtgctgggattacaggcgtgagtcaccgcgcccagccaggcactagtatttttaaaacattctccaagtaattttcatgtgcagccagaattgcaactcaccaggctaaactgcagttgcgcaattctggtcttcttgatacctgatttctttgccccttctcttttctggttcaatgcataataagaattttccaatattagttttattagcttccacttactgaattctgcttacgggggttcctgcttagtctagatagtaagcaggaacttacaaactatgtaagcttatagactacataagcaggaaccctgtaagcaagaactcagtaagtggaagctaattaaaactacgtgccaggcagggtgccaagcattttttgtgcattatctcatttaactttcatagcaaccccgaagtaggtgccatttctatgaaacctgcccagttactgccccactccgcggaataagctcttacccaccgctcctcttcttcaattcatttctgttatggaactgtcgcggcactacaaagtctctatgtagttataaataaacgttatctggaagagcagccgacaacaactttcaagatctccaattccccgaccccacactccaactgacgccttcaaccacaactactgagccccactttcaaagctcactcactaatattggataatagttgtctgcctacctcagcctccggagtagctgggactatagcgtcttactagccagcttcagggctagaatagcctttctgtgcaagtggaaaaaacctcaggtatttcccaaatcggtagctgcagaggggctctatccctaccagagatggagaaaagccctctcgcgctttttatgtcagccagagcggctcgttaagagagcgaaggccaggggctgcacaggtcgcatcccgtgagcatgaggtcagagaacctgcccctggggcaaaccgcgaggggtgggacgggtgggtgcaggcggggcggagggtaggagccgccctagtggcggcccctgggagtgtcccgtgcctcgccttaaaggagggcgccaacgcaatttcagtatgtgggagacgggctgccccacccccgcgcgcaaaaccctggtttagcttaagggatggaggcggggacccctgcgcaggcttgcggcgtgggaggcggccgcccgcgacctacgacgccgcgcgccgggaggctgagagttcggcgccgggagggtcccggggacagaagagcgcctcgcccggttgccaaggcaaccccacgcggctggagaagccggcgctcgcagcccggcccgggccgctgccggaagtgacgcgagttcacctgccgagcgggggctgggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtgggtgagtaggggccatggggtcctcagcacccgcccagcccgggggcgctcgctgcccgcggccacccaggaacaatggggcgtgggggagggggcgggcgcgatttgggggcgctgctgcaggggcggcggggcgggcagaattgcacaggggcgcttttgctgggccgggcgctcctggagccgtcccgtagggagccgcgcagggcgcgcggagtgcccggggacggagccctcggcggggggtggaggcggaggggctcgggcgcggcgtgtcgggtgcgcctcgcagctctcccatagcattctctgccccggtgcgggcttgcctttctttgctctcgccgtctcccttgtcagccttcgtgtcggttctctccagcgttacccgatttcaaaaaccttgggcggcgagttttcaggtgtcgagtcgcccaggcggggaggctgaattgcaaacgccattattcaatggacatggagctgcccggtgcctcggatcggccaggctacctctaggaaagaggcgctgagcgaacgccagcctggacggtgttagtctcctggaagcagctcgcccaggcaggagctgctaaccagacgcgcattgtgaaggagaccgtggaaaatcaaaagtgggttcctgcaaaaatgtagcattggtttctgcagtccttgggcgaagtgcaaaggagaattcagtgacctcgtttttgagtttgtaatgagtcgttcattttggagataagacgggctgagttgtacagggtaattgctagaggatttgccaagtgcgtttgtcgactgctcctttctctgggaggggaaaaaaggcatgtgaaaaatgcgtggaccattaggaggcgtaatcattttgacactttaaaaaacggattttccatgtcggtgttttaaccaactgatcttgtttgtcaaactaagcacttgctgcgttttataaccaaataattcatttttaaaaatccgtaggtgggatcctaggaggcgcacttagtatagcctctggaagggtaattttttgttgttaggtgctctgaagcaggatctagtggccctttctgttgggatggctctctgcttcctgttgaaatgttaattccattgttggatgccacagctgtgagcattactcatgggatcaacattctattagcaagtctaatcttcgatctgagcctatagcactacctccacctttttgatatatatcatttagacttggcgggctgaaatgtccaaagtaagccttccggagaagatgaagggtcatagaaccagtttacaggtacattcccacctttctttcttttttttcttttttttgtctaggccgaacctgaagatgaagttgagaacacagtgtgttctctgggaaaaaaaaaaaaatagttttagaccacatctaaagcagaaaagtggaagaacataaattatgtggaggaacttttttttttttttaaatggagtttcgctcttgttgcacaggctggagtgcaatggcgtgatcttggctcaccacaacctccgccccccgcgtttaagcgattctcctgcctcagcctcctgagtagctgggattacaggcaccccccaccatgcccggctaacttttttatttttagtagaaaccatgttggtcaggctggtctcaaactcccgacctcaggtgatccgcctccctcagcctcccagagtcctgggattacaagcgtgagccaccatgcctggcaggaactagttgttgttgttttaacgggaatatttagataattggatttaattttttttttttggaatgcctcactttgataggcacaattctaagaaataatattttgatgcagagagtcattgtgctcataaggtatacacgggtacagtgaacatctactcgaagggccagtgtctcagctaaacaaggcaactatctttattccagtttttcagtttaagaaacagctgaggccaggcacggtgcttgtaatcccagcaatttgggaggttgagacgggagggtcatttgagtgtaggagtttgagaccagcctgggcaacatggcgagaccgcatttctacaaaaaatacaacaaaataaaacccaaaaagaactagctaggtgcagtgatgcttgtcatagtcccagctacgcgggaggctgagatgggaggattgccggagcctgggaggtctaagctcatgaggtctaagatcatgacgctgctctcgagcctgggcgacagagtgagactctgtctcaaaaaaaaaaagaagacatactaattgatgaatggctttatttcttcagatatttctgaccatttagaaatgcattggtatgggccgggcgcggtggctcacgcctgtaatcccagcactttgggaggccgaggcgggcagatcatgaggttaggagatcgagaccatcctggctaacacggtgaaaccccgtccctactaaaaatacaaaaaaattagccgagcctggtggcaggcgcctgtagtaccagctgaggctgaggcaggagaatggcgtgaacccgggaggcgtagcttgcagtgagcccacatcgcgccactgcattccagcctgggcgacagagctagactccgtctctgaaacaaataaacaaaaaaaaaggcattgttattaactcaagttcactgttaacatgattgactcctactttagcaaaacaagggaaagactcattcagattataccgtcagtgatagatattcctccagctctgaaacagttttgtggtatactctggctgcagatgggactcctttcgatgcatttttattggctgcctactagtgagtcatactactagtaatcagtagtagcagcagtagtaagcagtggcagtagcagtagtagtaaaattaaacccttgatcagttatgaaatgccagatactgttctaagggctttacatacctatatattcaatccaccaagcaacccgagagggtatttattatacttatccctgttgtacaaatagagaaacagaggcacagagtcgttatataattaacttgtgaagatcacagatttgctcttgaatctgtgttctcatcacactatgctcttctgtccctacagcagccactttctcttactaccactggtcatctgtcatttattaagaacctactgttggtttgactgtgtgtcaaatactgaaggcttttattattagctctttaatgtcatagtcttaattgaatactttgaggcattgtgaggacactagtttctccagggcttgggttgacattgtaaactaatgtggcctagggacctgcagcgtcagcattacttagggatcttgttaaagtttggggtggtgttcttcaattgccaacatgaatggaactaaaaaagtctggtctcccaacctcttgttagctatttgatggtggccaagcctcactgtgtgtctgttgccttacgtgtcaagaatggggatcctggagcaggtaatgggggttgaaggtggaagggttgggtagatgttggtcaagggatacaaaattaaatccattatccaacatggtgactatagttaataacaatgtattatatttttgaaaattgctatgagtggattttaagtgttctcaccacaaaaagtatgtgaggtaatgcatatgttaattccctggatttaaccatttcacaaggcacacatatttcaaaataatgtgttatatgtagataaacatacacaatttttgtcaatgaaaaatagaaaaaaaacagaaaaataccaaatttataaaataaattgaggtgtttggatgaaaaaaaatacaagagctttgccttcatgtctgtagatctcttaatatattattggtcttgcatctcagatatcaaataaaggtacctagcttgacacaaaagttggtagctgcaaggttaagctgtattagtttgatgatgggccaggaaatgatatattttctaaattttatccttaaatattggctgtaacaaatgctgatatagcaaaacgtaagcttctattagacagcaagagggaaacttgagtgaatgaatgcaacttacctccaagtcctcttaaaggaggtaaaataataaatactgtgttttaccagtgctccccccaaagcattattctaaggcatgcaggagggtatagtgagcagctacaatagtaagatccaacccagaggtaggttcaaggccaagagtaggagagtggttgaggaaatcctcctagggccagtaccatttcatagtaatgcccatttgtgttgggggatgagtctatggcctattttcttctgattcaaaagcacattcccaatttcaaccttgctgaaaaagaggcatttttgtacctgctattaagaacagctaggatacaggataaggctggcataaaattatttagcaagcacatgctagctattccagtttgaaatctaccaaactgtaaaatcggggagaaataaaaagttgaagttgaagttgttcctcaagatgagggaacaaaatcttacaaaaggtgggattaggcactcgcttaactctatatggagaacatccttctcaagctaggtggaagatgaggaagaatattaccaaaagctgaccaggccatttggagaccaaaaggaaaggaaaaaaggcatttaggaagcaagctagtaaaagaagttcttctgggtctgactaggtaagtgaatctaagggaaccataccaaagatatgttacccattactccagcatgaagccagtggcaaaatacctcaagacattttaaacccagagaagtgtatgaaaaatatgatagttaaccaagcagattaaaatcaaaccactaaatggtaaaaatctcttcagaaatctgaaatccaagatactcacttttccattaattctgtgttttatagggggaaaagaaaagtaacaaatgtaaagattttttttatttctactggggagggaggaggataaatagaactgttttccaatttgctctccactgtatacacacatacccacacacatacataagcaaacatacgaccaaaaataccccaaacaaaaaacaaaaaaaccaggaatcaaaacccagaacaccctcaaactgctaccaatacttcatattttgtaccaaaaaaatatccctgagaggaagtgcaaaatgcaaaatcaaatgacagaaaaatgctgaacaaaccagcattattaatatacaaaatatttatattagtgaactagtaacagggtgatgttctctgtgtctgtaaaactttggaaccacatagctgatttgttcaatctagtccatgccagcttccaaaaaccaaacttttagccagcttcattctttgatgcctcatcaaaattttctacaagatcgggaacatcatcatcctcctcatcagtgtcttctggttttgctgctttactgtccaagtacttgccgtgggaactgttcagctaacttccctaaggcttgttaaactgtcagcaccaagctgacttaatattcccaggtatcatttctgtgattggtttggcttctgcatgaccagtaattgcaaaggtgttagcagaaagggaagcttggactttgggattgttgaagtgaataactgtcccatcatctttaatcatgttcatctcttcaataccaactatattattcacagccagttttttttagagaactactgaagctttttgtcatcagccatggctgttttatgtaccaccttcttctttctgcgagctgtaccccttgccccctataccggacctgaagcctgaagtttgggctaactttttcttgattcatgctgttggtaaatcctgaagcagggagggtcctccagcaccagcacgcggcaagagcaagatggctgcccgatatgccccctcttaatcttttcattcctgcgattataccaccatcagaggaaaaatgcctcccctccaaggcaagcctccctacattggctccttaccctgtctgttgtggggtctccatcgattaccaacttagctcactgcactagatcagaggacagggccattacctatattcattgttgcagtccctgcatggtcttgtggctcctggcagacagctagtgttcagcaagtcctttttgcatgactgaaagttttcaacttctttgccactaggcctgtgtgtatgatagagctctcttcagttcatcactctctcccttctcatctaataaagatggtccttacagtgattattccactagtcatgtctgagtcagtttttaatctaaagaagctgagcttctgctttatctttgacctcgttctattttttctcctgcttcagttgccaaaggttacagtaatgcatgtgccaaattggtttatctctttggaactccttgacacctattttggttctttcccaccctgttgacctgcgctttactgtcttctaaaataggtcccttaaatgtcagccttccttatagtttagcccatagtcaatcttgaccttaaacctgggtgacctcttgtatccatcatggtaatctcccaagtattggtagtgaattaaaaatattttcagctcccagcctggccaacatggtgaaaccctgtctgtactaaaaatacaaaaattagccaggtgtggtgatgtgcgtctgtaatcccagctactcaggaggctgaagcaggagaattgcttgaagctgggaggctgaggtttcagtgagctgagatcgcgccactgcactccagcctgggtgacagagcgagactccatctcaaaataaattatatgtatacacacacacacacacgcacgcacatgcacacacacacatatatatataaaatatatatttgcacctcaacccacctctgctttggatcctgggccactatttccaactgcgtaactattcaacttccattcgaatacctaacactcttcactctccaagtacactcacctgttaattaagtgatacttaatgtactgatactactatgtgcaaagccatgtgccaggtgcccctacaatagaacatgacattgcaagttgcaaaagctttggcagaattttccagtcagatggtacagcttttgcaaagacatagagatctgaagggtttgatatgtcttgggagttgagtagttcagtgcatgtaaggcacctaaccagtgcttctcaaactttgtgcatctgaatgattcttacaaggaagtctaggtggggcttgtgagtttgcattttaacaagttttacatgatgtcactgctgaccacgttttgtgtgggcaaagatctaaaggccatactgagagcttggtgggagctgacaggtctgtcaggttatgcaccctaaccccacggtactaagacatttgtggaagtgtcgagaagtaaggttatacgctgagatttattttattgaatggtagctatgtagcagttctcaaggaaggtagaactaatagagctaacacaggaatcctctgggatgatctggacgtaagcagtccctgttgaaacgcagcagaagagagttgggcttctgctttgatctggaaagcttttctgaagaagatagtagtggaacctgatgtctggttgcttgaatgagtagcatgaaaaagttggagagatttctggcttgagtgtataatgatgtcactaacctacgggaaataaaaaggagcaggttttagggagatgacaatgagcttaagtttggacaggtagtatttgaggtgcctgagaggcaaggaggtaaaaaaatatctgataggaagattgcaacacaggactggatttcaggaaagagacagacattggtgatacagacttgagaattcactgctgttaggtggcgtctgtgtaaagttaaggaggaaatgcaggtaggactagaagagaaggtgaaatgtgaggcgggggaaacatgaacttctaataagtacatgaggaagcagctgggagtaagaaggagtgataggggatataggagacctagaggatgaaggtgtcctagagaatgatgcaaaagtgaggctagtgggttttagcactgggagactgttgagaacattcagaaagttcccatggggaagacagctctgcagaggtgagagtgaagccagattttattattattattattattttgagacggagtcttgttctgttacccaggctggagagcagtggcacgatcacggttcactacaacttccacctcctgggttcaagcgattctcctgcctcagcgtcccgagtagctgggaatacaggtgcccgccaccacacctggctaatttttttatttttagtagagatggggcttcgccatgttggccaggctggtctcgaactcctgacctcaggtgatccaccctccttggcttcccaaagtgctgggattataggcgtgagccaccgcacctggccaggctccaaattttgatagaggagtgggcatcaggtaagtggagagtgaaaaataaacttcacatttgcaggtggtttgacagtgaagctttgcatgtgtggccttaattccagaggacagtagcatatcccaggggagaaggtagaagccagcagataaagactcttttaacttccctccatctaggcctacaatcttgtccacatcatcattccacaaaacatggtatttctccttaaggccaattcctgaacttcagaccttttggcttctcagggatgtcactctgttatcccatctattatatctggattccgtcaactttaaccaagcttatttatccctctttatattccttcggtactgttgtcgctttgcctttattttttatttttaaattatttatttttttgagacagtgtctctctctcttgcccacgctggagtgcagtgggctcaggtgattcttctatctcagccctcaagtagctgggactacaggcacctaggcttatttttcttctttcttccttttttttttggagacggagttttgctcttgttgcccaggctagagtgcaatggcgcgatctcgactcaccgcaacctctgcctcccgggttcaagtgattctcctgcctcagcctcccgagtagctgggattacaggcatgcaccaccacgcctgggtaattttgtatttttagtagagcgggggtttctccatgttagtcaggctggttgtgaactcccgacctcaggtgatccgcccgcctcggcctccgaaagtgctgggattacaggtgtgagccactgcgctcagcctttatttttctttattaaccagatttctggaaaaaatagcctgcatgtactgactgcattattttctttcatgcccactaattcttccatcctttgcaatctaattttcatccccttctacttctatgaaactgcagttgctgtagattgcagttgacactgtggctacatccggtggtcacatcgtatcttcagcctcttaaacctcagcacaaatagctctattgaacagtttctttctgctcttgagctattcctcatttccttttgtatggtccatttccttcgtgtaccgtaaatgccaacatttctcagtttatgggtgcagttactgtttatttgcctacagtctccagtacatttctagtctcccttctccaactttacccacatcaaaaccatccacttaatgtctctacacacacttcccacaggcatctccagctgattctgtttcacactcttctctctcatattaattggcattttcagacaccaaaatgcccaggcaaaaatatgaatatcttacttggcctttcctattttcccatctgctcatatccaatttcgaagtcattgtgtccctccagccactacctgtaatctaggttataccattctctcttcagcttgttgagatgctttcataattggcctcctgttgagtgaactttaccctgtcctccaggcacatcctgttacttactgcagcatgttctaacctttatcaagcatgccgatactgtcattgttttctcttgccagaatgtacatttcataggtcaggcactgtttacattgtattcccagtatatggcacagggcatgttcattgcataaatggggaaagttatgctagacaggaattcatgtttgtaggcttgggaaggacctagaagagaaagagcatttgaagatcaagaataggtacctcatggaagaggtgagcagggctgggctctgtgtcctgcacaggtcagctttgtgtcagctttgccaggtgttcaggagtggagtttatatcaccactcacatttagttctcctacttgcagccagttctctccccttcccttatttccacctttcatctgtcatagaagtcatcatcagatgagagttgatgctttgtgtcattaaataaaggaaataattgaggctgggaactttggattcagtttatttggtggctagcaagtagttgatgtgaagataattattaaattaaattaattattaaaataagataattattaaaataatgcagaaaacaattaaaaattatccaaccagaatgaccttatgggtttatcttactgtctttcatctaacttctgtttcttaagaaaacaaacctagtaatctagaataataattgttcaattgggtttggatttaggttggttctttttatttttctttttcttttttaaacagagtcttgctctgtcgcccaggctggagtgcagtggcgcgatctcggttcactgcaacctccgcctcccaggtttaagcaattctcctgcctcagcctcccaagcagctaggattacaggcgctcaccaccatgcccaggcgattttgtgtgtgtgtgtgcgtgtgtgtgtgtgtgtgtgtgtgtatttttagtagagttggggtttcaccatgttggccagcctggtcttgaacttctgacctcaggtgatccacccacctcagcctcccaaagtgctgggattacacgtgtgagccactgtgcctggcctacattgatctcttctgtgccttcccatttgtctttcttccctcaacttattgcctcacccattcttttttcagtagttacccagggccaggcgtggtggctcatgcctgtaattccagcacttgtgggaggccgaagcaggcggatcacctgaggtcaggcattcgagaccagcctggccaacatagtgaaaccctgtctctactaaaaatacaaaaatcagctgggcgtggtggtgtgtgcctgtaatctcagctacctaagaggctgaatcaggagctacccaggaggagaatcgctggaacccgggaggcagaggctgcagtgagccgagatcatgccactgcactccagcctgggcaacagagcaagactctatctcaaaaaaaaaaaaaaaaaaaaaaaagccagttagaggctgggagtggtggtgtgcgcctgtaattccagcactttggaaggctgaggtgggagaatcacttgagctcaagattagcctgtgcaacataacaagacctcatctctacaaaaaatacaaaaattagccacgtgtgatacaaaaattagccgggtgtggtggcacgttcctgtagtcccagctattcgggaggctgaggtaggagaatcacttgagcccaggaggtcaaggctgcagtgagctatgattgcaccaccgcactccagcctgggcgacagagtgaaaccctgtgtccaaaaaaagttagccaattagacttaaattaagcctttgagtttaagttgactcaagtttttgtagtttatttcagttggtggggtgtttgcagaagaaaagactttcttgatctattgataaaaaaaggaagataggaaaagggaaggagataatagtaacaatatttttagggtaagtgtgagatcagtggtatggttcagtttgtcctttggtacttggtgagaaaaaggattaacaattaaattaaccaacatttatacatactaagaaaatgcaaatttctttggaaacgttaaaatcattttcattctttcaaagatatttcttacaaagtggaatgggaatggttttaatttcatttacttctaagaaataaaagtatgttaagattttaagaagaaacaacataactaattgcagttattttttcactttcccatcgttagatgtgtgttctatgtgagttttagacattttcagaggaagggtggattgactgtatgtttgaagtcctctcaaggaatctcaagggacatacaatgaactaaatgtgttcagcccccacctttgttcagttgttggagtgactatcacttattctcttcagtctctctcacatgtattttaaacacttgaatactggacagttcccatgggagatttctgtcaaggaccagatacaaacttttgactttgttttgtgccagggtaattctgcaggaagaattgagaagactcttaacttactcagttgtacagtggaaatctgatacttctagaatgaacttgtaaatctggatgagcaaaatgatcatatcttatttttaaagacaattgcacacgcatctcatttagagccactctcttaaccttgggatagaaaggacacatcatattattctcatgtataggaaacaagtcctaaagcccaggcaattgtggcattggtgttagaacagtgctgtccaacagaaatataatgcaagccacatatgtaatttaaaatttgctagtagccacattaaaaggcaaaaagaaaaatgtgaaatgaaacaatatattttgtttaacacaatacatacaaaatatgcttttttccccatgtattcaaatgaaaaatattgggatattaaaatgtttttcgtactttgccagaatctggtcagtgtttgacctacagcacatctcatttgcactagccatgtttcaagtgccagcagctactgtattggtcagcactaggagttttagttccagtcatcttccaccatagtcctagaacatttaacctgaaaaagcatgggggcagtgtgccatcaaaacagctttctcaaatggaacatgcctttggaatagttctcatgagattttacttctaaaatcgttattttttttttgtcacatagtatttgtttcctgttagcgatgagctaaaatagtttcttatttcttacttaatctcttgtagtcatcaaaacatttgttacaggcacacaaaattgtatcagctctccttattccatagttaaagccaatcacatcttgagtataaagcagaaaagtatatgcataataattatatttttaatttgcctaggtggggaaataaatgcatttatggaaaggtccaaaagaagcaggatagaatggccccaggtaatggttgctggggaaatttgaattcacttagagttattaaaaaggaatctataccaagattggggcaatcaggttagacatgctcacaacagggataattttcttattggagttaactttttcttcattaacttcaggacttttctataaggaaatacactatttgctcattttgctaataacatctgtgtctatttcttggatatcttattttctgtgatcacatctttataagacacttcatctgggtgggttttggtgttttgtttttgtttttgttttgctaaatagtcacttttcctgtctcatgttaattgaagaggaagagaagcgagctgcaagttttatatgagccaggaggcaaaggaagatttccttatatggagtgatacatattattctatgaaggtgatgaaaatattcaccatggcaactgatctgccttacccataatgcaaaataccctatttgcatttattttgccagagaattctgaaattaggatctatgtagtagagaatatgaggaaggtaatatactatttcggttgaaaaggagaataatttttcttttgactcgtcaagtgcagtagtaagaaggggggaagagaagaacaaagagttggatctgtaactgtgaacaattgattgaaataattcactacttttagaccaaccaagaagaagaatagttttgaccagaattggaatttgaacgctcccccaagttgagtatgtctgtgtgctagtggagtggggaagggttgagtcacaatccagttcagcaaatctctgccaggatgtttactttttagctccccttatctgattttccattgtaaatttgtattaaatatttctgataagcagcctcaattcttgtggaagtttgagggcaaataaataatatgtacttatgggcaaggcattgtaatagttgcttcaggagatttaaatgagtaacacaccattctagtactcttggcaagcttaaatccagagggaggagtcagacaattattcgtgcagctatggtaccaggcagagcaaggcaggaatcatagcagatatgctatctgaaaatgtaaggtattctgattattccttccatgccttaactggcatctctaaaccatttttccttccaccttgggaacccctcatcctttgagacttctgccctttgcttatatctaacttatagttgctgctccttttttatttttttatttttatttatttatttatttattttttaatgagacggaatctcgctctgtcgcccaggctggaatgcagcctgcttctccttgttgacaggaaatgctcagcttcacattcaccccctgccccagcattatccggcattttagtatttacgttttacaatgcacttttctaacatccttacaccacattttcttgacctttcaaatacagtgaaaggtattttttagcaattttacttaggcagtgctctccttatgcttagttctttctttttttttttttttttttttttgagacagagtctggctctgtcgcccaggccggattgcagtggtgagatcacagctcactgcaagctctgcctcctgggttcacaccattctcctgcctcaccctctcgagtagctgggactacaggtgcctgccacctcacccagctaatttttttgtatttttagtaaagacggggtttcaccatgttgtccaggatggtctcaatttcctgacctcgtgattcgcctgccttggcctcccaaagtgctgggattacaggtgtgagccaccgcgcccggcatgcttagttcttttttcttttttcccacgctaaaccagagaccctttttttgaaatggagtttcgctcgttacccaggctggagtgcagtggcgcgatctcggctcaccgtaacctccacctcccgggttcaagcgattctcctacctcagcctcccgagtagctgggactacaggcatgcgccaccacgcccagctaattttttgtattttttagtagagacggggtttcttcatgttggtcaggctggtcttgaactcccgatctcaggtgatccgcccaccttggcctcccaaagtgctgggattacaagcgtgaggcagcacgcccggccaaccagagaccctttaatgcttagatcttcacttctaaaatcttgaactctaatatcatgcctcccagctttctcattctgcatcacaccttctccttaatatcagtgaggcctccagagccttccccaactctcacacccctactggtcttctggctactttaaaaccagaatttcgtcactagtcctggtcagactccagctcccgttcctgatgtggatcagttctccggggcagtttctttgctcctactcacggactgtgatgcacagctgtgtggcttggggaggtactttttattgtccaatttgactggactttttgtcttttttttttttttttttttttgagacagagtctcactctgtcacctaggctggagtgcagtggcgcgatctaggctcactgcaacctctgcctccctggttcaagcgattctcctgcctcagcctcctgagtagctgggattacaggagcccgccaccatgcctggctaatttttgtagtagagacgtggtttcaccatgttggtcaggctggtgtcgaactcctgacttcgtgattcacccgcctcggccttccaaagtgctgggattacaggcttgagccactgcacctggctttttttttgagacacagtttcattctccctcccaggctgcagtgcagtggcatgatcttagctcactgcaagctctgcctcccgggttcaagtgattctcatgcctcaacctgttgaacagctgggattacaggcatgtgccaccacgccctgctaatttttgtatttttaatagagatagggttttgccatgttggccaggctgatctcgaactcctgacctcaagtgatccacccaccttggtctcccaaagtgctaggattacaggtgtgagccactgcgcccggccgcctttttgaattaagtacattaataaagcgttagaacattatgtatttaacacaaagacaatttgaatttgcttttttgttgcttattccttcaggtattctaaaatttatttttaagtaaagcttttaattgaagttatgacatgcacagaataccacacagtttagaccattaatttttataaacgtacagggtagagcattgtcacaaagtggccacacctgcatacctagcaacctgatccggaaatagaacccaacccacatatcagaagccctgtcatgccccttccagtcccttcctttactatttttctttttctttttcttttttttttttaatttgagatggagtctcgctctgttgctcatgctggagtgtagtggcttgatctcgactcactgcaacctacacctcctgggttcaagcgattctcctccctcagcctcctgagtagctgggactacaggcgcatgccaccatgccaggctatttttttttttttttttttttttgtattttttagtagagacggggtttcaccatactggccaggctggtctccaactcttgacctcaagtgatcaatcacccacctcggcctcccaaagtgctgggattacaggcgtgagccactgggcccggcctccttcacccttttttccactcttttctgatttctaacaatgtagattagtgttaacattttatataaatagaattttacagtttgtgttttttgtcttattttacttctcatgttggtaagattattcatgttgtgtagctttgttttattcatttgcattgctgtgtgatattctattatgtgactgtatcacaattgatttatttattctactgatggaccctttttcccagcttttttgccattatgaaataactactgtgaaggccgggcgtggtggctcacgcctgtaatcccagcacttcgagaggccaagatgggcctatcacttgaggttagcagttcaagaccaacctggtcaacatggtgaaaccccttctctactaaaaatacaaaaattagccgggcgtggtaatgcatgcctgtaatcccagctactagggaggctgaggcaggagaatcacttgagcccaggaggcagaggttgcggtgagccgagattgcactgttgcaccgcagcctaggcgacagagcgagactcagtctcaaaaaaaagaaaaagaaaatactactgtgacattatcctacatgtgttttcatgcatatgcacataaatttctccctatcaatggaatttctgagtcctgtaggttatacataagtttcactgtggttgatactgccagttagttttccaaagctaattgtaccagttgacacttcgatcaaagagtatgaaagttccagttgcggtcaggcgcagtggctcacgcctgtaatcccagcactttgggaggtcgaggtgggtggatcacgaggtcaggagttcaagaccagactggccagcgtggcgaaaccccatctttactaaaaatacaaagcttagttggtcgtggtggcagggcgcctataatcccagctattcaggaggctgaggcaggagaatcgcttgaaccagggaggcggaggttgcagtgagctgagtttgtgccattgcactctagcctgggcgacggaacgagactctgtctcaaaaaaaaaaaaagaaaagaaaaaagaaagttaagaaagttccagttgcgctacatccttatcatggccttctttcattttgactattctggtggatgtgttagtgccatctcattataattttcttttcttattctttttgttatggaaaatttcaaatatatgtaaaactagagaaaattatttggcacatcccagtatatctttgctcagctttatcaactctcagctcatgtcggactttttctgctgctctgttgactctgatttgtttcgccattcctcctcacaggtgtctcagacttggaccagtctctaaaattctctacctacaaaatgttcagcctcttgtattttaagttaatattgtagtccccgtttgtcacagaggatatcaggtacaaattcttgcaatttcttgtactctaatgtgtaaacttaacgataagtgtgccaatgtttacatctttccttcaatctctttttggttttttagagttaaggtctcactgtattgtccaggctggttgagcaagtgatgctccctccttgtctcccgaagtgttgagattacaggcttgagctacggtacctagggtctaataaaaggtgtcttattcctgatatttgttttttgggttttttttttttttggtggtgggggacagggtctttttctgtcacccaagctggaatgcagtgatgcagtcacaactcactgcagcctcgacctcccaggctcccacctcagtctccgtagtagctgggactgcaggcatgcaccaccacgtacaactaacttaaaaattttttttttagagatggtgccttcctatgttgcccaggttggtctcaaactcctgggcctaagcagtcttcctgcctcaacctcccaaagtgttgctattacaggtgtggtgaacaggtccttattgacagttttctaggtctcattcttttttgagggcttgatcttttagtctctggtgtttggctataagatttttaacgtctcctattctatttgctttttccttttgacttataaatgtactcaatgtttcccatttcaaaaagaacctttccttgaccacatatcatacactgtctattttctcccctcatcgagaacaaatttctcaaactagtagtcatttctgtctttgctcacatctctcaagcactgtggtcagataatatcctgttgcagctccccaaaaccttcactaaatctgatttggcctaggacaccgatgatgttctaattgccaaatctagtggatacatttcagtgtcattttttttacataataaattgtgagttcttcctagtggaaggcactgctaaatgccttttaaatataaaagatgacaagacatagggttatgtatcatagtagaagtattaggcttatcagatgacagtgaattgcctactagctactatttattgaagagtgaacaccaggatgtgctgcagctgttctaagaggtttacatgtgttatttaatttctccaatgaagtaggcattattatttttaatcttcattttagagaggaaaacatctagtcacggagaggctagaaattgcctgtggccaagcatttagtgagataaatttgaatctgaacccagatctaactttagaactcctactgtttaagaaatgtctgcatttgttgggagctggactcagagaactcctgctaatgcctttgagatgtggatacaggggaggagaagaaatgattgtcagggaaggcttcttgttggttgattgatcaatgggctagaattagaacatacttagttaggtctgaaatagataatttagttcaacacccctaatttacatttgagccctagggaagcaacttgtccaaaatcatacagagcttttttgtgtaataaatttggcaacagtcagataacctagtctgacatttatttttctgtttttccaaaaaaagaaaaagtttcacccaaacccctgaaccatgtgccacctaaaatgctactagaaatgtagcatagaagaagagtataaattccaaacatttctctaccatggtgattggaataggatttctaataatgcacccattgtattttatagtgacttcagaaatgaaatctttattactgttgtatgatgttcgtggattgacttctacatacagagtgagtgtggctccagaatcagtcggcctagatttgaatcttgctccttcagtagcttagatgtgtctcagtgtgtttgtttcttcattgcaaaacacggatgcataatattagtacctttttcttggagttgttatgagaatggaaagagttaatacgtgtagggcattttgaaaagtgcttggtctgtcataagcactcagtaactgtttagttgctgtttattgttaaggtgatggtttccccatttctattccagtttatttcctgggggcctgctttttgatttctcattggggatagggagctgggaattgatatttgaaaagtacaaagaagagcaagtgtgtatacttatgccatttctcattgttactaatttatcttgctgtattaatttccttagctctgagtacatattaacagtctatactgagtaacactcgtgggaattaaagaactaaaactcctagacaatgaagagcataatttctacttccctgtattttcttctctttctcagcaatatatatatatatatatagctatatatatatatatacacatatatatagctatatatatatacacacacacacatatatatatatatatatatttttttttttttttttttttttttgagatggagtctcgctctgttacccaggctggagtgcagtggcgcgatcttggctcactgcaacctctgcctccgggtttcaagcgattcttctgcctctagctgggactacaggtgcctgccaccacacccggctagtttctgtatttttagtagagacggggtttcgccatgtgggccaggctggtcttgatgtcctgaccttgtgatctgcctgtctcagcctcccaaagtgctgggattacaggcgtgagccacggcacccggccttagcagtatttaaagccttagttggtagagttaattagtgttaacatatttaaagtgtttttcccttctagaaactgggatactcactatttagatgactttcaaatattgctaatctcaaagcaacttcctgggaagaagaaaggcaaaggttggagttagggtctggcagagggggaaaggaaatggtgcaaatagcatggtggtcacctttttgtatagagtttagagtatctcagtgacttgctaacctagacatctatagtatttgtaattaaatgcacaaaattacacttgtctttatcaatcttcttcttcattttctcgaacctctaaatctacttataaatcttttaacatactagttcctgatttgtctaacttattttcttccttttttttttttttgagaaggactcttgctctgtcaccaggctggagtgcaatggtgcaatcttggctcactgcagcccctgcctcccaggttccagtgattctcctgcctcagcctcctgggtagctgggattacaggcacatgccaccacgccaagctaatttttgtgtttttagtagagatggggtttcatcctggccaggctggtctcaaactcttgatttcaggtgatccgcctgccttggcctccgaaagtgctgggattataggcatgagccaccgcgcccggcctctaacttatttcttaaagttgctgtagtgaatcattttttgactattattgagtgtgtgttttgacacagcgtcttgctctgttgcccaggctggagggcagaggcgcagtcatggctcgttgcagcctcagcttcccaggctcaagtgattctcctattcagccttcctagtagctgggaccacaggcgtgcactaccacacctggctcatgttttgattttttgtaaatatgagctctcactatgatgtaccctgcttagatctaccatgcctggctaatttttttatttttttgtaggtatgaattctcactatgttgcccaggttggtcttgaactcctggactcaagtgatctttcctcctcagcgcctccgaaagtgctgggatggttacaggggtgagccatattattgtgtttttatagtaagtcttctgatttctatgattcgaattcagcattcacattcagaatgtgttctccctttaaaatagtaacccttatgacgggttttgacatttttcacaaagctcaatattaaataagttcttcataacatttggtattaaggtcatatcccctttccaagcaaccgaacaagcatgtaagactttggaatataaatttaagttcctcttattggctgggcacgttggcttacacctgtactcccagcattttgatagccccaggcaggtggatcgcctgagttcgggagttcaagaccagcctgaataacacagtgagaccccatctctacaaaaaaatacaaaaattagtggggcatggtggcgtgcacctgtagtcccagctactcgagaggctaaggtgggaggatggcttgagcccagcaggtggaggctgcagtgagccaagattgtgtcactgcactctagcctgggtgacagagccagactctgcctccaaaataaagaaaactcctgtttttatttgtaaaacttttcatttttttgttaatttctttggaatggcgccagatatttcgagaagaatcatgtatcagtgtgtaatcttttttcctttatttcatcctagagatagctgaaagataacagctcttttcgtctatagaatgaagaatacgtagttgtgattttagagtatccacaataaaagtttttcttaacatacttcttttatgtcaacaactatacataaagtagcatcagtgttcatttcttctcagatttgctaacatttctcatcaaaaaataagtatcctgtctttccttccatcagtatgtgaccaggctcgctcaattccctgagctgtttctcccatgtaggcttcattgttcgggttctttgcttctctggatgcacagtcaccccagggctcccttctcatgccttatggtcctctctcccatcaccggtctgccttcagatagctccttcctttcactttccctctactctgagctccctccttctacttgtccaaggctggaagggagaaggctgactgaataagtctagggacacaccctccagagaggaagcacgttcacttccagttaagttagtatgtgcttcagaatagggacatgtaaatacctagaggaaatgtataaaacagaggaggaagcaattaacactgcctgtggggatcaggggaacttctgagatgagctgacaagtaaagtgcattatttattttttttctttttgagacagtgtctcactctgtctcctaggctgaagtgcagtggtgtgatctcagctcactgcaacctctgcctccctggttcaagcaattctcctgcctcagcctcccaagtaactgggactacaggcgcccaccaccatgcccagctaattttttgtatttttaatagagacgcggtttcaccatgttggccaggctggtctcaaactcttgacctcaaatgatccgcccgtctcagcctcccaaagtgctgggattacaggcatgagccaccatgcccaacctaaaatgtattttgataaatgactagaggtgctctctggggacaaggtggagcaagagagaaaagggacttttacacatagaaggaaaagcatatgccaacagtgttccacacatgtggactgatttgtctttttccccttagtgcctcctctgatttgttgtttttattattggtcccagaccaaaacaatctcactgttgtggttcattttgttgtcaatttttttcactatttgtaaatgtaccgtcattcattcctagtgcaatttcccttctcttatacaaaggcacttgtgcctgtgaacattgttttgcctgccacttccctcagagatctcaaaattgttatctgcttacctccaggcatccagacttgcctgattgctgttttattgttacaacaaagtgctttgttgactgcttagatgtcaagacagattatgcagttatgcagttgcctaactcataattcatagctcctctctgtccctgcttgaattctacaatgagtcatgatctttaaaatccctgtgcatgtgccatcactgatcagggtttacatctagtatctttctgggataggttaaaaacacagaaaatatgtttcaaagtgttccttttgttttgtttcctcagcgatagaaaaaagaaaaccttcattcaacaaatatttgttgaatgccaagtgcccaaaattttgctctgctaaaaaaaaaccagtgatgatcaagaacagcatgagctttgccaccaaagtcaaatgtgaaatagtccctggaggcagagggtgagcgcagtttcagtaaagtgaggaaagtgcccgtgatgaaagcattgttagtgctagtccgaggagtaattagaggacatatgttctggaggaaggggctgaactgagaccatagtaagcctaaaaggtgggatggagcagaagaggaggtatctttttttttttctttttaagatggagtctctctctgttgcccaggctggagtgcagtggtgcgacctcggctcactgcaacctccacctcccgggttcaagccattctcctgcttcagcctcctgagcagctgagaccgtaggcatgtgccaccacgtccggctaatttttatattttagtagagatggggtttcaccgtgttagccaggatggtctcgatctcctgacctcgtgatccgcctgccttggcctcccacagtgctgggattacaggtgtgagccaccgcgcccagcaagaggaggtatcttacactgtgctcgtgctgagtgaggcgagatgatgatggagatgatgatggctgtattatactgtgggagtgggaagtggtaagaagctaaaggtgctagagggtggctagtcaaaggaccttgagggagaattaaggtgtctgaatcaatgaggagcgaccagagattgtcagacatgtcagtgacgtcttttttacaaaaggagttataggctggatgcagtgacccatgcctgtaattccagcactttgggaggctgaggtgggaggattacttgagccctggagttcaagaccagcttgggcaacataacgagactgcaactccactgggaaaataaaaataaaaataaaattagtgggcatggtggcacatacctgtagtcccagctccttgggaggctgaggcaggagaggatcccttgagcccaggggtttgaggccacagtgagccttggttgtgccacagcacttcagcctgggcaacagagtgagaccctgtttcaaaaaaatagataaataaaagcaattatatagagaacactctgggtgaagtatggagaacaagttagaatgagaaagtgtggttgcagggaagccagttagcaggctacatccaggccacgtgaaagataatagtggcctggatataggtaaaaatggttggatttggaatgtattaaagaggacatagtatgctttgaatgagtgaacgttgataccctgctgcctttcattttgtctccaggtttgtgcagatgattggtgatgcagctatttcttgcatctgtgatcttatgcagggattgattgccaaaagtgttggtagtaggtcacgtcactgagataaggagttcaaaggagaaatttagggttgtgctggggaaacaaacagtttgatcaaacatcatctcagcttgctgccactggtccccctgcctccaaatcaagtatgtgggttgaattataaaattacccccatattttcttgtgttattagaagtcttccagcccagctttaaaactgtcgctggtttgtgctttccttattttagattctcaggggatctacaaggatatccctattacctaaacagacttcttcctgctcttgaattttcttgtctcatatcctcatttttcttatttcagtgcctttatgatctttcacttccctcttctccttccacattagtctggattaagtaactggtattattcaacatttacttggattttgcataagaagcagttctttgatgtcattgtctgtaatgcctgttccacaggttttgtaaggatcagatgaaataattaaagccctttgcataatgcttgacttacagataagcaataaatttaaattcctgtgcacttctgtatattaatgtacataatttttttttctcctgagagggaccatccaggcagttccctcgtgtctttattggctaatggattgaaaagtacatttttccatcattttgcgaattcccaatatgtttaaatcttcttgagaatttctgctgaaatcattaccttcatgtccagttgaacagtataccctatccatgatgagaaacttcactgctctgtatgcagtctgtattagtctgctcaggctgccgtaacaaaatgccatagacaaaataccaatacaaaataccatagatgccttaaacaatagaaacttggtttttcacagctctggagtctgggcagtccaagattaagatgccagcaagtttggtttctggtgagggccctcttcctggctggtagacagctgccgtctccctctatcctcacgtggcagagagagtgctccggtatttccttctcttaagcggatgtcagttccttctgttctgggctctatgctatggcctcatttaatcttaatcacttccttaaaagccctacctctaatacagtcacataggaggtcagggattcaacatatgaattttgggggggacatgatttactctaccgccgtcccccaaaagtatttttattctattaatatatttattagtatacattatatgtttaatgttatgttccttttgaaagacctaatttcattcgatgattgtatttgctgttgggtgaatggaaccaaagctgaaggtggcaatatttagtcatacttctatttatatgagtgaaagtcagcattactccccagaagccaaattttagtagcatctttttgctggaggggactggttctacctgatctgtttgtccttgctctttgtctgaggtaggtgagcttgaatttcttactctgattttcctgactgttgttggacatttaggttgttttcagatgtttttgtgtttcagagagcatcagtgagtaatatccttgtacatatgagctgttcagttatgagagttcagctgcagttcctaaaagtggattagcacactgacatttcacacgtcttctactgcgttgacagtaggttgtgctgatttactttctgtgttgccacagtttccaacacttttgccaagattggccttattgaatttttttaaccaccgtcaattttatatttgaaatatgttacgttattctaatttatatttatttaattataaatatggttgtgtgctctcttgttaatcttttttaaaaatagactttattttgtacagcagttttagatttacagcaaaatcgagcagaaagtacagagttcccctgtacccctttcccccatgcaccaacatctccctcgcttgtcaacacgccccccaccagagtgtaccttgttaggattgatgaacccgtattgacataacattaccacctagagtccatagtttacatcggggttcactcttggttttgtacattctacgggtttggacaaatggatgacatgcagccaccattatagtattacacagaagcatttccctgccctaaaaatcctatgttccggctgggcgcggtggctcacgcctgtaatcccagcactttgggaggccgaggcgggcggatcacgaggtcaggagatcaagaccatcctggctaacacggcgaaaccccgtctctactaaaaatacaaaaaaaaaaattagccggacgtggtggtgggcacctgtagtcccagctacccgggaggcttgaggcaggagaatggcgtgaacctgggagacggagcttgcagtgagccaagatcgcgccactacattccagcccaggcgtcagagcaagactctgtctcaaaaaaaaaatcctatgttccacctattctcctcttccctctttcccctgcatctgttgattttttttttttttttactctctgtagttttgccttttccagaatgtcatatagttgtaatcatacagtggcttttttcacttagtaatatgcatttgtgtttaagtttactccatgtcttttcatggctagagtatgcatttttgacttggtatgcaatactacagaagtaatactatgttcttttctaatcaggaggtacataatgtccatttgttctggtgaaggtaaatttgatcgtttgattaaggtgatgtataccagatttcttcactgtaaagttactactttttcctctgtaatgaaagtgttttgtgggaagatactttgacattatgtaacaaatgctgtttctcatcatagctttcagcaccaattttcaatattttgcctgaaacaattattactctgtttttgccaaatggtgattttttaataagatttttagtatagttaaatttttgtcttcttccatagcttttgtgtttttctgttctacttttctctaaggctttcctcactcaaaacattattaaaaattctcatgtttacttctctttttaaaaaactagtgataacatttcatgagcactttctaatgtttatgactttaagattgccagaaggaaaagatcactgaagaccacctaggttaacaaacagcttaaatttgaaaaaacaagtgaaagaagccaacgcatgttatcagttcataacattacctcccttctagaagaatagcttcttccattctctccagtttgcttccaatcttatagtggaaccagatcttctaaggccttagtaggaggtgacatcaagggctaaaaaaatactctttgatgaactcatgtcactttgatgctcagatataagtcagactgtgcagaagagaagctttaaagatccaagtgatttagaaactggagataagaaaagcaagcagaaaactgggaaatgttatttcagtcactgccaatatgggatgtggttccgtctgtttatttacataatatgatctagtgctgtgcacttattaactagactgcaaatacttgcagcttaataatgtgccgcatattttatcacatcctgaattataaatttgaataaaattgtaagaagatctgatatttgatttaccttttaaaccgtgtttcaacctgcaagtagtttgcaagttaaattgttaatctacttgctgcataaataaaattgggcagtattaggaaagatgcccagggccgctgtctgagaccaagtgtctgtcttttgtcttatgtaatttgtgtctgttgcgtacttcagcacttgaaaaactattcctctgtgaaaagaggcccttcagtgttgctaggaaacccaggaactgttttatatgatctcaagattttaattcatttctagtgcaacacagtgaagaggaattgaaggctttaaccattttttgaaagaaaaacaaaaaacaaaaaaatctaaaagtcattaaaaaatcgttttaaaatatcataagcagcatactcatttaaaaaaatctcagaataaagcagaaatggacagttgtcttccttaaaatcctaattctcaaaagtagttgctgttaacaatttgacatatatcttttcagattattttgttacacatatatgactattttaaggcagttttttaaaattactttttatgtatcaaacgagaaagaaagataatataaaaactaagttgtattttattttgatcactttgtatagtgtaagtactgagaacatgaatttgggggatttcaacttttacaaatgtaggtgtctaattgaagttatttaacatttttatttgatttctacaaaatgaaaactctaaaaacacacagtaacccggaagtttttattgttattgatagcaattttttattctcacttatatattcttagctccatatttgaactatttcttggtttgttttggaatgagatttttatttttaagggtacttagattactcatattatttgatgcatgatgtgttaataaccaaactaaatttctgaaattgatcaaatttataattcactcattaattcttttctattatgtgcaaagaactacagcaggagatagaggtagccgcaatttgcaatttatttcagccctaatagagctaatgatttaatagtaaatcagggcatgcattttaaaagttcgcaaaaatacaaggtaacatgggaagaagataagtttctcaacatctaggaagatgtgacaggccaggcacagtggctcaagcctgtaatcccagcactttgggaggcaaaggcaggaggattacttgagcctcaggagttagagaccagcctgggtaacatagtgagacctcatctcttaaaaaaataaaaaatagaacatgtgacacaactctggatgccacctaagtcagtttcaccataaaatttatagaggaaaaaaaattccaaggcaacatatgctaagtgccgagtaagtgataccgatggtagaaagtaaagtacaatcagcattcatagagaaagaaaaatcattgtagggtggagaggtagaaatgccttaatgaatgagataggaatggaactgagtttattagaaataatagagtgtatttaggttacacatttaggagaaacacttgagattatgtacataaataccaaatcatatcattttaaatagaaacatgggcatgaaatggaggccagagtagttggacttttgggctggatcagtgggtttggatgatgtctgatcaatatttgctgtataacaaaacaactcaaactctagaggcttaaaacaaaaatcatgtattcatgatcctgtgggttgctagttagactaggctaggatggaaaattatgggctcaacagtggggctgcagagagctggtctagactagggctgagtgttcgagggttggccagacacctccgttgccccctctgtggtttgttcacacagtggccggtgaccgaggaggcaagagtgggtgcagcaagggtttttgaggcctaacctcggaactacacaggtcattcctggcacatcctgttggtcaaagctgggcaggcctcaggtttaagggagcaggtgcagataatttgaatcccaatttaaatttatttcaggagtgcatttacatgtgattgaaagcttacgatggtgcctaaacgtaaatggtgttgaatgtaaccaggattttctttagttctcagtctattggctttgactttattaaaattttattagaactgatagtctgtgtatattaagcttattttaggactaatggaaagaatcatgcagtgactaactcctcttcattttggtttgttctgtcaaaatttatttgaaaaacaacatcaagatagtcatgtggagaattaggactttggattgatttactcctaattttgctctaatgtgtttttttttttttttttttttttttggtgggagcaggggaaaagggagaggaagagagaggcaggccccgtgaaccataccatatcttagtgcttagggcctcctccaggtcatcatccagctctgaaggttgtcagagtcaggtgacataggtccaaatagagttgctcttcaacagaaagtagtgaaacttaatggttatgcacactttagatgtttgaatttatacttaagaaaatgttgggtaatcacaagtaaaccatagatgtgacaaactagtgctatgcatacttttatagtatgaataggaaaaaaagttttatgtgattgttcacttacagactaaatttgcatttaattttttaattttttgagacagagtcttgctttgtcacccaggctggagggcagtggcacgatcttggctcactgcagcctctacctcccaagttcaagcgatcctcctgcctcagcctcctgagtagctgggattacaggtgcacaccaccacacccagctaggctaacttttgtatttttggtaaagatggggtttcaccatgttggtgaaattaagttatgtaattttaagacgtcttttataaaataaaataaatgtgattattggctttttcagaagggaaataaaaagggatgaacagtaagaagtgtctcaaaaataatatgagtcaactatttggttttttttgtttttttttttttttgagacagagtttcactgttattgcccaggctggaatgcaatggcacaatgtcggctcactgcaacctccgcctcccaggttcaagcagttcttctgcctcagcctcccaagtagctgggattatagtcatgtgccaccatacccagccaattttgtatttctagtagagatggggtttcaccatgttggtcaggctggtctcgaactcctgacttcagatgattcacctaccttggcctcctgaattgctgggattacaggcgtgagccaccgtgcctggctgtacatttttaaaagataagtaaattgacagtgttccttttctttttgaattatcctcatcaaaacttattgcttagaaatatttttaagcattcaatagaaggttatagaattaaatctaataaaaatttaaagaagccttagcagaaactgtgtcacagttgatcagcatataccctaccgacagtgacttagttccctgtgtgtttgtggtgagcatgaattaatgtagccttgaatttgtatgacatgactgaccgtattagtccattctcacaccgctatagagaaatacctaaaactgggtaatttataaagaaaagaggtttgattggctctgcaggctgtacagaaagcatggctggggaggcctcaggaaacttacaatcatggcagaaggcgaaggggaggcaggcacgtcccacgtggccagagcagagaagggggaggtgctgcacacttttaaacaaccagatctcctgagaactcactcactatcagcaagggggaaatccacccccatgatccagtcacctcccaccaggcctctcttccaacactggggattacagttcaacatgagatttgggcggggtcacaaatccaacctgtatcactcacctttcagagattctagccaaattcagttttaaacatctgcttgcatatagaaaccttctaccagtagaaacttacataatgtcaggaagttcacagcgttccttaagggaattgtatcaaataagatgatactacttgtgtcattctacttttacaaaggcacaaattaaaaactgggcatctcttgagtttggactccattcctcgggacccaaaccccgtcctgtatccctcgcatcaatgtgctgcttctgaatggctgcggggcactgtgtgggctgtcagcgtatagcaaatgcttagtcccttgtacatttctttctctagatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtggtaagtttgatatgtccttgctcgcttagcagctgtctgtgcaactatctgatgtgtccatcaccttgccagtcacatggatgggctgcagggagctaggaaggaagccccccaacttctcaggctttatggtctgggtgaggaaggcaattgctctggtggaaattgaggacacatgtaatggagggaaatagataatgagtgtgacctaaggttacagaagagcaaaagatcactggagttcttagagacacttcagggaagaagaggaacttatgaaagttctgacaatctggatttgaggcggggaatagcagaggcctagatggagcaggcatgacgttgagacaggagtgtgtgttgtgttaggagatggcacataactgtgctttgttaaacgttagacagaattgaaatttttaagttttacccaaggattctgtcagcagtagaagtgtcattagctatggtgtaacaactacatagtattacagtctattttccttattttttcaagttaaatatcctgtccaatgaattttttaaaagacaaaatctttttaaatttattttttttactttgactttaaaacttcccagtgtaaaaatgaagtctttagagcaaaaaacaatctataaaatatttagtcttaaatttaaaaaatcttaaaacattgtttcagtattttttctaatcaaagtaataagagtctaatgtagaaaacttggaaagccaaaaatagcacagaggaggaaacatgcctaataatctcatctccaaatatatgtcatgttttaccttttcaatggttctagaatactttatttagaatgttgcatattggctttgtctgacacatttaattttttaaaaagttaataaattatattagatcagggagaggaaaataagtccaaatatttaggtaaatatagtaatatatatatttggaagagaaattttgtttttacttcatttgttcatgtaaaagaaggggatatttaaaagttacaagtaacatccttccatttaatggctgaatcagtgcagttaggtaattaatatttttggcaaacccagtcggtttgcccttgatgtttatgttaaggaaataattaaggtgctttcccaagttgtgagtgactagagccaccccctccaaagatgtaacctctgccctgattctgttaccagaacttctttctgtttccctgagcaaaataaatcgggcctgactcattttatctactcagcctcgttgccctgttccctgtcactcttacctcccccttctctcccttctctctctctggaggtgctggcacctagagtacaggctcctgtctgaggtcctgcagttccccgttcctgtgacagtgcagtgcctgtcccgctttagagcccaggactctgatcctgtgcgtaagataggggaagcctaggaaccatatggagagcgtgggtcttccgtgcttctgctgagtgaagcttgtgaccaggtgcatgtagagaccaagaagcactgtgccctgagccattagcgtgtctgttaatgagaagaagactccaagtcgtccatgctgagtgagaggcacggctttgccgtctacaggagttgtaagataaatgtgaaactgggacttgactctgagtgaccgtttctgggttaaaaacctagcttctaacctaaaacacagtcacatcagaccaaaagaaagaagggttaggaagagattgatgcagaagaggatgcatacatggaatttaaactacatatgttaacagagcccctattttaatatatttcagctagtagacagaatggttaaaaactaggaattggaggactgagctggaaaaatttgcattcttattccttatgtgatctctttagtcagcagttactgtaaacagcgtgcttgggcagtgttttgtatactttaattgtatatacttaagccttaaaacaacatagtaaggtgagaattattatacatatggcaaggaggaaacagaggcccagagattttcatgcccagagtaacaagtgcagttgggatttgaacccaggtccctctgactctcacagctgctctgttatcatttgcactgtcctctgctgcctcccgtgtttcataaacctgtttcctcatgtgtaaagtaggaacagctatacctagcatctcagggtcattacaagaattcagcaaaatactgtattcacacgcattctgtaagcttataaatgatattgaaatgataatcatgtactgtgccaagttaaatggatctggtctgcatctttgttgtgtgacttggcaaaagctgatcagtgagagccacttctttcctcagcctaaatgtcaatgtggacaatgccatcgtccttgcagggttgtgaaggggaatctgaagacatgtaaaatttcatggtaaatttcccattccttaactaatatttataacattgttttctgggaagacactaagctagcttataaaataaccaacagcgggaatgcatcttatttctcaagccccccttaaaggactactaaggtgtgtgtggagcataatgagctattggaagtataagagattgaactctacgacctttagagttagattccacaggcaaattatgataagccttttaatcaaaggaaattaatcaaaggaagatagagtagccagatttgtggagtagtcagtgttgcttttgacaagtgggtatgtcaagaagattgagcaaataaagtaatagcttgtgtttacagagtaagtcagctgtggacccgtcaactacttcttttatttacttagcaaactggtattgagcgcaacctagatgcacacagttcatatataaataaaagatctagctgggcacggtagctcatgcctgtagtcccagcactttgggaggccgaggcaggcggatcacaaggtcaggagttcgagaccaaccaggccaatgtggtgaaaccctgtctctactaaaaatacaaaaattagcagacgtggtggtgggcacttgtagtcccagctcctcgggaggctgaggcaggagaatcgctttaacccaggaggtggaggttgcattgagccaagatcgcaccactgcactcctgcctgggcgatagaacaagactgtctcaaaaaaaaaaaaaaaagatctttggtgggttggggtggggtcagtgtggttgggaaggagataatacagaagagaacccaagttcctccactcaagaagtttctgcagaataaacctggaaaacagtgttcttagatgacatttattctgattatactgcccataattagcactcaggtaaaagaaattaattgcaggatacaggccgtagttgtgtttcctgattattatttgagttttggcatcactgctctttggcccatgggtctcgtataaccagaatgaagagatttcattagcaaaaaagaaaaattataaaatgtgttaaattaatgttagagattgttagagatgactactacagttctcttccaagaaaatattccaaacatagattttattttccctctaaagcatccagcctttagtaattgccttcaaaggctatgtgtggttcagaaaactcagtgggttaggcacaggtctttgctttagttacagaagattcattcaaaggacttgttaacctgggtacacatatcttaagaggtttattttatgattttatctgttagagtctagagccctcaagtaactccaacttagtattaagaccaaacaaagttatctttttgttagattccacaggcaaattatgataagcctttgtaggggcagggggcagtaggtacttgattttgttacacttggttggcaaactacagcctcagaggcagttgaaaaatagagtatataagaatgagcaggccaggcatggtgactcacacctataatcacagcactttgggaagccaaggcgggtggatcccctgaggtcagaagttcgagaccagcctggccaacgtggtgaaatcccttgtctactaaaaatacaaaaattagctggctgtggtggcacgtgcctgaagtctcagctactggggaggcagaggcgagagaattgcttgaacccgggaggtggagggagccgagatctcaccattgcactccagcctgggccacagacacagactccacctcaaaaagaaaagaaaaggaaaagaaaagacaacgaacaagcaaatctgtgttcttgcccaatcttactaaattgctctctaggacagtatagggctttactattttatcatgttgcgtcttggtttccccattaaaaatagaagtctgggactatacccaaggatcacattgattcctttccattttctcgttctgtggtttgggtagttttatgtttccccataatactgtgttcttctttttcttttctgggagggggcgttctgtagcagcaggtgtatccagggctcctttaagagacagttttttttgtgtgtgtttgtttttcctcctgtctaattttggctttcttttagattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttggtaagttatttttatttgtgttaacgggttactgagtaagagaatgattagtcatagtactgtagtagcagcacttgtataaaataaagcttaattttttagaataacaattttaaacacttgaagtacttctatgttggatagcatcaaatataaaactagcttttggttttggataggaaaagtaagaagtgatcaacttctttgtgaaattcataagagtttgaaaataagtgaacgagtattatggtatggaggaagaaccctaagctaggagttaggagatctagggtttttgccttgtcctcagaatttgccctgagaattatgtagaaccatgtttctatgatgaataatttaagcatttagaatggagatgaagaaatatggaagaaggaatattgaattcaagtaaggccattaggcatcacatagtatttaagcttcttggcatcactgtttttcatcattaaagtgaggagatgagacattcactgatatcttatagccctctctgtaatagttaatagggaggtagtgtaaactgctttgtaaactgccaaagactacagagtttattatccttctctagattctgtgataatgtctacaagcactcttaatcccttcaaattgagaaactgaaagataatagttcataaatatacttctaaaaccatactgtggtaagctttacacaaaatgtacattggctaccatgtagaaaaacatagctgtctagctctctgcttaatgacagtaaattcccctgtcctcatgttttaggggacacttggggattgactttcataggaaaagctgatgctagaattgtctagcatgactggaaataactgatcagggcaggcctcccacatcaacatttacctcattccttctgtttagagaactgattaggggtggggtagaatattctaaagaatactctttattttaattttaatttaatttaatattattttatttgagatggagtcacactctgttacccaggctagagtgcagtggcacaatctctgctcactacagcctctgcttcccaggttcaagtgattctcttgcctcagcctcccaagtagctgggattacaggcatgcaccaccacgcctggctaatttttgtatgtttagtagaaacagtgtttcaccatgttggccaggctggtctcaaactcctgacctcaggtgatccacccacctcggccacccagagtgctgagattacaagaatactctttaggagagcaatgttcaagatgacttgggcacccaacacttaactactcctcctacaagtagacccagcacttaactattactcctagagactaggaacaagagtggggatttttgtgtaccttcatggcaaattcatgcattgtcttggtagatagactctgctggcagcatcattgaatggggacctgaagaggtcctggtgaaatgcatcattctgaatcgcactaactaaaaatgtttcttgtggtgtgaaagtaagtcaatctaaaaaaggaaccaggaaaaggaatatggtaatgttggaaatttgaattttctgtgtcttcattgagtaaacatggagtaacttttctttgttataaatgtataagcaagtgaaagattaacacctggtccgaattcttttttttttttttttttctttttgagaccaagtctcgctctgtcacccaggctggagtgcagtggcatgatctcggctcacggcaacctccgcctcctgggttcaagcaatactcttgtcttgccgtcctgattagttgggactacaggtgcccgccaccacacctggctgattttatttttggtagagacggggtttcaccatgttagccaggatggtctcaatctccagacctcgtgatctgcctgccttggcctcccaaagtgctgggattacaggtgtgagccaccgcacccagctacctggtctgaattcttatcacagacccaggaattcctgagattataaccctgactatactttcttccaacactgctctctaggaactattaagttggaagatgtatacggaatattaactggttcatgatatgcgaagcagaagatatttgattatcggaattatttattgtgaaacccctgtttgatgggacagttacactgggattaatggggttggcacatattcccagaagagttgtggacaagcatgtttgtgtgtttgtgtattgtctggatcctgtgggaccaggttcagggtcacatttgcagttctcaactgaagagaacattacagcagaacatgtcccaaaaaggaacctgagttgggtggtaggggatggcacatgatgtggctcagttcactcatggcaggagccgtgactgcccggcagtaggaatggcctttttatattaaactttgaaccccagcatgtcctaagaatgggtaagtgggaagcattgacacagttcaccctgagttactcctggggagaattttatagccaagtcagccttcagttcaaaccaaggagggggagaggggataaactggggatgagaggagaaagcagggaagtgattgccgaagagaagtagggacgactggagctctgatctggacgaggttgtgtcagagccagagaattccttgtagctttttcttccatgtttttagatgagtcgtgactgctgctgggagaaaccaccagaattatattctctcgaaggtgaaaattaattggattgaagcttatctgttagttttgcctggaaattctgcctggattatctggggcaaaagataagatgaagtgccctctagtgacccaactaagtggtggtcactggagctcatttgattgactgatagtggctctgtctaatgctttggttcttttgtgggaaatctgaagtagttgccatcatggcattcacagggtaatggcagtgcattcattgagcttgtgtgttatgtggccgttaacccacagagatgattgatagtcgtctggatgtgaggggcagcatgttgctgtagcttgctccattgccgtgcctgccttgctctttcagacacagcagaagctcttgtggatgcagctcagtaaagaagcagaagtgggaaatgataacaaagagagttgatagaaggttactgttgtggccatatatcacgggcaccttcccctggagctctggaagggcctgtttattgaaaccttttggtataaagagacagagttgttttgaagagcagaacatgcacagttaacaattcctggacatatatggtatactcccactgcaccatgccacagtggcagcagcaagtgtagtggctcagtcatcactggccttaaaggtcctaagggatttgcaaaccattgatactgggcacggcccctcactactttttattttacaataatttttagttttatggaaaagttgcaaaaatacaaggaagtttctgagagtggatccatcatctaatttcccctaatgttaacatcttacaaaatcatattataattatcaaaaccaggaaattaacactgatacaatactattaactaaattacagacccagtttgaattttactgttttccggtaatgtcctttttgtactaggattgcatctagaatccacatggcatttatatctccttaatctcctccagtcacgtctgggggcacatgatgtcatgtcttattgttaatcgtgatcgcttggtttaagttttatctgatgggcttctccactctagagttattatttttccctctataattaaaaaatgtcttgggggagctacttcgagactatgcagatatgttatttcttatttaacttttgcctattgattttagcatctattgatagattttgcctggagtcagggtatttttgaaccaataagaaattatatttcttggaaggatgacatcatgataaaagtatcccctgtctcatgtagggatttagagattatttccagtagactggtgcagccactagcaggaaaagatgatgaaggaatacgtgtatggaacagagcattactaaattggtgggataccatgtccaactacaacttgatggtcacatacccatatctgagaaggactgttgtttgtgttagtgatcatggaagcagatgttctgaggacagcggccagtatgtgggaagtccagaccaaagaaacatttaggagacaagactttattcgtgctctctttgtggttttcttctgttccagcagagtaccatgggttaagaattaatcttcctcgtagtgtaatggttggatgttggcatgtaaaagacttgtacttcctcttcccagtggaaagcaggtgggccactccaaagtgtcattcagaaacctgtgttggtagaatcttgttttattgtggacgggttgtagtgaggccctgaatttcctagcagctattttaaataactatccgttattagatatgtttagattgctggttatatgggagaaaatggatatagaaaggatgagcgttagagttagaataccatattacccatagatgtttgatgcacaaagcattgcatcagttatttatttgctggtaatttattctaataaaggatttattggtagtttgaagaactggaagagaacaaggctcatttcattgaagactcccagaatgaaataatttgcaaaacttatttaaaagtccaattgatgtagtctccagagcacctggtcagattgaaaaataaacagatttgtttggaaaaatcaacagtgcagttaaatatgtgttgacccttatttttaaaatgtaagtaggagcagatgaaggggaatacaattaaatttgttaaggagttactaagaaagagtaaggtcatggttgataaccttagttgaagataccccactgaatatgataaatcatgttgagccagttttgggaaacaatttgacaatttcttacagtgttaaaatatgtacagtcaccatatgatccagcagttactaagacaaaggaaagcatacgccagtgttcacatgagtgttcaagcagcattattcataatactgcaaaacaaaaatgcatttacctttattcatagtagtgaaagaataaaaacccattcacgactgaaaaaatgaaaatcagcttaaactaaaaaagaaaaaagtcttgacgtttatcagccggaaggacagatacagattaaagtcagccacagagtttatagaaaacattgtctctcccaaggttatagagtagtagtaaagcatagactattgctgtcttttctagtgttgcccgcagacccacatttctctacccatcctttactggaatactcaattactaaatggccccacctcctcacagctcccacttcctgtttaatcctcatttttcctaatctcagaaacagctgattgacagctgatggctacttccttacaacctcctgagaatccttcagcatccctgctcttgtccagtggcattccgtggttcctcgtaatgccgtcctcactagtcaatctgattttgatagaccacacacttgctccttgtcagtttggctgactgggctttgacagtagccccaaactggaaacacagtattcattaacaggtgactggataagcaaacttgtgttatagtccattgaaatactaaaataactatatatacaataacggctcaatctcagaaatgttatgctgaataaaagaagacaagaaaatacatactgtagtattctattcatgtggttccagaagaagagctaatctacagtggtagaatctgatcagtggcttcctgggtccagggttttggagtcccatctattgtaaccagcatgagggaacttccttgggagagggttggagtggtgcttaatggatatagacacatttattaaaagtgatcagcccacgtgattaacatgttaactttattgtgtgaatattataccttattaaagttcagcagaagagtatgcaatgccaaggtgttaatccaggattggggtgagttgcaggtaatggagttagtagttgttctaaacagttacccagaaacacctggaatataacctcagatttcctttttttttttttaattaaatattcttttttacacatgaatttccaggctgtgaatatctttttgattcagggtctggttctgtcacctaggctggagtgcagtgacatgatcaaagcttcactgcagcctcaaaatcctggtctcaagtcatcctcctaccccagcctcccaagtagctacgaccacaggcacacatcaccacacccagctaatttttcgaagtttttattatgacagagtctcgctatgttacccaggctggtctcaaacccctgacctcaagtgatccccccactgtcttggcctccaaagtgctgagattacactatgcccagcccaggttttcttttttgtagcctgctctttggatggatttgaggtgatgtaaatgcagaatgctagttgttccttgccacactaagtgttgttagtattgttgatgataaactgcctgattgtcagggttatggcgcctagagggatgtgacttggtacatactgccagagggttacatgtcaggcatggggaagaatagctaaggaatgggagggggagcttccttgactctcaagtggtcttgctgaaaaaagcaagtgcatcattcttgctttttttcaggtgtgccccatgaaatggacaggcaccgagctatgcctgagatattgccatatctactaatgcagtggctgcttgtctgagcttattctttgctgttttgtgtcagataaagctgaataaactgatgttgatcacttactgtggtctttcattcttttgtgaattctgaacccagaaccaactgataatgagtcagtggttgtgtacaatgctgtattcataaaagtaagttccattctcttatgtaaatttataatttgttttctctttcagttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcaggtactgctgataatagtatttgtaccacatgccattgatttggactaagatctagtaggggtgtgtgtgtgatttgagatagggccttgctctgtcacccaggctcactgcaatcacggctcactgaagcttcaacctcctaggctcaagtcatcctcccacctcagcctcccagttagctggaactacaggtgcatgccatcacaccctgctaattttttttttaaaaaatgtgtagagacaggatctccctgcgttgcctgtgctggtctcaaactcctgggctcaaggagtcctctttccttggcctcccaaagtgctgggattacaggcatgagcccaggcatgtgcccagcctgcttgtatattgtagattcccagatgctttctttcccttttctacatagaataatcaggatttccataggaattattcagtgttttataatatcaatttagtgtcatatattataaatgaagagctattctatgatttcatttttttaggatattagttactttggtacttttttttggttttttttttttttttttttttccgagacaaggggtctcgctctgtcacccaggctgggcgtgcagtggtagaatctcggctccctgcagtcttcacctcccaggcttaagtgagcctcccacttcagcctcccgagtagctgagactacaggcatgtgtcaccacaccctgctaatttttgtattttttgtagagatggagtttctgcatgttgcccacactggtctcaaactcctgggctcaagctctccacccacctcagcctcccaaagtataggtgtgggccattgcgcctggcgaattttttttttttaattgatgagacatgttcatgattacaacttagatggtggctaaagtatagtaagagttggctctttagtgttttgcctagattgaaaatatagtaatttacccatggtgtgtctgtaaattaaaagaaaacccgtgtgacactaactagaaagttacaaattggccaaatctgctcacctatttgttataattgacttcttagttcaaactgatgaccaggctccaccccgccatccactgcatcctggtctttagtaggttttctctctgcctctctgtttttcaaactaagagaccaatctgggagtcctcttctgacttccttttgtatgtttcttccatctaggggggaataaaataggttttgtatgttttcctgctgcaggaaagatcctttgtggaatgcggtagcgtttatagtcttatgtgccccaagatgggtttgcagcagctacacagtggaccagcacccctgctccagctgaggctgtgtgctgcaggggatcatggttactttcaccttgatacatgtgaactggaagcatgattgaattctggaaacatctgtgtggctcaatgccagtttgcttgcatccagccttggtctgtcttgcttttaactggattgtttaatttggagaggactatgtttactaacacctgataacaatacatactataaaaatgagtttgttttctttttcctccttccatagaaatgacttcatctgttatatctgtaaaaaatgcctcttctgagtactctgggacatacagctgtacagtcagaaacagagtgggctctgatcagtgcctgttgcgtctaaacgttgtccctcgtaagttatcttctttctgttggtggttttgtttctgttatctttataccacctcctttagttcagtcagcaagtgtgtattaaggacaaagggacactgactttgatcagaacactgtggtttgattattagcttttctagaaaaatacattttattaaaaaaacttcataattgcaatgatatattaagaaggtaagagttgtcaaatcaacccttgtaccatatttagctgttataagtatgagtagcttagaacattcttatatgttaaccaagatagctttgaatattaaaatctttcagacaggttttatcattttaatgcttggaatagattatacagttcagaagacagttctttttatgaatttttcccccggatcaaaaagactaaataatttgtcttaaagttaacacatgtgatgaaatcaatctaaaaatgtatagcctaccttcagtatctatacatgtatatatgtatatattttttactattaattcttcttattttagcttcaaataaagctggactaattgcaggagccattataggaactttgcttgctctagcgctcattggtcttatcatcttttgctgtcgtaaaaagcgcagagaagaaaaatatgaaaaggaagttcatcacgatatcaggtaattaagtgagacaggagttgactgatgtataccaaatatatgtcatttctctaaagcattcgttctcttattaaccacccaaagcatctttcttaggagaatgggtaaaagctctggccgccttctcaatacatttgaaagcatttacttctaactgcaagtgcagagctccaaccaccattcgttgtgccccgctccccaaccttctcgtaccccattttaagaaccactgccaaatgattatctcaagactgcctgcttcttgagaagaatccctgcctgcagtggtagggatgaagtagatattgaggtttgaaaaaaaaactgacctgattgtatcaagtaatctggaagtttgtagaacaattggtagtataatttttattttccttaaatattctaaatcagtaggtcttaacgagaagtgtgcatattagataatagaattttagaagtaataacacatgacttcacaccctagaaattgacatttggcaggtctagggtggggtctggacacttgtacaggcacacttcagagttatcgcacactgcgataaatcacatgaatttttttgtttttccagtgcataaaaggttatgtttatactatattgtagtctaaaatgtgcagtagcattatgtgtaaaaaaacagtgtagataccccaattaaaaaaatattgctaaaaaatgctaatgattatctgagccctcagtgagtcttaatctctctgctggtgaaaggtcatgcctcactgttgatgactggtggctgatcaggatggtagttgctgaaggttgcagtggctatggcaatttctttctttggttgttgggttttttgttgtttgttttctgagacaaggtctcgctctctgttgcccaggctggagtggagtgatacaattatggcccactgcaacctctgccccctgggttcaagtgatcctcccacctcagctttccgagtatctgggactacaggcataagccaccacacctgactaattcttgtattttttgtagagatggggtttcaccatgttgccaagggtggtctcgaactcctgggctgcattggctcctgccaagatgtcaacctgtcctttaaagctttgaagccagacattgacatctttagccactaaaggcctagatggtgtcttcttccagtagaagtctgttttgtctctattgaaaatctgttacttagtgtagttaccttcatcaacgatcttttaactagatcttctggataactttctgtagcttcttcatcagcactttgttgcttcactttgtatttttatgttatggaaatggcctttttccctaaactcattaaccagcctctgttagcttccaacttttcttctgcagctgccttagctctctcagccttgatagaattgaatagagttagggccttgctctggattgggctttggtgtaagggaatgttgtgactattttgatcctctatccagaccactaaactttctccatatcagcaataagactgcttcactttcttatcgttcacgtgttcactggagtaacactttgactttactttaagaactttttctttgcatttacaatttggtttggctgtttggtgcaagatactagctttcaaccagtgttggttttcaacatgctgtcctcactaaggttaattatttctgggttttgatttaaagagagccttgctgatgattgcttgactccaggagtttgagcttgcagtgagctaggatcgcaccactgcaccctagcctggttgacagtctcaaaataaataagatatttttttaaaaagtagagccatgataactattccttttacttgaacacttagaggtcattgtagggttattaagtggcctaatttcaatatcattgtgtctcagggaatagggaggcctgagggaggggtgagagatggggaggatgttgggggggatggccagaacacacacaacatttattaagtttgctgtctcttatgggcatcattcatggtgccccaaaacagttaaaatagtaacatcaaagatcactgatcacagatcaccctaacaggtatgattatgagaaagtttgaactgttgtgagaatttccaaaatgcaacacagacatgaagtgagcacatgctgttggaaaaatggtactggtggccgggcacggtggctcacacctgtaatcccagcacttagggaggccgatatgggtggatcacgaggtcaggagatagagaccatcctggctaacacggtgaaaccccgtctctactaaaaatacaaaaaattagccgggtgcagtggcgggcgcctgtagtcccagccactcgggaggctgaggcaagagaatggcgtgaacccgggaggtggagcttgcagtgagctgagatcacgccactgcactccagcctgggcaacagagcaagactctgtctcaaaaaaaaaaaaaaaaaaaaaggtattgatacatttgcttgacacaaggttaccacaaaccttcaatttgtaaagaaaaaacaaaacaaaacaaaaatgcagtaagtatctatgaagtgtaataaaagcaaggcacaatgaaacgagtatggctgtattttttaaatgcaccaaagataactcatatacatagttattcttcggtatccatggaggacctcctgcagataccaaaatccaaggatgctcaagtccctgatataaaatggcggccaggcgcagtgactcacgcctgtaatcccagcactttgggaggcggagatgggaggatcatttgagcccaggagttcaagacaccaacctgagcaagatgtctctattaaaaaaaaaaaaaggaaaaagaaaaagatacaatgtatataacctgcacacattcttctgtatacttcgagtcatctctagattacttataatacctaatataatgtaaatactatgtaaataattgttataatgtattgtttagggaataatgacaagaaaaaagctgtacatgttaggtattttaaaaatattaaaacaaaattttctatacatggtttgttggcttcacagatgtggaacccgtggatgtggagggccagttgagctctctgtcagtgtttggtatgaaaattcttatgcctaaattcccagcaaacttaaatctgtagtgttttcagctaaggttttagataactttaatataaaaagaattttttcttttccttttttaaaaaattttaaaatttattatttatttctctttttttgagacagagtctcactctggcgcccaggctggagtgctgtggcgcaatcttggctcactgcaactttggcctcctgggttcaagcgattctcctgcctcagcctcccgagtagctgggattacaggcacctgccaccaagcccggctaatttttgtatttttagtagagatggggttttgccatattggccaggctagtcttgaactcctgatctcaagtgatctgcccacctcagcttcccaaagtgctgggattacaggtgtgattaagatagaaatatacctgtaggtgttagtgttttctcaactataaagtgttacatggctttaactagattgtcttgaccagtgatactagaatatgaaactatttgagatttgtgttttgtaagacaacattctagaatcatctacatttgtgtaaataccatatttcattaagtgtgaagttataactctttaatcagaatgacagattggagacatacacaatttatgacgttatggcttgtgctttttgcttttttgtgacacacacacacacacacacacacacacttttatatgtttagtacctaaatacaggctcttatccatgattcatagcttgcataattgtaggtttttagaaacttattctcttgacatgtattggggattttgctttgcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagacaagtttaccatctgaaaaagctggattttctttaagaggttgattataaaggtttctaaatttatcagtacctaagtaagatgtagcactttgaatatgaaatcataggtgaagacatgggtgaacttacttgcataccaagttgatacttgagtaaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatcttttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaa

SEQ ID NO: 16922 - DNA, 23051 bp, Human
tctatttcacagtgttcagctatgagaatttttttttctttttttagacagagtcttgctctgtcacccaggctggagtgccatgatgttatcatagctcactgcagcctcaatttcctgggctcaggtgatcctctcaccccagccttcagagtatctgagactacagctgcatgcaaccacacctggctaatttgtgtattttttgtagagattgggtttcatgatgttggccaggttggtcttgaactcctggagtcaaatgatcctctctccttgacctcccaaagtactggattacaggcatgagctacagtgcccagcctgagaattttttaaaagtcattttgaaattgggtttcaggttcttgcctgtattttttgaatatggtactgctctaagactggaaaatgtggaccacagatttataaatactacacaaaatactaatcctaaactatagaaatttctggacaaattttgagtaatgtgggtggttacctagctattttatgaaactgcagaattaaaggcctttatctgtaaaaataacctcatcagattgttatgattttaaaataaaaacaccttcacacctcctagaagactccaaggtgtaaatatcctctttaaatgtaccagtaagtagactaagtcctagaagagtataatttttttttttttacaaataaagtttattgtactgtttgggggatggtatatttattactgctaaaaaaattaccattttgaattgctaattggctataacaaagatcagtaatacaaatttaaaacattcataaaactgagctgaaaacatgctcccaagcctagtgggcagtaaggaatctggccaatatactgtacaacttgaacattcagttcttaagtagtttacaacatggtttagccctcttttaataataataataaaaaggtaggaatatcttgtattcctcccgctagttggatgtattaaagtgctttcacaaaactaagaccatggtgttaactcaatataaaaggttgaaaagatgttccttcttttcttcagaaagttaatgttccctctccatatttgtatttgctcaaagatgaagctttgcatctgggaagtccttgagtagagtgtctcagaaatagaaagcctggactctcaaggcttcattcctttggccaacatctttggagcctctcctttatgcaaaacacagtggccggtgccagggcagcacacaagcgtccacaggaggcaggccctgctgtgaggggccagggaagggcccaactaggagtgccaacaaccgcctaaaatacagcagggcggctgcacggttaacgtgcgtgtaattgactacagcaagaaggatgaggatctgtccataaatgccaagttccccttcccgtcgagtccgtgtcccccatgaagccccgggtctagagagctgggtctagaactcgccattccgccctgagggtgtcaagtgcagcgtggagagacctgagggggaaacaaaaaggccgagacagccgaaaggaccaagcccgcgcgacccccgaaggcgctgacgcacgtagggcggccgggcgggggtcccacaggccttcagcgccgctttttgccggggagggaagcccgcggttctgcggaccgcgccgtcgcggtcgagggtctgcgccaggctcagggtagggcgagggtgtgtcgcctcccgtgcggctaggcccggggctcgggggtggcctcgcggcgaagccccgcccccggcaccgcccctcaggcgcgcgagccgatcccgcgcgcgccaaccctttcccgggtcatcgcccctcccctcttccgggccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcggtgaggagaccgggccggggaaaggcagacatggcggggctgtgggtatcgggggagggtggtcccgtcgcccctgcggccacgtcgaaggctcgctggcgggcggcgcaccggggacaggggaggggcaggggatggaaccaggttgcatgggctccggctcggcgccagagcggggctgcgggccgcgagggcggcccgcgaggctttccgcgggaccctcggcgggcgcctgaggaaaaagacgccgcctcagggctcctgccacgtttcccacagcgcgttacattccgcctccgggtgggcgacaaccccgcggcttcccaccctctgtccacccccttcgcgtcggtgttttttctggagctccgcttgtttgctggagagtcgcgcctccgggaagccgggtcctcgaacccagggccgcccgccggggacagcggacccgcggggcaggcgcaccctggcgaggatgttgtcggggaggctgggcattgggcgccagggcccttccccttgaacttggggaaaaccgggattgcagaagttgggcgcagctcaaggcggttctttcaagagcgggtggagatgtttgatccctcctcacctacctctctcaaaaccccagcgggagagcctagcagcaggtttcgatggcttcagaaagtccaactcttagccccttggaaaattatttcccctcttcatggctttgtggcgccgctgaggtcgggccggggctcctcaccccacgggccagtcttctcgcgccctccaccttgggaacgtctatcaggagaaaaatgtgttcctagaaacgtttgcgattagcttttcgttacaagggagggaaaagtacaaaagttataaactcctgcgaggccgagcttgattctggattccctttgggttttatccacgcagccgtgagcagaggagccttgtggaacaaagtagaacttgaggagcagccgccgcggtgacgaggtcccaggatgacgtcaccgtgcgatatttaaaatgggagccttttgctctgagtgtgggtggaggacgcctacttactcaagacgcctgaggtcttcttggccctgcttgcctctggtggttcttgccctgactgtaactctccctctttcaccttttggtactcctagaatactggtgggagtgggcttatttttcagctgttcgagctatcatttcttcaaacggggaaaacaaaagtccaaatgagtcatcttgtgttacaaccaaaagcaaccactaagtggttctttccttcttttctatttttttatatgaagcagagcaaacagaaacaaatccagaactcagatatgtggcacatagttggcaaatgtaatgaatgaggagaaagatctagttaaaagattcagtacatttctttagtgtggttccttgtttgctttgctggagtggaggctaatgtagttccatcagcaaaactttcttcccaacccgtatattaaattgccttgggttttcttttccatcgtatcgtggtggaatataaacgtagctttacaaagtggaaatggcttacatttttcaggaggaggctgcacagcagtcgtggtgggctggggttatgtatacgtgtacactcgtgtgtggacccatgcccggtgcctgctagctggctgtagaaggtgaatttctcattctagggttctgggaggaagatttgtgtgccttcccctccatcaggctatctgcggctgccagcacacctctcagataactgtgtagaatttatttcacagtgaggttccttgtttgaatttgcacttggaataaaggagtcatattctgaagagagactgaaagagcagtttgagaaaagaaagctaacaatcagctttatttttttggaaatgtgggaacacaaactactgctaggttagttgtttttatgctaaacatagcagaggctgtatgtttttaatacgtaattggctcccaaaaaggtgatgttgcttactaaaggcagcatcttaataactccaggttacagcagccagatgaatgagctcactgagtagagacaacatacatcaaaacaatcttaggacaagggtttgcccttaaggattaatcaatgataaatcagatataccatttttaaagtcctttgaggcaatccaaaatgtagctaaatctctgattatttcttttagtttgtttttctgcgggtgacctgaatttccatttcttaaatatgtcctgatagatccactagtttttgtgtctcttaacttgtggataaatgtatctctcttcctgaaagagtactttcggaaagtcaatgctgaaattttttatgtagaacagttttgggatttaatttatataccatgcaattcacccatttaaaatgtacagttcaatggttttagtatattcacaaagttgtacaaccattactatagtgaaatttagtaaatatttttatcacctcaaaaagtaaccctgtacttattagcaatgctccttttcttggtttcccacttccccgtaggccactaatctgtcttctgtctatatagatttgcttattctggatatttcatatcaatggaatcgtacaatatgtggtcatttgtgactggcttctttcccttagtgtgatgtattcaaggttcacccatgttgtagcttatattagtactcattcgttttaactgctgaataatattccattacatgtatataccacagtatttgtccattccttaattggtaaacatatagattgtttttactttttagctattatgaatactgctgtgggcatttctgtgttcaaggttcacccatattgtagcttgtattagtactcattccttttcattgctgaataatattccatacgtgtgtataacacagtatttgtccattctttagttggtaaacatattgttttcactttttagctattatgaatactgctatgggcatttctgtacaaggttttggtgtggacatatgttttcatttctcttgggcaaatagaagtagaattggccgtgtcatatgataactctgtgtttaacctttctaggaactgccgaacttttctgttataaaatagctctacagttctagattttaaagtagactttttttatgttttaaagttcaaatcatttcacagaattttaaacttagattattgcagctaaatattgacacacacagtaacatctatgtcgtatcatttattatagtgcttctcttttactgataggtgtggttttattttagccaacaggagcaacgtgctatctttatggaatttcttcatgaagctaagtgataagatttttaagtagtattttataataaggcctttatggcataaagataagtagattgttctctacttcagatataagccaaagaaatacaagataaaattggaaggaggaaggggagagctgtaaaggaggtatatcttacagagcttcatcttcccagtttttatattttgtttttctgagaaaacatgttttatctttgcagggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacaggtaaaggattagattggattaagcagaggctgatcaacccctgaggtgggttcaaggccggatgattgaagggtgtgcagaccatgcctacaggtgtttcatctgcaaaatatagaactctggggtgtttgtatattttctccttactcattttaaaacaagtatttgttggcggagtggtggagtcccactgcctggacacaggaggccaatgctatggggtcaaaggagttagtcttttgtggttatagcctggctcctaacagtgcatttctgtttatcacaaatacttagggattttcacaattctagaggacccctaataacacattaatgggcatggtaggagttgaaagaagtgaatcttgcatctaaaagtaaattacatgttatatgttctttgaaaaaaaaaaaagtatggaaaaagggaactaagattatcagacacctgatatgtcgttaatacaagaataatctcatttatatatttgtggtagaagtcagtgtaactattttctagatgaatgtgactcacctgtgatccacgactagtaaataatggctctgggatttgcttttctgggagttttttttttttgtggtattgtttttgctctgtcacccagtctagagtgcagtggtataaccatagctcactgcagcctcaaactcctgggctcaagcaatcctactgcctcagactccaaagtagctaggattatagacatgtgccaacacaccaggctaatttaaaaacaaatttttttttgtatagatgggatcttgctgtgttacccaggtgagtttcaaactcctggcctcacgcgatcttctccctttgcctcccagaatgtgaggattacaggcgtgagccaccatgcctggccaaggttctgggatttgaactcaggtctacatgaccccatgttttcatgggctttctgcacaccacagtgttaccactgttttggcactgagaacgaaggtaattctcacttggagctgtcttttgtactctgctgtataaggtacatttacagcttaaagtaaagaagagcagactcctataaaacatgccctggcatgctcactgtagtatttatgtgactgctcaggaacctcagttgagaatgttctgctaaactcagctgccaaacattgtcccattttgtggatgtggccacgagaaataaaagtggaacagtgactatagtgataactacagaaatactcttttatttgtgtatattgatgtccccaaagtttcctacacaaatcaacactttgtgctttgatgtcagaaggacttcctttctgccactgggctcttgcaagtacagcactattcaaggagtctaaaaaggaggtaaacatattatttgctaatttctcatgtactgaaagtcaagtgagcttgtgttctattgacaagaagagaatcaaaatagtttattttccttttcatttttaatccaaagaggtttccagtaaattggaaaatgaattaaaatagaaatgtgcacgctaacacaggctcaagtcattttttatcttatctcttgattatcttaattttttttttgcatattttcatttccaatagagtgaacagctttcgttaagttagaactgttgaggctttttactctgatttaactgacattggatgaaggctttttggaagtgccaagccaccatactattactgaaaaaggaggcactgtcaagtaaatatttaaaggtcagacagtgtacaatttcatttccattaattctaaaaacttgagaaaaaaactgaaacgattaaattggcatgtgatcagaagtatcattactgagtcattttaaagctgtatttgaagtagaaaaaatagtgggttgttactattataaaaatgaatagaatataagattaaccaagttagtagagacttcagtctgtagaataggtggagtgttctttctcttacaaaatgtttgtaagttgaaattgtttttctgcaatataaataagatacttgtagagagcaatttggcaatattatcaagatctataaaaatattcataccttttgaacagtaagtctcccaagaatctattctagaagtataattagaaatgcagacgaacatgtatgaatatggatgtctcttacactttgtaattgcaaaaatggaaagaactaaactgtcaacattaagtaaatgatagaatatttttatgcaacttttaaaattttgtttttgaagagtagttaatggataagtagtatgtagagtgaaaaaaaatagtacaaaacatgtaaggtatgcagattttgttgaagcatagtctctgtttaagcatctatatttatatataatttgtaagcttagagcctgtatcaccttaattgtagataagaaaaacacatacatctaagatatatctttttatccttaactgcttttggtcccagagcacatgggatctttcaaattaccctatacaatattagaatctatagcataagaccatgtttttaaaaggactaagcagtattttacatactagaaaataatttttctcactttgcctttgttatattgttaatggtgacgctaagataggtacgtatatacagggttgagtattaaggaaataacttgctctttggagtctagtggcctggatttgaaccctagatccatcacttagtagctgtgtaatgttgggaagttactcaaactctctctgcctccttttttctttatgctgaggaaaaaagtatctaactcacaggatgatcatgagaattaagagttaatacatgcaaagcatttaggaaattgtccattgcataataaattttttaaaatgcttattattgttaatattattatgtagaaacacttattcctattacctgttgagaactttttcattttttaaatagaaattaaaaccaactaataatttaacttttacaaaaactttaaatagcacattagtctttatatcattgtattttacagcgtaattactattcatcaattaacttgtatttccatgttttatagttacaggtctgaggaagaggtacagtgacttaactaggcttacctgataaatactaggattagtgctgaaatccaagttctcttgattgattcttgattgtaggcagtaaatacttttccttcataggccctatttccctacttaatcagaatgcttatcatttaacagaatgcatattttttatttattaaacattccattaggtagatgtcgtataataggttaaaaaaagatgggacagaggctttattggtttagaaattttcctcacttaattttgacaactatttaaataaaagtgcttgggtaaatagaagttaaatgaaataagccaataacatgttagttaggtattttaatcataagtatatgatatgaatgaatctgtgtccttcacttatcctgtatttatagaacaattataggtaaagcaagggtgtcctcttaccactttactatctgagatataaaagcaagttaatgacagatcagaatttgtcgtaagcatttccaaataccatctgaaacattagatgaggccttttgttagagatttttttgtataggaacttggcctatagaaacttttaccttcagagttctaaaatttcgtgcaactttcatactccgtgctcatttaatgtacatgggtggtcaagtctctgggtagactgaggtagacccagtactagtgatttccttgggctcacataggtgccatctttttttcaggctgcctctgtgcctgtagttcacatttattatctgtttaggatagatatgctcctaggttctctaccagggtatttttttattactattttattactcaccttggcaagtatgaatagatattacggcgtttatgattaaattcatttaaatccattaacgtaactccactttgttgtagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtgagttctcaagtttagaggctgaactgatgaccatgctggaactaattttatgacattctgtcatgtacggcctgcctgtgtatctttatggccaggagctggtggtttaactctctcagatgtaaattttatgaaatacttttctggaggtgatgttgaaggactagttagatttctgctttatagccgaaaaaagaaactgattaggcgggggttttctagtagtgctttgccaagaagcttattgtagaccaagaagtagacacctagattccgctaggtgtctattatctttaattggtggtgcacttgtctgtcttcaaattaagaagctaatcccaaataatactggataaccacttttggtttgtttctgtttctgtttattctccctctctcctctttttttttgggacggagtttcactcttgttgcccaggctggagcgcaatggtgcattcttggctgtctgcaacctctgcctgccgggttcaagtgattctcctgcctcagcctcctgagtagctggaattacaggcgcccaccactgtgcccggctaatttttttttatatttgtagtagagatggggtttcaccatgttggccagactgctctcaaactcctgacctcgtgatccgcccgccttggcctcccaaagcgctggattacaggcgtgagccactgcgcccggcctcctcctttttgattatgtaagtgactgagtgatacttcgtggttttatttttataatggaagttatttttcacatctcctaatgaatagagttgtgaaagatcagtgctaggtatgaaatctttttgaactccacttgctcaaaaaccattatttgtggaccaggcactctcagttgtagggttttcaaaaacgaaagcaacattctgcttttaggtaattcagtttgaaattgagaagaaaagtaagcaaattacattgttatctgatttatgttagaaatgtgtacaaaatgcagtggtaggttgcacaaagtagaaagttactgcatctggtgaggagtcaggagactactgagtaggtgatacttgagctgggaggtgaaggatgagccatggttgaccaggtgacaaggtgggaaggatgttctaactagcaggaagaagatgaacagaggcatggaattcctgcaagaattttcctgtggctctgcctttaggatgtttctatttggttttgaggtacaattcacctgaccacctggcctctttattgattgtagtaaagttgctttttgaaggaaccctaactatgtactcctaaggtggtcgcagactgacctgattccagcaatgaaggtggaggtgaagacaggagagatgaattacatgattattcttccattaaattttgtcaggaccaccgcttgaggttactacctgatttgccagtggttggtgtaagtttattgcttttggaaaccagatgtaggtggtagaggtttgtgataaacattctccaatacttctttctcgggtagaaaaggagcaagctatctcaaatttaggtctgagaaaataaacatttttagattctgggactaattaaggacctgctttaggctagtttcagacttggaaaactttggccactgaacctgtgcagaagacctccatttataagaaatagctgtcaaaaagctactatattgaattgtttactttttaatttgacctgcacttagatcctagttggctcctatttaacacacagttaagttagttgtgtggtttcttaacccatgaaatgtgagaagcagcattttaaagagggttgatgagtcagacgctaccaaaaaatgtcatgtggtctgacatagaggcaaaaatgaaaaagctaaaaaatcagcacgattatgttatcacacaatcaaatagtttacgttcaatataatgatcctaaaccatcaggggaaagtttttatgtccaaggatgtttaacaagttacataattatataaacattttggacctatgtatttaaaatgcttaaaataagtctcagtacctgaacataaaaactttagttatacggacattctacttcagtagacatttcattacttgatgatgcctggtaggaaaaaactgctactttgctttcatcttattaatcttagaaaaccttttcattcagtaggcttctaatttatatgtaaatttgccaaaaattggctctgatgtgatttttttcacagctaatagaaatcacctgcgagtgtcaggtgttcattcaataacagaaccccaaaaagaaagacgtattaatcgtttagtagaggtggttgatataagttaacagaagaaaaagacattgagaaatattttttcaccaaaactggaaacatagatattttgaaaattaaagctgatctagcaagtatacaattgatcaaatatctgagaatctttaaaaataataactcattggtatactagagactaagattgtaaaaaaaaattgagatgcactgagaacattcttcatagtcttcacttactctgatagaataaaatgctgcaagagtacaaagagtgccatatagttagaaaggttatcacttcgtgatacagaatagaaaataaatcttgcctatgatgagaagttctgagaacagatgccagcttatctactcaacatattttacaactttttttttttttggtgatttctgccatcctttttttcccccaatagagtgttaaatactattgattgtttctaaataactaaattagccttgatgttttatcagtgatcattgaaaaatggaaagtttaaaagttgtccaggtgtctactaattctcctaagatatcgactgcacattgtaatgttatagtagtatagtcagcagcttctcttaccatgaagagagagccttcataccaaaatagtacaaagggaaaaatgcagaaccaaactaggtgtcaaagaaatctgagttaataatgctgatccttcaatcattagatatttgcccttggttgaggtttctgtttacaaaggcaggaatttttctcaaatttcttgcctttccatttttgaattttgattccattaatgggcaaaactgaagataggcctaagtcattgttatattagtgtcattaacacatgaattaacccttgattgtcttgaaatttgttgagtcttccaactgtggaggggacatggagtaaatgtgtattgctaaaaccttatgctaagtaaacttgaaattagagaacacaaattttatgttgtgaggaactcaattgtttaggaatttattttttgtttgttttgttttgttttagagagagggtcttgctgtgttgtccaggctggaatgcggtggcatgatcatagctcactataattgtgaactcctgggctcaagcaatcttcctgccttgaccttccaaagtactagaattatagatgtaagctaccatgtccagcttctgtttaggtattttatactacgaagagtcaccagccgtagatcaaccactatctagccagctccagcttcctcgtccagcatataggaaactaaggcctagggaaattaagtgacttgcctctggtgaccaagctagtcagtggcagagccagaatgagaaactagtctaatgccctttctaccatcccgtagcaactttttttttttttttgagacggagtctcactctgtcgcccaggctggagtgcagtggtgcgatctcagctcactgcaacctctgcctcccaggttcaagcaattctcctgcctcagcctcccgagtagctgggattacaggcgcacaccaccatgcccggctaattttttgtatttttagtagagacagggtttcaccatgttggccaggctggcctcgaacgcctgacctcatgatccacccgccttggcctcccaaagtgctgggattacaggcatgagccaccgcgcccagcccctgtagcaacttttatgaggtaaactaaaaaagaatacaaaagcgaagttatgtactatatttaagtagtatttatagtttcatttggcctataggaatggaagacagcatagctatctgaagaaatagaactcatctatgtgtgatctctgagactgctagatttccacatacattttcttttctgtttttttaattttttgttcttgtttttttgtttttttgagagacagggtctcaccatgttacccagactggtctcaaattcctgggctcaagcagtctgcccacctaggcctcctgaagtgctggaattacaggtgtaagccactgcacccagcctcatgtacattttcaaaggctttatagcagttaagccttttactttataatagataaccattctgattcagaaataatttgagacgagtgctatcttgaaatgaattaacttcagctaactattgaatcaaaagcttgacattatttctacttagagttacttatttttatcttttttcaaacttagaatcactttaattacatttctaactgtatgtgttttgtaagaaccgcttaacaatatcctttgtcctgatgctagaaattgtttgatagtgttgacactgtgcaatctatttaaatagatttgtggatttctcctatgtccactgaataaaaactcttggttttacttgagtttattacactattttcctacagttcagaatttttttttaagtaaccagcagcatatgttacatattttgacaacttaaaaaaaatcaaaaatcttcaaaaatgttttggaagaataacaagattttttcatcttaccttaaaaaaaattaagatgagaggtgagtagttatcctaggaaactctgaagtaagcaatataatttaagcaaaacctctatattcttcaacaactatcttttttctttaatctcaataactgcctcagttctcatttttgtgagtataaataacaggcccccttttttatttaattggggttaaagtcaattttataggaaatttctagttgatctgtgacttgaattactagcatatatgttacatttataagtacagctggggctgggcgtgatggctcacgcctataaacccagcactttgggaggccgaggcgggtggatcacctgaggtcaggagttcaagaccagcctggccagcatggtgaaacctcatctctactaaaaatacaaaaattagctgggcgtggtggtgggcacctgtaatcccagctacttaggaggctgaggcaggagaatcacttgaacacctgggaggtggagattgtagtgggccgagattgcacccattgcactccagcctgggcaacagagtgagactccgtctcaaaaaaaaaaaaaaaaaaatcagccagtggcgcatgcctgtaattctagcactttgggtagctgaagtgggtggatctcttgagcctaggagtttgggaccagcctcagcaacatggtgaaaccctgtctctaaaaatgtatataaattagctgagcatggtggtacactcctgtagtcccagcctcttgggaggtttgaagttggaggatcgatcacctgagcccaggaggtagagtctgcagtgagttgtgattgtgccactgcactccagcctgggcaacagagtgaaacccatctcaaaaaaataaaaatacatcagaatgttttattgtacaaccaatttcattggtacatacaaaaatgtaatcaaaacaatggactttttttgatgttttaaacaattttttttttaggaattagtagaaagaaaataagggaaagaaaatggggttatgtttatgaatacttaaatagaccagaagtagaaaactgtggtttgcttgctggcattgagctgtattaggatattaaatgtgtagggtcaagttctgtgatgattcaatctttgccttgtattgatggcatgtccagatctctttgtttttatggacattttttgctttgctgatgtgacttcaagatttgtaagtttttaattttattcttaggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccaggtaaccatgaaaacagctcagttttaaagggatgtgcagggattgccaggacctttcaggtagtcctacttggcattgcccaaggtttctgacttgagattctggataatagttcttgcctttccccatgctaagggaaagctgtttctctggcacgtaaataggcatcctgagtcattttatcaaaggtcagcttcactatacaataactaggataaatatatttcagaaaaattggcaaaaagtagaaaattcatgatggtaaaacattcctgatattttaaaatctcattcaaaagttaccacttattttttgtagtatgtaacactttgttttgtacctttgggtttaactttctattctctcccgttccatgattaaagagaaacctctctaaatttattatattataattaatattttactcaagctgaaacattgtctccctttttgctttactagttgaaaagtcatatagctagtgtgcctgcacttacagatccattcactgatttactatttatatctacataccaaagaacatttaatcgactttaaaaaattgttgaccaaacagcattcttcaacaggaaagatattttaaagtcataacaatttaaagagattttttgagttgagccttattctgtaaatgtacttattactaatttttaaaggttatctatttttacttacttgctttgattaaatgtgaaacataccaggtttgtggtaaggttgagctgaaaatgaaaatttagacctaatgagtaagaagcagaatattggagcttttagtatgataaactaaacttttaaattcagcatacatttacataatgaacattatttcagtgtaacttaatttttggtttctcatttttttctcagttgaattattcttcctagactttaggggaagattatttctgaagattatcataatttaggattctatgtatatgtgtatgtatatgtatatgtatataacatgtacctggctttatgaaacttcaaacagtacaagacagtataatagtgagaagtcctctttctccccaaccaccagtccctatgcatttccacagagacattcattaccaggtttttttttcttttttttagtatccttccagagacattccctatataaataagtaaacatagtatttgtacttcaggatcatttttaaaaaccttgccataaatatttgaggcattttttttctctgtgtgatggattatatattgcaaattaggtatattgaattttctggaattcatccaaatgtgtggcaattttacctcagaattttatttgttgttaagcaagaatgtaagtctcaaattaaattgattgctgctaattttttacaagcaaattaacctttaatttttaggatttcttttaaaattaaattgcatttattttccctcatgttgaaagactattaggataacagaaaggtatggaaattgaggtgtctcttacgtgctttttaaggaaaacatttctccttggcctaatactcattagcaaaacattttataatagagaaacactacttgtgtgaaagctagtgcaaatggcccactttgattttcttctttctagtatcttgaatctggcattgccacaagctttaaaaaagttttatcaaataaggacaacaaaatttctagcttggaatttttgttctctactgttttctaaaaggtatcccaagagaggggataaagaattattcatatcttaaaaaacgaagaaatgaagattgtgtcagttctcctgaaatagatctgtagatccaattcagtatcaatgaacatcttaaaaggtttttttctggaaagtgacaaattgattcaaaattttaaaaaaggaggatcagttggagggctcacactaattcaaagctattatatattcatcaagacagtgtggtaatggtttaaaaacatacaaatatattgatggcacaggatagagagtccagaagtagacccacatacatacagttagtcttttttctcccttttaacaaaagtgccaaagcaattcaatggggaaagtcttcaagaacttgtgctgaaacaactggatgatctgtgtaggaaaaaaaacgaacctaacttagctgacaccatacacaaaaatattgatttgagatggattgtgtacctagacataaaagataaatctctgacgcttttagaagaaaacatagggaaatataatctttattttgtgacaggcaaatatttcctctagagggtcacaaaaagtaactaataagggaaaaaaattgacaaactggacttcatcaaaattaatcatctttttgttcatcaaagaaaccattaagaaaatgggcaaaccatagactaggacaaaatattctcattacatatatctgtaaaggacttatttccagaatatactttttttaaaatcgctcacaaatcactagtaaaaggtaaatgattcaatgaaaaataatgggcatatcctgctgtaatctcaaaaaaagggcaggaggagcaaaagatgtgaataaacactttacaaaaggagttatgtgaatggcctcatttatgatcagaggaatgcagattaaatccatatgaaacactagttcttccagaactgcacaatttaaaagcctgacagcatgaaatgttagcaaggatgtgaagcagctagattcataaacttgctagtcatgtaaaatagtaccactactttggaaaactggaactttttaacgttaaatgtgtaactcttctattactcagcagttccactcctaagtattaaatatttaccaaaagaaacgaaaatatgcctataaagccttctattagaattaactgtgctgttattcattgcagcattgttttgttcgttgtgtatcattgtttttttaatagtaagagactgaaaacagcctcaatgtcccattactaggagaccatttaatttatagtcattgctatactatctagctgtagaaaaatgagaaggatctttatgtattgatatgtttctgaaatgtattattatgaaatgtaaaaagcaggatacaatccagtatacatatatatttttaaagtgtgtatagatgtggatagaatatctctaaaggtatatttaaaaaaatgtttggtgtcagttgcccttgagaagggttaagataaagaagataaagggtgagataaaaaaagagggactttccacagtttacccttttgtactttttgaattttctatcatgaatgcaatgctatacacaatataatttttttaaaaaaatcctatacttagaaatgcagatttgagatcagcaaaatcagaaatttaagaagatgtggcattctaagcagagaggtctaaaactgctgataagaacactttgaataatgtgaacctgacgtgcccacctgatttatgggataatctaaaactattattcccaaatactaaactggctacatcagaatcacctggggagctttgtcaaaatacctggcctctagttctgagattttattattgttcattagaccagtgctagggcatgaatgttttgtgtttatctttttttttttttaacttttattttaggtttagggatacacatgaaggtttgttccataggtaaacatgtgtcacagggatttgttgtacatattatttcatcacccaggtgtgaagcccagtactcaatagttatcttttctgctccttttccttctcccaccctcccctctcaaatagactccaatgtctattgtttccttctttgtgttcataagttcttatcattacctcccacttataagtgagaacatgcggtagttgattttctgtttctgcattagtttgctaaggataatggcctccagctccaatgttttgtatttaaaagcctccaagtgactcctggcttagccagctgtggaaaccactggactaaaacaagcatgtccttacaagcttccattcgttccatgttttggtcttttttggttgaagttgtttaggaagtactgtgtttgagtttattcatttctttatgcattcagaaaacattggtcacctgttatacattatacgcctattacacatgaggtttttaatgtatttagacctgacaataggagtgtcacttagatgtgatctcagtgttgtgggtaactttgtttgtctttaatgagaaatctggaacatagatgatgattttttcctttgaattaacttaatgtgttctcttccctacagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatgacaacgcgtgtttctgttgtgtgcataaaaggggaaaagaacgggtatttcccttcaatgtatttaactaaatagcaaaaacattaaacagaacgtaagaattttaaaatttcctttgaaaaatcaactattaaccatacttttcctaaaagaccacatatcagaatatgcatatgaaaagttaaaaatttgttagtggtagttattgaaaatataataaaacatcttttaactatcagtgtcactatacatagggttttttaacaaagaatttggctcgtactaattttgacatgacatctgacttacatgtctaatgccattgcataaagtagatgtgttcttacagctgctctaatctctgtgccttgtgctttttttaaaaaacatttaagtctttactagaggcctaaaataaagtcaaataatacaatacttcagattcttcagtagtccatatttatacaactgtaattccatcagtcttgtaagggtacttgaactacaaaaagaaaaaaagagatatctctataagagttttgatttttctccaaaggtaaatttttaaaaactaagatcagcaatactttttccatcaccttcatctttaaatttgcagtcttaaattatttgacttaccagaaaaatcacaacttgctaataaatcattgaatggccatggctattccacaaattattgttatttttaggaagataaattctgttgaaatacaaaactgcacaaatcataaaggtatagctcaatagtatgaaaatgtcagtttttaaagtttgcaacttcagaaaactcatttttaaaccttagagacttttctagctttaatattgtactctttaagccatacacaattttaacatctctctaaaccatatctactcttttcctgaaatctagtgactgcctattcaaacatgagcatgtttgtttattagtgtcacaagggagatgcgttttatcaattttttttaaccaaagttattgaaagaaaaaaaggaaaaaaaaattactttcagagtcatcacactgcttccttatgggtccttgagagttttgtggtgataatgacagatttgtaggtgattggcgtaaagttggaaagtttcaagtatttttatcatgaagttagcagacagaatttatttattgctttgcttatgagcaaattggtcctcatctgtaggtttttcatctgtatttaaccatgtatggaaaatactcaaaaattaaaaaaatacaaattttaaaatataactacattgcattaggtattatctagatttaaaggatgtacataggttatatgcaaatacgaagccattttatataaggcacttgagcatctgaggattttggtatccaggagggtcctggaacaaatcctccaaggatactgagggatgactatataggtttgttgggaaaatcagaagcataatagtgtaaagaaggaagtgttatttttggcacatacctagtagccagaacattccacgttactacaaaatctccttaattagttctgacgattaaatgacagggcctcttggggaaaccactagttttgaattcaactgcatacaggtagatgttattactcatagaagattctgccagtgtttcgactacccatcctccaccttgtcctgaaacttatttagagcaaaagaaagctctcataaatatggcttttccaatctattcctaatgaaataaaactgtcactcagcaactgggtcttaagttctagcaagcatggggtacaaaagtttgccaaacccttttttagtagtaattatgactctaggtgctttgttctcttaagtttgtctcccttagacaactccaaggtggctcttaaaacatgactacataatttcagcttgaaagccttatcgg

SEQ ID NO: 16923 - DNA, 390416 bp, Human
tgcttaccacagacctttaggtttaaaaataaaccctctaacagatttacattcattctcactttaagaaatacttactaatcccttttaaaccactgattctttgagttttgaagcatcacttcctgaagaacccctttccaaactcttaaatgggattacactactttttttctttacttccataacaccattttgtaaagctcatcatactttaatgccaatgagttccagagtggcagcaatcatatccctctgtgtctccagagattggcacaatacctcacacaacgtgggctctcaaaaaatatgcataaataaatgaatagtttgactttgcctcttttctgaagcaggtcatgctactgtttttcttaatttttatttgcacaggaagggtctcgctatgtttccaaggctggcctcgaactcctggttttaggtcatcttccctcctcaacatcaccaaagtgctccaatgtaagccagcacacccagccttgccgctgtttgatattctctggtcttaaaaatgctccccgaatgagacaaaatttactcttctacaatttccctctgacaatcttatttttcttagctcttctcacatatctaacactgaataaggctactttcttttaacacaagaattcttcaaatgtctgaagataaccagcatgtgctcctaattcctcttggtttcctcaatctttccacgcaaaaatgcattcctaaatccctatcagtccctcttcttatctgcagacatgttctgctttgttaactctcatcccaaagtgtccagaaccaagcctactacttgagatatgaactgactagctttccacagtggagttctaacctcccttggagaatgaacatgcattttccccaccatagggtttttagtgaaaagtatagtgtctgacaccacaaacaaaatactcagtaggtatttgttgaataatgaatgaattaattaattaatacacgaatggactttaagatatattagattccttttgcaattgtttcccactctaggctcatataacaactgtggacatacttttcatatggatttggtcagttcttcaaaatctatttaccagttaaaaaaaagagatgttaatatagacctagcaaacatatatatagaacattccccacaaaactcgaaggaaattaatccaacataatcaaatgctgatttccctagggaagtgtccttgtccttctacagagaaacagtctccaaacctacattgctaaaatagcctatctttcagtattcagacctgacagttaaaagaaatgaagaaaagtagcggcgctggaggctgcttctatctcagtggcatgtgtaaatggaagcaatttgcaagagattatcttgggtccaaataggaatgaagccactataatcttggagtactgaagctttctcattcctctcccccttcccctgttcatcatcctcgtcagagtcaaaacaggagccccggtattttccaaaatattggaggtgattttccattaaatgatgggacgagtcatagctggctgtctataagaccccctaacaggtgcacacggacattaccaagaaggcttccttgccactcacagcggacagcagaggctttctctgctcggaccaatagtttagatttgatctgtcttgagaatgcaacactcgatcgacttcccagcagcagagcgcaaagttgagggagagaaaaaagagcgtgtgtgtgtgtgtgtgtgtctgtgtgtgtgtctgtgtgtctgtgtgtgtgtgtgcgcgcgcgcgcgcgagtatcttgatcagtggggttggggcgggcagtaaataaagggtggggccagcgaggggaggaggaaagcaaagattcagagaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggtgagtgagccccaggctgcctgctcgggagacgtggtcggtcgccgcaccaacgcgggtgtagcgggtcccgggcgaggcagcgcgcggcggcgcaggagccggagctggggaaggtggaggtcagtgctcatgggaggctacacaaaaaagggggagccgcgtcactgcttccctcctggagggtgccggccttccccgggaggtacagttggcgggtttttcaatctgggctccaggaacgcgggctagagtgcggggatccaggttcgcagggaccggcacccctactctgggcaagggatcgcgagccgctgcagccacttgagttgggcgcagaaatgagctctcccagcctcctgggtgggcgtctggcagtccagatccgcagtcccggtgcctggcaacctgggctctgggcactggcaagtatgcacgaatctcaagaatagaatacagggaccactagggatgtgggaatatcctagagcctgttaccccagagcctccaagtttttatgcctaagtaagacttccacatggagtctgccaactctgacgggttccactagattggggcagagttcagatctgacttcgagctgaagattcgaagagtgagaaggacggtcagttagcaacatcagcagacacttaagtttcccacttgctccctaatttgcccgcttgcctgccactgagcaagatccagttcccagtccaggtagcttcctaggagattcagggctctgatctcgaatgagataaaaaagacaccggaaagctgaatgtgggcagcccaaagatgacaaaacgcaaggacagtggaaggggcgtggactgacagccataagtgtatagcacccaccaccaaggtttggtctgtggctgcatagggcaatttctgaactttgagggttgacacagctcttcgcctttaaaactaaacccagttattgttcgctgaatctcatttgccctcctcctttcccaacccatcgggcttcttagagtcacggtcacagagggagccacaggagaagctgtgacatcacatgggtctcttagtttctcccatcttccactttcaaccgcaagagtgaagccctgatctctgaggacttctaactccccctttccaggaactaacagaatatgccaggagcagtgccagacactggcatagtgacgcttcctgagcagttgaaattgctcagttactatactagctctgacctacaattagtcagcccctttacaaaaattcagaacatactaggttttattttttaatcactgaacatgcccactaaaagaaaaatagaaatgtgctactttgagctgcagatatcaaatactaacttttactacacacatgttttttctagactatgggtaattttaatgtgcattgtattggatagagtcttttctaaaatagtttcaaagtatttatttttttaaaaaaaaacttactactatacataactgaaatatcctttatctgagataagttctaggtttaacatcctgggtttttgggaatgcaatcaactctactcaccctggtcaaaaaaaaaaaatattctgaacaatacaaagtaactaatgagcgtgtgtgttataatttccaatacttattaacttaattggggttttgcttgtgtcttttaccttttgaaagagacaaatctagggatgctagaaatggctgtgctagccaatgttcctcatccctgtataacaaatataaggtagcattttcctttcctatatcccccacatctaaaggaactcaggaggagaagggaaaaggatgctttaagacatatttgttcacagatctcagtatttttctaagctccaagcaatcacaatcatctacgtaaaagtagttttcaaggtgaaaacaaacaacatgattcactgaccttacaaatatatgcaacaagataatgaggttttcttttttctaaatgggagccaaaatgcataaaataaaatggcatggcatggcctggtgttgtttatgtgcagtacaaatgtgttactccttctggcctggagtgtcctgtggctgacatgagcactgttgccccgtatgcacctaaggaccaatgcacgcttttaaatgagcagtttagcacactgtggaaaccagctttacctcagaggaaacctgtttctctacagtgactttcttgtgtcagtcaagtgcaatattgaatacaaaaaattaacaaaaaggggttggggactaagccaaagtttatgtgtgtgtgtatgagtgtgtgtaaggaaaaagaaaggggagttgtattctttattatatcctgtcccattcttctttccaacaaaccatcacccatccaagcaaccgaccgatcaactaaacaatcaaccaaccaataaaaagggtctctagattattaactggcatgttttttagtgacttaaaatattcaaagtaaagtatagcaaaatcgctaggcacttagtactgggtcctcatatagagaaggcactcaaatgcttgaatgaattaattactggtctacttttcttgtcaaagtgtctgcttaagcttcagctttggagaaaaggataaaagctaagataaaattcatgcatactgaatatttgagagggtattgagttcacatagacacgtgatttgagcatacactgtgaatgtctgttggaaagtttataatcttatgcaacagttaagagacagagaaggtcggtaggatagtggtgcccttaacattattactgcactcaagaagtttcccagcagcttgcatagaagagaaatatagctggttgctgggaattgtgtggagctgctggagtcattcctgcctctctgtatacaccagtgtatatcaacaaccagttagttgacatatgtaattagttggtctgtgagcttcacaatcacaaatatcttccttaattgggtggctgacttataactaatggttagaacaggatctaggtaaacttagtagacgtggcccaccaccattaattaaaaaaatattccaagtgcatatgcaattttaggacagatgtgtaatatttataataaggattgcagaaagacagataatatatttgtgtgcatcatctcaacacatacaattatagaggtcatggtgaaaataggattaagaattgagcagtgggcagccaggctttccgaagcatgttttggtgtcagaaagcataggtttgattcccacgtccgtgatttactagatacatcaatgagtgagtgagggttatttagtcttaccaggccattgctgttgcatctgataaattgaattaaaactattgcaaacctcacagtgtcattggtaagagctcaatatgaaagggctttgagtaatatctggatacatttgttttattattattattgttatgttgtttttactactttttttattatttacattttcttcctaaacagggtcttaacagttgattggtgtatctttataagacctttaatatctttaagcctaaatctcttcatctgtgaactagcagtaatcatatcagcctttcctgtttcacaagggaagatgaaatacactaatttctgtaatttgccaaaaaaccaccaaataaatatggtactattatgtagttaagtacatcacataaatagaaatattatggagatttatatgaatagtgtggaaatctatagtgacaatatcattgttcacatgcttttatttccttgagagaggtccaaatttattttatgccaatcattaccttggctggagcatcattttggatattttaacccaaagatccccaaagttccaagtaatgtttttagttgttcatatttttacataagtgtgtacagacccatgactttatttttaggcacttagttttttcatcattttaatattcattcttcattcaacaaatattatttgagttcttacttccctagcatgagccagacacacttagaaaattgcaggatgtacaacagtgaataaaatggacagcatctgccccttgaggtttgcattctggcaattgcaatctatactgctgatgtttttcatcagattttccacgtggacacattaaaatttttttcaaatactattcttgaagagtttttagttaatgttctgccactgatctattacatcagttgcatagtcaacttggaataggttctagcttccaagtgcatagagtgtggagagtggtgcatgatgccaaacctggaagaaactcagaggagagttgcctgtgtttaggaagacctctgtggctggaggtagagtcactgagagaggcacctgtgtcttcaaaatcatgttggtcctaacatgaacttgaaaactccaatgggtgctgggaaagtctaaagagaaggtatctgatagtgtgatataaaagggagtgcctgactaatattaacatgttgctgagaatgagcagatcttttcccttaacaattttacctgtgtcattcatctttgcatttaatattgattttatgggcctaatgttaacattacatagacctcaacttcagctacttttcttgtaaggtttgtgatctctggttttcattgagatagtgactttgcgtaagttcagttattactggtagaaataccagaaattgaaactagctattctggtctcaggttttgagctccttccattaaattatgccatattgtatatggacttatgtatgccaagtacacacagtataagtgtgtgttcaaacaataaataacacttactttcagtaatttagttacctggaataactaaaagcaagagttcatttctcttatatttgatttcagcttagtatacactgtatttgtcctaacatgaacttgaaaactccagtgggcgctggaaaaatctagagagaaagcatctgatagtgttacataaaagggagtgcctgactaacgttaacatgtttctgcaaatgagcagatctttcccctttcactgtgtgtactaagtggaaatcaaatataagaaattacctcttgctcttggttatccagggtaactaaattacttaaaagtgagtgtgatttatatgtgaggcaactagcaaagagaaaaactgatattatcagtggactctccagaatttctcttttgaaagggttcaaataatgcaatcaagttggagaggaagcctcactacctacctatgcctagcaaacacactgtttgttgttagagtgtacaattaactgggatgggtttagaggaaggattgatggagatggcggtggtggtaatctctcaatcctctttcgttgtttcactgataattatccatataacataggaaatatcatttatattctaaaattttccaaaagctatttagactagaggaaaagagtagtggagatctcaattctgttttgttgtttcactgataattatccatatgtcataggatatattatttatgttctaaaattttccaaaaggtatttagactagaagaaagagtaacggaggacttcagggagaaggggattcatatttccagctgcctttttctaattgactgaaactgagaagattatttaatttgttaccctccattttgttatctatagaagagaaaataataataacaaatttatagtttatcataaggatgaaatatatcacatgtaaaatgcatggcataccttcagtcttgaggaagataactctctccctctctctctctctctatgttaatgaacagggtgagagttttgtgctccacaattacctatttgagcaagtaagcatggggaaatgttcttacttgaagattcatgaggcacgtttgtatagtaaaggctttttgaaattctgcagcaaaacaaacaaacaaacactctgtttcttttgtctaacccagtgtctttcacattttaattattggaagacccttatttgaatcgtagctattaatgtcccactcaactcatgctccccagagcacacttgaggcaacatgggccagtaacaccactgcaatttcagcacacacatccaaagtcacatgaccatacatcctgcagctgcttcattctaagccagagtctgccattcccaatttcagaacattttcttaaaggtttaagattaccatgacacacggttacctatgtaaaaacctgcacatactgcccatgtacccggaacttaacataaaaatacaaattaataaaaaaaaacacttagtatggtggcagatattttgcatgcttaataaatattttttctttaaaaaaggtatacttagatgtttaatacttattgccctcttttatttagaaaatattcttaaaaccacataatctattctaaaggtttaccattttattagcataaaatttgatctggagccattttacttttctttttctcgtttttttttttacactagacttgctttttaacattgttttaaattgaaaattcatattagacttaaaatatcttttccaggaatgtaatttgtggtaaattaaaggtctatatttacaatttaacctattctttattttaaaatgcttatctgattttttaaatgacaaattttcatggcaacacaaaagcatccaaattaaaaggaatgtattccaactaaatcaactgtattaatttgttatcttgatttactactgagatcaagttgtatcaaattggaaactccctacttattatacagcactgtcactatttttccaagtaatttatttaaaataattaaattaattgtttgaaataataaagtaattagaaaaatagttaatcttggagaggaaaatttttaaaaaggaaagaagtaaaaatatttaatttataatctcagttatgaactactgaaaacattaaactctttagaataactttcccaagttacttggacaatattttacttttttcttattaaaaacttaggaatcttctaaagtacataatgaaatctaaggtaagattagtcacaaattgaaattaacaagcaatgatattgactaaataataagtaaactactggccacaaattaatctcatagaaacaccttccacagcttgaaaagattttcttttagcttttaaaaatattatttggcacatttgtcaagtagagcagttaaatttgaaagattaggccatgttgtgtcttttgattagttgccagtttactagtatcctggcaaagcaaacatacaaaataaagcaatcatacaacagcctatcaactgtattgaaaatttctacttattaatgtttcaagagaagtgtgataatgcagatttttatattagaattatgcctgtgtgttttcatttaacaaaaatccaatggttaattgttattattaccatcagttatcatcaatttggagactaagagttcactacaacttactatttccctttaaaaattcaaaaaaatattaaaacatattattttttacaccaaacgagtcaaagagcacagacaatcttaaggcaaaacacctattttatctaatgattgattaaaactcaacctatacatgggttggtacacacacacatgtatttccttgctctgtctgctgagagggcttaggaacaatgataccccagtaacaatgaacactcctggcacctagagctcctcagaaaaaatatatattattctggtgctgggaagggagatacataagatgattctggaggatcttatagtgctggaaagtaaagaaatgctcccatgagtgcatactgatatagataaatgattaaataaataagtagggagaataggcaaatctgctcagcagaagagccaggggatccaggttagcatcagcagtggtagattatgctgctagtattcacgcttgataacaggtgatgcaaagggtatgttacctatctggtcttcctccccaaagcctagagccctactctactaatgagaaaatatcagacaaattccaacagagtagcattctgcaaaatagctgaccaatattgaccaaaaccaccaaagtcatgaaaaacaaggaaaatctgaaaaactgtcacaaccaagataagcctaagaagattagtgagaaaaatgtaatgtgctatcctgaatgcaatcccgaaacagcaacaagaaaatgacattaggtaaaaaccaaggactctgaataaagactgactttacttaataataattcattaatactggtttattaattttaacgctgtaccatactaacgtaataatttcaggagaaagaagatgtggagtacatgtgaacttggtactgtattctcagtttttctgtaaacctaaagctgtgctaagaaataaagtctatattttaaaaagattcaacccatgtcaaggtttcttctgttactgtttctacctactctgcagtacataaagatctgcaactgtatcaagggaaacaaaaaggaaaaagtctcgttcattccatacaacatgctacatggagggttttctaagagtgtccttaaagacaacaatatttaatgttgaaaaaatcattgaagaaataagctttatataacagttgctaatctgatggtcatacgtcttctttagaattctgcaaggagtttgtagaaaatcagacattagttgttcctatccattagcatcttggtcttcaactattatactttttgtacttaaatataatttaccgttgaatattgatgcaagcattgtaacattctgtcagatgctttaagtgctgatgtctttaaatgaaaagtcacaggaaactattttcacagattacttttcttagcaaaattgtctaaatatgcctttaaaaatcaatacttaattcccagagggggaaaaaaacacttcataatgcagattggggaaaggatggtaaaaatcaagtgttcttactttctttcattgtgaggactcaatcataacttttaaaggttttcttttttcctaaattttaaacttctaaaatgttggattacatactttagtaatccgtaaacagatgttgcattctgatgaactggctgtgtttatactgtatgagatgttactgtactttttctcctaaaaatggattaatgagatagagccattcttcaaatctaaaggcaatatttgccttttgaattctgggtagcgctgttccttttgttcttaggaaaaatctgaaccctaaggctgtttccatgcatgtccactgagttggcaagaacctttataaatgattgtgaatcatctaaatgttcaacaggagagaatggttaagaaaataacagtataatgtcatccaggtttattcatgttgcagcaaatgacaggatttcattctgttttgtggctgaatagtattccattgtgtatatttaccacattttctttatccattcatccgctgatggacacttaggttgactctgcatcttggctactgtggataacgtggcaatgaactgaagtgcagatatctcttcaacatgcttatttcaattcccttggatatatacctagaagtgtgattgctggagcatatgataattttatttttagttttttaagcaacctacatactgttttccataatgattgtactaatttacattcctgccaacagcatgtaagagttgccttttcaccacatcctcgccagcatttgttaattttcttttcttgtcttttttgataatagccattctaaccattctaactgaggtgaggttacttaagaaataaagcattcattaaatatgatccgtaagaagaaataagcaaaaaatgcacacaaaataatatagaccatagtgtatggttttacatactttggattgggaatttatacagttcattcttgcttatacatgataactttcagttagttcatgtggaaaagggaagtttattggttttgttaagatggtagaattgtgggtgaaagttttttttcacttttattcccattaatgtgttttgtccagtttaacaacgattagttaaggataagattttgtagattctcgattattaaagcagacatttgcctgcagattgccatagtgaaaagtgcactggaatgagagtacttccacttccggtggttcttagcttggccatgtcacataacctcctagtaaatccaaccctttatcggagactagtgagtggtgagcaggtaatgggtgcgtctgctgatctccatatctgtaatcccctctgcagtatctgctttattttattgtcattgggatgaactgatatgctgcatgaagatgtgcagctgtattacatttaacatttatagccacagcatccagtgtgtggaactttgtttgtttccctgtaattaatgttaactggcacacatcaaagtgaggaccttgatgtggccccagtgggagtttcctcgctttctatttcaaatgtaaattattttgaatctattttctctcttctccctacagagataaaagacatgaaaggagaggcatttgctgtcattcctccaggacgtccactggggtgtagcttgttccactaggtcctgggtatcagcctctaatgcactgcattcactgcccaaatccctgactgagcagccccatgtggctcactctgctgctgctcatccttcaagactcagcgcattttccatctggtctctcacttagctggtgcttacccagcgcctctttggggtggaatttgtggctcacacagcaacacccactccaagtgaccttcaagtcctgctggttatctcaggctctttctgtctaagtatatcctgccttcatcttggctttcctggtggcactttgaatggccaattgtacactatggtcctccactcccagagacccacctgcctgtgggcacaggttttctccagatctaagggattttattgtcctcctaccatgactccaggtttcccaactcgaaggggaagaaagatggagctgagttcttgtattatcacatgtctatctcagccctcaggttcaagctgtaaatactgctgtggtatttaaagcaatgcttttaaaaattaaagcagcaacgaaagaagcaacaaaaacaataaactttttaaatttcagttttcggctttgcaacagaaagcctaggacatggatgtccaaccctttgaatgtgaggatgtttttgcttatctgtggtggcagatatgaaaattatgcccaaacttttttcttagctcatcaactctccttagtgttaatgtattttatgtatggcccaagacaattcatcgtcttccagtgtggcccagggaagccaaaaggttgaacaactgtggcctaggatttaggactagtgtctctgtctctttctctctatgtcgtatatatatgtatatatgtatatgtgtgtatatatatgtatatgtgtgtgtatatgtatatttttgtttgtttgtttgtttttgttttttttgagacggagtcttgctctgtcgcccaggctggagtgcagtggtgcgatcttggctcactgcaacctccacctcccgggttcaagtgattctcctgcctcagcatcctaagtagctgggactacaggcacatgccaccacgcctggctaatttttgtatttttagtagagacggggtttcaccatgttggccagggtggtctcgatctcctgacctcatgatccacctgccttggcctcccaaagtgctgggattacaggtgtgagccaccatgcccaacccatattttatatatttgtataaataatatataatataataagtgtgtatatggctgcatttattacagatttttcaatttatatatatattataagcattgcatatacatattattaagcatatttattgcatatattatacacactacagcccaaaatactgaatataaaacatatactacatagtatacataaattcacatataactatatacaaatacatatatagttgtgtattatttattataattatcctttagtttatatattacatatatatcattacacacagtacaacatatattacatatcatatataatatacgtgtattcatagataaattcatatttatataataagattccaatttgcatttttctctgtcttttacctattctacctggagacaaatcatacataaagttattattgcatttcgaataactgggcaaggcaatgtctgtgagtgctggtggtgtggagcggggaggcatcaggcccacacagaccatgccaatttgttatgcttttaggatgttctgaggctacatacaactgagtttgaaatatctgttctgcttctcatgagaatattcctctcggtcagattgaacaacagggaacacatgctatcatccaggctccaattaacctcgaaggattgatgatttgctacatctgtgggacatttgtgagaaaataggcagtatgatatcacaaataaaattccttagggaaaaacataatttcatagaaaacacaacaaaactgttataaataattgtccattattagcttagcctaaacagtatactcttcttggaataataatgataaataaattgtaaagagaaagaaatcagacccagaaatctatttgaacaagctgtagaaggcacatagacttaaatatatatgtgtatatatatataatttcttatatgtatacaaaaaactatataagatacataaataaattaacaacaatagtgttcaacacgaggcagagcctttaaagatcctaaagtccaactttttcatttcataactgagaatactaaggccccagaagcttaactgaaataaagactcagtaagcaagccacaattcttaaccttcttctcagtgctgttttcttgcaactttgtttttctcatacaactaatttgaaaggtgttaaaaatctatatttgaatgaatgagaagtagtaatcaactaacaaaattcataaaagctttagagtacaaaaagcactggactaatcactgtggtttctttaaatcagggtgcccgttgtagagaattttgagatgtgtcttaaatgagagagtgcacatgtgaaacggaggtgaggccagaggaattattattgtaaatactcaaatctagggaaattttaacatccagggaaaatatcaataaagaaatcttaacagaaatatgttaaactatacataccttgcaagttttttttttttttttagctttttatgatctaggtatttctgattaacttatcctacagttacttgagtgagcaggaatgtcttcatctctaaaagcactcttggaaaaaaataaagttagcatttacaaacgagtggtatatagcttaacaatttagaataattagagtctacggccattacaatttgtattatcctaatttaactggaaatatttaagtgagtgttatactttggttaggctaagtacatgtgcatacaagggaagaagactaaagagtggtatctgtcactcactttttgagaacgtcataaaaaatcaggaaggcagcccaccatttgggactttgagattcatagtctcactcctatatcagatgcaaaaagtgaggtggaatgtattattgatatgctacttaaaaagacaaaatcggtgaacaattcctggagagtatgctaagtttgctgtactattcctgaaggctgacctgccttttgtttcatgtgaagtaatccttcaaatcaacttctgggttttgcaaagtaacatttgagcttttcttctcccttcagactatgaagttttaatttatgtattcacaccctctctgtcatttactattcatttattcattcttatatttatagcttgtcttattctaaaaatattttaaaggcttataaaaatacatatattataatctgataaaatacattaatgaggatggaggtgaaggtgaagcaagattaaggcaggtgcgtttccctgaaaagatgccaaaagtggacgagaaaattgtatctgcggctgaattgagaagggaaacagaacaaacttcagagttgggagggtctggttgcttaaacaaattataggtttttcaggttaaaaaccatgcaagaaatttatcctgtgatcctgataaggggaaacaatgtgatgttatagatagcatacctacgatcaaatcagtggtgtgtttcatacatttgtttcttatgaaatgctcaatacaactctatgacaaggcatcacgtagtaataagaacacttctacaaaacatcttggtatggaactgtcaaatagtttggtttgatctagacttcaatttatagtatctagggaaatggatggcttgcacgtcacctcatcatcattcgtaatgattgctccttgagtctgagcttttcctgaaggagagcagcagaaagttagagggaaggggggttgtgattaaatgtgcatttctacttagagccagatccataaacattagaaggtaagaatgaggtccttctatgaaattaagaaacccaaataaggtaccttgttaaatagaagaccacctcacctctaagaggatgagacgcctggaagcagagccaatgttttactcagaaaattcttgcaaatagttttaaataatgacaagagtcactaaaaggtgaaaaaaacaaaaaaggtcgggggagaataaaattttttgagacattaagattaaataccatgtctttcaggtaaatgctaagataggtaggttgggaattgcacattgacctcatataggagcatctgtaaaccaataatgtgttcagtatagtctacccaccatggtgattgggtttcagagcagttgttcttaacctttcttacagtaaccatagaataaagctcatgatgtcatgagctcaatgcttcataactgcatatatatctgttcatcacttcatcacaacccttcttccatctaaccttctttttcttttttttcttttttttttttttgagccagtctcactgtgttgcccaggctggagtgcagtggcatgatctcggctcactgcaacgtccacctcccgggttcaagcaattctctgcctcagtctcctgagtagctgggattacaggcgcccgccaccacgcctggctaatttttgtatatttagtagagatggcgtttcaccacgttggccaggctggtcttgaactcctgacctcgtgatccactcatctcggcctcccaaagtgctgggattataggcatgagccaccgcgcccggccttaaccttctttcatatatgagtatatatctccccactgttcagataataatttccaattttttgtactcttgttttcctaagattttgtatttggtacttgcttaactatgtttttgttgttttgtttgttattagagtctactttgcatatcttggtctggtcagtaataaagcttaaatcttttctatcccctctgaacctttcagatactcctctgtaatcctaatcatctcctcttagaaaagcctattttatctaacgggactattgattacataaggctgaagggaaataactaaacgttgtttgtcagtctgtgttctgaacatcaaatttgcccacctttctttagactccatattttagagtactaccatgggcttaagatgtaagaacaagcaaacaaaacctgaaacattggcgtgtttggtttaaggttttgatctttgtctgaggttcctgaaaagatgactttaacttttgttcaatttcttgcctttttttctgagagaaaggaaacactcgttgtaactccatggtatatttcatttccaaactcacacttctctattttgagttcaaattaaagacttctgtcacatctgtaaaatgccatgctgagctacaaattgagttaatgatagcttccttctacttcatgtttattattacaatgttttactaggtttctctagttttctctctttcaaacattaatatgaatgtggtacattagatattatgcagaagtacaaattctcctttatagctgcctgagaaaagcttgcaactgacatttcgactgaaaagtaatatgcagaagtgaaaaaagaacttctctagggccttttgaaggaggacagtatcaccctacaagtcaatatgagaccatccaaattagcattatatttcataaatctatctacagcataattcatactcagtcaaaaggaaatacagcaaaattccctgtggaaagactcatttttgcataacacatacacatacacataaacacacacaaatggcatagaattgtgtaaatcagtacacaagtcctttcgggtcaaataaaaagaaagaagaagggtgattgctttctagctagtgtagacttgagaaaaccattttatgttctgcagtctggtcttatgcaccactcccatctgagattcttcctgaggaaataaaacaggttctgcaattctgtctgtatcttatctcaaaagtctgctaaaaaaagtaacttatttagaagcatacaaatgcatgacccaataaagaaaatgaagtgtaaaagggccgaggaatacaacagcaaaagctgtaagtttgaactttagtcatttttaagcaaagtaactgttttcatttatttttaaatgatcatttaagtaagtataccttttgccatacaagaattaagaaaattagttgaaagtaaagaaaaatgaaaagttcatttaggttgcttccaatatagatcataatttttttctaagattgcttctttctgagatttgtagtgtccatccaatgctgttaaataataaatcatttctgtataatgacaaaatatatgtacatttaattattaaaggctatgaagaatagaaaggtatgcagttttaagataattataaaatcagttttcttctacccacagaaattattttttaacagtgtttggcatttattgaagaaataaacaaatatatagaaaacttattttaaaaataaagatgttaatggttttattgatttacttaaaaattcagatattctttattggacataagtcatttatttgatacacaggtttatataccatatcttcactgttactccaaagtagaaggtagttatatctaatataaccattttattgatgtagaaattgaagtcagagtttatgaacagaatcagattaatggtgatcttgcatgtaacccaagagcggaaaaaggcatcttgtgaacacattgtccaacttagtagcttgcataatctagattgggataattgctaatcctttctttcatctacctttatttacaaaacaatagtatcacccagaaggactactttaggatgctatcaaaagcaaaggtaaatctacttacctgcaaaattattcttagattgtcttaaagtaatgagcacctagtacctaggaaatgcaagaagtgtattgtcaatggtaatttttaaaccaaaattttcagtttactacaactaaatttcctctagaaccttgtccaattctatttgtcaagttttagcgtacgttaatttgtatagcaatattaaagtgagcttatgtgcagagaaacaaaaccaaattcaaaagacttaattaaaaacaaagggaacctgagtgaaattttagatgttagaagtctggcctatatttttatttatttatttgattcgtgaaaactcaactttttcttgaaacttttacttgagaaccaaattcaaaagacttaattaaaaacgaagggaacctgagtgaaattctagatgttataagtctggtgtatttttttgtttgtttatttgatttatgaaaactcaacttttactacagaatgattacagattaagatacttttttaaccatgagtaaaaccattaagaatggcaacaatttgaattaataatcttagtgggccttgcaatgaggactaacatgctgaactggtcttttctactgtgaaatatattggaaaaaccttgcactagtatttcaacagcaccctttccattacacttatatattgatttgaatctgtcaaggaactcctctagaacagttgtatgcaactgcgagtcattttttttttcttccaggggacatttggcaatgtctgaggacatttctgtttgtttctactgtgggagtggtggaagctgctactggcatttagtggttagaggtcaggagtgctactagacatcatacaatgcacagggtagcctccacaacagggaactaaccagcccagaatgccaacagtgctgaggttgaattttaggttggagattatgaacacaaacctagtgcaggtttagtgtagatgctttggaaatcctgctccagaagaaaataaataaaaccatcaatcatctattctcagatggtatgaacggaagccacataccacgttagtgttttgccatgaatcaggaggactcatggcaaaacacttttgataacacttcccttgcccagtgtgtatggtgcctcttctgaaaacatgtccatctgaaacacaaaacagacactacagcaagttacaaaatcatgtatgcaaatgcacttcactcaatggctctccaagcttcatgagtatctgctataggcaggccactggatacatatgaatgagcaggatagactgtctgttttcatggagctcatggaaaggcacacggatgtgaattaaatgatcacacaaataaatatttaattctaaactacgacaaatattattaatgagagggtcatggttctatgaactcctgtaatgggaaaaaccgacaaggttaaagaaagtcaaagaaacttttgcagggtaagaagtttgtgagtttatatctgtaaaagaagtcattcctagaaactgacttcaagaaaaaggaaaggactccaactaggggaacagcatatgcagacgtccaaaggtcaaagggcatgtgtgctcagtgacaatttagctctttattaataccttttgttagactgtgtgtgtacatatagtagccctttctaataatgggaaaatgaaactattcctcaagttaaatttacaatgtagaactagttatttaaccaatagctatctcccccaaagataaaatttaaaacttctctttgaagaaatagagaaatgaagtagaatgttcttattatcccctgagagactgtgagcaaagaagcagagtaggcaatttctgggaaaaaaacattcaaaatatttctctttgcctaaatcttcattgattcttcttctattctgcctcagggagagcccttgttcctgtaatggtttttctgaacctctcccctgctcccattccttgtcaaagaacacagggaatcaaagaatgtcagccagaaatgattcaaaacttaattggtttatttacaaataaaagaaatggaggaacaaagaggtcctcactgtttaatatcaatttttaaaataagtactatcctgaagcacgttggccccttaaaagggactgtttttagcacattaaacctcttcaaaccactacgtaggtttattcaacctcatgctttgtaaaagtacagaagtcatttaaaaatatggttttaataatgaatcaaatggctgtttctataattaaatctactctgtgtagctagatagacagcaaactctgttctagcaaactcttggttctcctgtaagtcatttagggagtgctacctttgctcagtgaagagttaagacaaagaaagccttgaatatgtttctcatattcccaagctcaagaaagtataacctatcctgaacaagttatgtaggtgtgtgtttatgaaccgccctgagattcactctacttacagattgctgtaatacttcttgcagagagcctggaatacatcctctgtgtgcatagccactaatctgaaatcactcaaaccatgcttccgccaacaagagacacttttctgcagtgactatgatggatattctctgtttgcccctccagatccactcttcaccagcctcttacctccgtggacttttaggagttgcatcacaagtgtctcttgccttcaggcttcatattgcttttggccagtgcaagacaacatcagcttggaagacaggaacagcttgtggctttgagctccttgactccctttctattgatttcatgtgagatgttgtggctgagttcctcctccaagggtcttagctcattttgggtgcctctctcctaaagctgcagatgtctcagtgcctcttcttcttgaccctttacccctaggattgatacattgctggtagcttagagctgttgctaactctcagttatatcccttgccttccccttcgcctgttgtacacttatcaccttctccaaatactcttacagtcaccttctatgaatatgccatctgctctctgccagaatgctgacctagacagaggctggatgcaattggggctgaaatatctcttgacaaaacaataaaataataaagataacataagtgtgcaacttagttggtgtatcaggtattttccacaatcatttcagttaggttttctgtaatataccaatttaataatgtgatatatgcattgtttctgaacatttatttatttgctttgcttatttttctgttagttaccagagcatagtatgcttggtaaataaatattgacacacacacatttcacattattatgtgctatgaaatatgccagaaatagatgagaattggtcgttgcatttaaagattttcaatttagataaaggagatataacatatactggtgaatattgaaatattcaagagcctgattatgaacattctatacctttaaatctccgcttcatatctaagtatgtgtaagaactgggaaaattgcacagcctctcttagcatcaattttcttgtctgtaaaatgagattggttatgtctacttcgctgggcttttgaaaagattagttgagcttgtatatgaaaagcgattagtacagtgcttgggaatgtggttaatacttaagaaaagttaactgccattattaatgttactattacttcatttgcatgtaattatttgagattcataaataaatttggatttttaaaattttcttagtaattctaagtagtaactcctgtcaacattatgcccatttttgagttgagagaatttaggagtgagaataaattatataaccaggttcacatatcaagtttgtgactaaaccatcaccatttatctatcatttatccattaatctatctatttatccactcatctattagttcatctttctctatataatgcagagtttgaattaaaaataatctcttagtcaggggggcatattaaagtgtgtgtgttttaaagaaatcatatattttattttttaacagaaattaggtctgttttgtctgaatggtttgagaaggaagacatgttaaaaagtgaaaaacatgtctttggtttcactgatttaactaaaatatataaatcacatatataagatgaaatacatcagaaactatgtattttgagaacatttcaactatacagtgaaaaaatgtaaatactggcttaaaatatgtgggggtagaacctaggtttttacaattattttggggtcaagttagaaaaaaatgcttagagaccactgtcctcaacaatgacagaccaatagggttttatactcagttcaatggaaagcatttgaagagttttagattgaagaagagaacatttcaatgtaaatgctttgcaccatagtaggcttacagcaaatcactgtgggattaaattgtgtcatttcctatgatcgttctcctaacatctgaataaaaataaaggcacagcataaattgttatgtttaaaatgtcagtgatgcagagattggcattcctttctccctaatgccgtagtaaaatggcagcagaaacagtaaataccaatgtgcaaacctgaccaagaagtgagacatgcttaattattcatttctctcaatttcagtcacagggcttcatacctcatcaaattagagtaaaaagcatattttaacgtttgtctgttttgcggtgcctgtcttttgtgaaaaataaatggcaaatcaccaaaaagaatttcttcctatcttatgttaaaatccagtcttcatttggaaagtatttaggtgtgcaagcgcaagcaagccaagtgatatactgaaaacgaaatgtcttaagtcttgatgagtttgaacataatgagaaaaacatcagaagcatgttgatttcgagaaaaacacataaacgtcattactttttctggagagaattgagactgtgatgtctaataccagcttagtttgtagaatctgtgtgtgtatgtatctataatgttacataaaagatatattcatgtatgtttcatgtcatcagtaaacaaatctctgtgaatacagaagtgttatcctccttttagtatgcaactgcctgcaattatatctatttattttacaaggctgcaaaccaggaacattgggtttatgtgtattaaacccagtgatatttaagacttgaaatcataatccactttggctttctgaagtggagacagagttcttacaagagatttagtcacaataagatgaattactatcaagagaactgtttgttgctttgtctctacatagttgctgtagctattgcactgtttttattaaatagactcttttattatcgattattatctttctttccctccctccaagcccctttcagttaaatgtgtatggatggaaatttagaaggtgttatcctctatttttaaagtaaatataaggatattaaatgacttgctacatagatttcttgatgcattaatctaggttattagctttccttactaatgctgctgcttcttaaatttttttttacagaaacaggttattctctggctcccactttgagttgtaatagcaaaaataacaaaaataagctatcttttatttagtgtctattctgtgcccaggggtgtatgacattgcataaataatctcatttcattcttacaacattataatatggatattaatatactgaaacatatttttccaatcttgaacattacttttctgtgtaaatttcagtttcaagcattctgtgtaattttctaagtactgcattcatagtaatgtttcaaagaaaagaaactagataactgtaagaaaattgcaataataaacaggaaatataagaacatattttattaactcaatttgtagttcaccttggccttttacagagtagtttttgactttactaaaattatttttcagtttaggactgttaaggtgtgggcttggaatatatcatgaggttttaatgagtgttttctttctctctgaaaagagtaagacatgctagaatgttgaaaaataattttcaggatccacagataaacaaagaggggatctggattaaaccacaattttgtgctaggtttttgggctgggcacttcatatatatgacacatttaattgtcacagagccactgggggtaacactattgcatttcagaaaggttaagtaacttgcttataagcttctgtggaactgtaccatgatttaaactcaggcagagactcagatcctatggtggtgacatttgtttttatttctgttgttgttaactttacatcacaacatgttcccgcagtaaacagtgtcataggacagcagtactcacacaccaaaccagccatcctgaaatccagagaaattgttcccttcctgtgagagaaagagttagtgtttgaaactagactagcagggcagtatatgtgaaaatatactaaagcgttgtgcctattacatgataggcactcaataaataattgatgaatgattggatgaatgaattaatgatttagttgtatcaaatttaaatttaaccgctagatagttggtgtacgtttagagcaactgtgaatcttaattgcttacaaggtctggttggatatgccagatcaagttctagtgtattcagtcagctctgagcactggacacagataggctgatcctctatggttgcacataaggaaggaaggtgtgtgtttgtgtgtgtgtgtgtgtgtttctggattcatgtatatagcgtggaaaagaattaacagaatagatggattgaaaatgagcacatatacatgaagaattttctatcactaaagtcttcattaattaattgacagtcattttttgatgatacttttgggtgcatcacctatatttctttagaaattatgtaaaaaacatatttcatccttttggattctcttacaataaaaaatataaataattcaaatgaaagtggcttaacaatagggatttatttatttggcaagtaatttaaaggcagatgtgtcagtgtggtttaataatgctcccgtaacaaagaacaccctgatctcaatggcttacagccacaagggcttattttttttgcacccacaaaacactcaatacaaatttacagggtttcctacaatggggacttaaggatccaagcagatgtagactctatctcaacatggcagggaaaggatctcaaaaggttctgccccaaagtgacacacattgtgttggacaaaacaagttgtatgagcatacttgacttctagggagatgggggaagagaaatgcaatgctatcttgttcccaaaaggaaggaaactggcctgtttgtgaaacaagccaatgaataccatggttagtaggtcaggattggcatagcagctcagtcaagtcagggcttgaagttggcattgctgacatcttcatgatgactgccattgccccaagtcttaagttctcacatgactgccccataggggcaggaaggaaatggagaaggaggaagaatttctcttcatgtgccttacttcgggagctttctcggaagtcccagcagatctttccttccatcttgtcagctagcactggtcacatagtgttccctagaataattcctctcatggaggaatgaagctactaggcttggcttaaacagtggttctctactggcaatgattttgtactcccaatgccttcccagaggacattcagcaatgtgtggtggcattttttattgtcacaacttggggatgggtgctattgccatttagaaataagaggccaggtatgctgttaaatgtcctatagtatgcaggaaaactccccacaataaagaattattttacctaaactatcaatagccaagattgtgaaaacctgccataaactaaacaatatccatcccttgagcccagacacagtgtgccagaacaaaatttgaattattttagcaaaagcaaaatacaaaaaggctgttagtggtataatcagtagtgtatatcctaagtactgaatatgtattttcatttgaatgacagctatcacccataaattttatgtatatgtgtaacttgaaaaagaaaatagagaaataaagaataaaatgatatgaaaaaccaagaaaaaccaattgatattcagactgccataagatttaatcacttctgatgatgccttagttgaaagtcagggcaattctacatacaaatctacaaatatatatatatatatatatatttagtgtttctttaatttaaatctactgttttcttttgacattgtgtattctatatatctcaccttttctacactgttgtaaggatactcatatcctattccaggtctttacagttagtcttttatcatgcttaagcataagaaatgtatgttactttaaatattaaaaatggttattagattcagggactagatctggaaacagcataaagtcgtggatactttttctaccatatactctattaaaaatgctctttcttcccacttacataaaagtacataagtatatgtaagtaaaattttaaaaacagaaatatattgtgctttaacatgtgtcaagtgctttacagagttatccatttttatttcacaatagtacatcaagacaggttttcattacttcagttcatagatgaggtgatgaaaacttgaatggtgaagtcagcttccacagtcatacagctagttagtggcagagctggggctcgaacccatctttctctcaagtccatgttcttgccaaactgccagggcaacacaggtgctttggactggaattcaatgttgaaaggacaggaaaaattgctttcataaagtaacctccatatatggtgtctttctggcataaaaatatcttattaaacacccatggcatgtattaagtacgtcatgtaatgaatatgttattattaagtatgtcttgtaatgaagaatgttatttctggattcttgtgccattggctaagtgaacttgatactaattattttaaacaagtaagtatattttgaatgtaaatgtatagataagtagctattacttgatattgcctaaaataaaaccttcgggaatgaactcttcacataccctctctaagaaaatgtatcatcatcatcatctctccttttgctaatggttttcaaccaggtctcaacccctggaacaaatataccctgtgagtctacaatgaaaaatcatattgagatgtattaaaattctggataaatattttttatcacactctctatatccagggctttagaataaatataacttaatttacaaaaatgtcacaaaaatagtgctctgaattcccatataccttttgaaagaggaaagaaacccaaaaagtggctcaatagtcaaagacaggtttattttggagaataaacctgagaggggcttctggccgatttttggttaggagtgctctttcttccagactaagagtatttactgatgagagagcttggaatgtttctgtgtaggggagaagtttatggtggggttggaatgtctcttgtcagaggagaggttatcttggggctgacatctctctgatcagaggggaggttatctagcggctggcatgtctctggtcagggaggggtttggaatatttatggttggagatgttatttgtggtttatggtcatgctgaccttagcccttaggctgatgccctttggatttaggcagtttttgatcaaggggaatttataatggcagtgcttgtgcaagatggcgatgctcctgctctgtcacctttaacttaggttcaccaattgctatcattttaccatatccactttatcattttctctctttctttctctctgtgtatatgtgtgtttgtgtgtatgtgtatttcttagctgaggacatcacacccctttaattctaaatacttcagtgttatcaaagagcaagaacattcattcagcaatcacaatataatgatataaaatcagtgtgttagtctatttgagctgccataacaaatgaccatagaccaggtagctgataaacaacagaaatttatttctctcagttctagaggctgggaagtccaagatcaaggctcaggcagaaactggtgtctgggaagagcccactttctggttcatagatagtcttcttttcattgcatcttcctatgatggaggagggagggagttctctggggccccttttatgaaggcactaatctcactcattatggggctgccactctaatgacctcacctaaaccatattacctcccaaaggccccgcctaccagtaccatcccactgcgtgttagggtttcaacacatgaattttgagggaacacattcagtctatagcaatcagagtatgtaatattaatataacgatatcaactttataggttttactcagatttcctcaattatctcaataacatagtttatagcaattttctcccagtccaggatcgtggctgcatagtgtcaccatgcctctgaatcttcctcaatctgaaacagttccaaggccttcaatgattcatcgcagtaccattttgaagcataaaatcagctgttttgtagaatattattcaatgtagatgtaataaacattttgtccctatattcacaaataaatagtagttgatgacacagattctgaagtcctgttgcccggttttgccactttctctctttttgaatttgggcaagttactcaatctctctatatttagggtttttctaacacataaggtagcagtaataataaaaaagtaactcccatgtaagagtattagaaggattcactgagttagtatatgtcaagcacaatacttaacacacagaaaggcttatctgtatttattacagctgttgttattgttattattgatgactagtgcacttaatatagttttaaaataataatcaaaataatgtgaaagccatataggatattaatattctgccagtgtagacttatgataagctgttccaaactaacgaagtcagtcttgtaaaaaaaaaaatcaattgtcttctttaatcatgctttctcataggcaagagaaaaacagcattctatattacactgtagccatgacccttcaggataaatagatctgtgtaaaattactacaagcatatgaaaaacttcatgtgaaaatcagtataggatgcagtacaacatgtcctataattagttagaaagggcctacgtaagccagacatttacacatcatagccacaagaaaggttaatttttattgaattgaatatttcctagtatgaaacctgtgcctcctctagctatttagacatcaatttcctataatcccaattgaatttgctgtattacacagtatcacaaggtcaaagaaaaatctaccatgactttgtttgacaagaggagaatatcagtcattactttctctcaggttagtgaaacacttgtacattgctaatttctgcccttctcaggcctctcaaatgacagaagtcaattaaagactgtttttgctttacggagattgacttcctgagatataagtgtgaacaaggctagataggaaggatccccacgtgtttagacaaaactaagggcaaaaaacaagtttattacatgtcatggaagtttaattctgaagaatttattcgaaggtctttttaagcagtgggttggaatgtcaacatttttaaaaacttttaaaattattttaaaaattttttgtgggtacatagtaaatgtatatattcatgggatatatgacatgttttgatacaggcaatgtgaaataagcatatcacagagaatggagtttcaattccctcaagcatttatactttgagttacaaacaatgcaattactgaatgtcacctttaatggaaaaggtctattcaaggtcatcatgcttcttgagagcatattcagacgagggttcagcttgccattgtacagtattatattgtccatgtgtctgtaattaaatgtcttttaaaattattcatccctgagtcttctgagggataaaagttatactcgtcatgtaattatttcaataaagatttttaaatgatagctccatattgctgattcccagacgcccaggctctctccgcttctctgcggattccttggtaaatgcccatgtgatttttcagaaagtgatttcttgagcaccttgccaactgctcaggattttcaggattaaagaactaaaccacatctgatttgaaagtaatctgtcatttattttttttctaattattactgcttagcttaggtttcaacaatgtaaatgaaagctattttagtttgaatgtgttaaaatgtgctgagtttaagtaacacatagaaagatatcaaactcatgagtatagagttgccttatttgaagccatattttagtaacattctatttaattaaatattctattaattattttatttaatattctatttaattagtagaacataatgtaacataattacatattaatgaccagagatctctcagaaattttacttatgttttgcttgcattaactactataaaacctcacaaaggagccaataatttgattaaatattttatagggccataaagaaaaatgagatgaagcagccagtaaaatgattttcttgtttttaagtctttaaacatttatctttagggcccttaaagatccctgttaaatattatatttgccattttctgattgttagatttaaaaatttcgtggcttgatttattagagtacaaatatttttttctaaagttggatagtttgttaaataaaaatttctttgaaaatgggcatacaatgtgtaacaaacacgggaagattttaaaaataaaacataaatttattttaaaaagtgatgtgtttaaaaatattcttacaaagattttcagtactcaaaattgaaagtttacttagtttgttcatatggaaaataattcatctaccaaagccattttgcagaggaaatacttgagaggaaggaagcttttagcacttcattgaataatttatgaacagaccaacattatattagtcaaatgaaataaagtgtcactcttaaaagagaaatcttgttcattgttgaagtttctatactcatttgagtaatggaaaaatcgagttgtaattgtttatctctattaaataaatgggtgaataatactggttacctgtttacttgtaacacactagaaaaatatactttattttatattacaatgaatcacattgaccagacatcatgaaatacaaatgcctgagatgcagcttgtctcgactagtgaggtagcttgattttgaaaatgtatgttggaggcctattttgaagaatatgcctggttaatttttttgtttgcttctgtggaaggagtgagtagaaaactcctgaaggtacgctctgctgttcggcttcctttccaccgtgctgaagatttggccagctctaagaagagcaccagcaggaaattggaccaaggtagattcagccaacatgacacaggatgagatagaaaatggggattgacaaggaggaacaaggggaaaaaggtcacagtagaagatggaagatggtgaaaagtggttgatatctaggaaactgagttattagagaattagggaaattataaaaatgattattttcatatacatttctgtgtaaataaaattataagagtaagatttgcataactcaacagaaaaatttctgtttttcctctttttttcggctatagaaattggataacaaatgttaaagcttttataatgtatttttaaacccttagaacaatgtctggtgtataataagtgcccaataaatgttaattattattatatttaacaagaccaatgggaccacttgcttgaacttgtttaatttatagatgaagattctacatccctgagagatatttttaaaaatgaatagaagtcagttttcaccaaaacaatagtaaaacttaaataaaattgtagctctgtattaattttaactgtattttgttggtttttaacacagaatggactgacatagtttctaatgataaagtaagaatttaaaagttagcacgattatacactaaattgctcttttttgcacctatgttttttaattcactagcatattatggacagaatgagactcctgtaggcagtagtaccggtaaaaatgaatcttgtccttcagctttctgtttttgtcaggtttagctcttattttcattcatatagaatgccttttgattatttctttttatactaataaattttaaaaactagaaattcgtgataacttcttaattgattaaaatgcgttagctgaacttagattcttctcaatcatttctctttacaatataacttatttatgttcacagctagtaaaaataattattacaaaatacattgaaggagactgtcagactatgattcgggggacacgtctgtcacctctttgaatatattaagcatctaattattatgtaatgaatccaatacttttgtatgatctagaacattgattattttacaaaaatcttgaaattttcttggttttcttctcagtatggcacacacttgagttttcaaaatttgcaacattaaccaaaaaacaaaaagtaacaggtaaaagcattgcaatttttagggactctgaatttcatttttgatatttattcttccactgagggagattgtattgaattcttttttttttctgtaagagtagaaaaacaaaaacaaaaacaaaaaaagcagcaatgaccacattccattgatacaaatttagaggaagtgaattgaaggtgcatgctgtgtgctttgcagaaactttagatttatttgctttggcttttttttttttatttttattgattcatctcaaagagagaagcaaaagatttcaggtctgtagtaagttacttttcacgaaagccccaaattttattgtttgttcagttttaaatgcaataagcaccatatagtattgaatatgttgcaatcaaagtttaacccttcatgtagttagtcctaaggaattattttattcagaaataaaatttactaaaatggagtaaatgggagaaaacagaggaatgtgctccaaataattcaagaacatgagcctatcaaatgtgacatccagaaataaataaattttgaaaagataattggttctaaatactattttaactcttttgtcttaattttatttcccctcctgaattatccttttcttcttttctgtttgttgccttcaactatttcttaaacctcttcagcctataaaccaaaagctagatgaatagatgtaaaatgtaaagcaaacatataataaaaataaataaggcattgaatataactcagtaaacagatgaaataacaagtgtcaatctaccttaaaaaacaattaaatactgctcataatggaaaacaaaacaacttaacaatttttgaaataaaatattttatcagtatgttatatttttctgaagcttgaagtttcttagattgtaccttaaaaataattcataaagaggttttctaacatttaactggatctgtaaaggtatttgatataaaatatatagctttctcagctgtttcttttagccatgtgaggattacatttcattagaacaaagcctggttttgtagcattcagcaataagttgtagcacacaatgaaactcaaatatataaaatgagctgaaattattttccttttctaacaccttttcagtgaaattccatgccattaatgagaaaaagattgaaaaaacgaattgctgtatttcctatctagcatatttttcagctgatagtcctctatatttctttgcttcttataaaatctgcttcaaaaaaattacaccaccccaaaatgcatacacacactccaccgggcaataacagatatttaaaacaaacaaacaaacaaacaaaaaaaacaagttttgggccaggtgcggtggctcacgcctgtaatcccagcactttgggaggccgaggtcgggagatcacttgaggtcagaagttcaagtccagcctggccaacatggcaaaatcccgtctctactaaaaatacaaaaaattagccgggcgtagtggcgggcgcctgtagtcccagctacttcggaggctgaggcaggagaatggcgtgaacctgggaggcggagcttgcagtgagccgagatccctccactgcactccagcctgggcgacagagcgagactccgtctcaaaaaaaaaaaaaaaaaaaaaaaaatacaaaatttgctgggcatgatggtgcgtgtttgtaatccctgctactagggaggttgaggcacgagaatcacttgaacccaggagacggaggttgcagagagccaagattgcactgctgcactccagcctgggtggaagagtgaaactgtgtctcaaataaattaataaataatataaaaattaaaatatatataatataaaaatttttaaaaataagttttgaaaagccctttgcttgggccattttaactgtccattttatagaccttctaggacccagccttcctccttcctggtgaatctgggagaagtcagtgtaacttaatataacttgctctttaatacacaaaggggagtgctctgtgtgggtaacagacgatttcagatttgaattcccaaatactttgtcatgatcaagtaaggaaggagccaaaatttggccccactcagtcagcaaataatcatgtttctaaattgctctgagccattggctttgatccaggtttaaaatgagttggtttaaataatggcactctgaccctctgattctaaattttcagtatgtttcacactgcctaggatcatgagaccgctcggaggctcagagaggacctcgtgtggcctgataattgctgcagcacgtatagcggtgtgaccctttggaactctgaagtcagagcatgtcggttaacccagagtgtggccacatgaacgctgtgggaggcaggaggaattttgagataccctccccagagaagggccttgggtagcagtcctaacacaaaggactccactgagaagtgttgatctgttagaacagagctgggtacatgacagtgttctggctcaggtcaacacttcctggttccagcccttggtagggtgctttccatagctctgccacatgcttccggggagttcagaagggcccatcctggtccctgcacaagtacatgtttcaatcagaacagctgatcgataaaaagagactagcacatgtaaaatcattgcaaccccatgaaagtgattgcagtaggtctgagaagcgtgagtcattgagggctgaacagtcagagaacaccctgcactgatcagtctatccatttgctccataaacattgcagactcattcattctctggctggattgtgttaagctaagaacacaaaagtgagcaagactcagtccctgctcttgctgattttacacagtattcattcatacactatatagtcataatagttccaatttcagttttaaaaaaaaacaaatttaggttatttgagtccttttttttcccaaaaaaaagtgtccacaatattttgagttttctttttttaatgattattatactttaagttctgggatacatgtgcagaacgtgcagttttgttacataggtatacacatgccatggtggtttgcggcacccatcgcctgtcacctacatttggtatttcttctaatgctaaccctcccctagcatcccattccccacaggccctggtgtgtgatgttcccctccctgtgtccatgtgttctcattgttcaactcccacttatgagtgagaacatgcagtgtttgattttctgatcttgtgagagtttgctaagaatgatggtttccagcttcatccatgtccctgcaaaggaaatgaactcatccttttttatggctgcatggtattccatggtgtatatgtgccacattttcttgatccagtttatcattgatagacatttgggttggttccaagtctttgctattgtaaatagtgttgcaataaatatatgtgtgcatgtgtctttatcatagaataatttataatcctttgggtataggcccagtattgggattgctgggtcaaatggtatttctagttctagatgatcgccacactgttttccacaatggttgaactaatttacacttccaccaacagtataaaagcgtttctatttttccacaacctctccagcatctgttgtttcctgactttttaatgatcaccattctaattggtgtgagatggtatctcattgtggttttgatttgcatttctctaatgaccagtggtgatgagcattttttcatgtctgttggctgcataaatgtcttcttttgagaagtttctgttcatattctttgaccattttttgatgaggttgtttgctttttttcttgtaaatttgtttaagttctttgtagattctggatattagccctttgtcagatggatagattgaaaaaattttctcccattctgtaagttgcctgttcactctgatgataatttcttttgctgtgcagaagctctttagtttaattagatcccatttgtcaattttggcttttgttgccatcacttttggtgttttagacatgaagtctttgcccatgcttatatcctgaatgatactgcccaggttttcttctaggatttgtatggtcctaggtcttatgtttaagtctttgatccatctagagttaatttttgcataaggtgtaaggaaggggtccagtttcagttttctgcatatggctagccagttttcccaatatcatttattaaataggaaatcttttccccattgcttgtatgtgtcaggtttgtcaaagatcagatggttgtatatgtgtggtgttatttctgaggcctccattctgttccattggtctatatatctgttttggtaccagtaccatactgttttggttactgtagccttgtagtgtagtttgaagtcaggtagtgtgatgcctccagctttgttcttcttgcccaggattgtcttggctatgtgggcccttttttggttccatatgaagtttaaagtagttttttccatttccagtggtagcttgatggggatagcattgagtctataaattactttggacagtaaggccattttcacgatattgattcttcctatccatgagcatggaatgtttctccatttgtttgtgtcctctcttatttacttcagtagtggtttgtagttctccttgaagaggtccttcacatctcttgtaagttgtattcctaggtatttgattcttttagtagcaattgtgaatgagagttcactcatgatttggctctctgtctgttattggtgtataagaatgcttgtgatttttgcacattgattttgtatcctgagactttgccaaagttgctcatcagcttaaggagaatttgggctgagatgatggggttttctaaatataaaatcatgtcatctgcaaacagagacaatttgacttcctctcttcctgtttgaatacgctttattgctttctcttgcctgattgccctggccagaacttccaatactacgctgaataggagtggtaagagaggacatccttgtcttatgccggttttcaaaggaaatgcttccaggttttgcccattcagtatgacattggctgtgagtttgtcataaatagctctcagtattttgagatacattccaccaacacctagtttattgagagtttttagcatgaaaggctgttgaattttgtcaaaggctttttctgcatctattgagataatcatgtggtttttgtctttggatctgtttatgtgatgggttacatttattaatttgtgtatgttgaaccagccttgcatcctagggatgaagctgacttattgtggtggataagctttttgatgtgctgctggattggtttgccagtattttattgaggatttttgcatcgatgttcatcagggttattggcctaaaattctccttttttttcttgtgtctctgccaggctttggtatcagaatgatgctggcctcataaaatgagtttgggaggattccctcttttttctattgattggaatagtttcagaaggaatggtaccagctcctctttgaacttctggtagaattcggctgtgaatccgtcttgtcctggactttttttggttggtaggctattaattattggctcaatttcagaatctgttattggccttttcagagattcaacttcttcctggtttagtcttgggagggtgtatgtgtccaggaatttatccatttcttctagatttttctggtttatttgtgtagaggtgtttatagtattctctggtggtagtttgtatttctgtgggatcggtggtgatatcccctttatcattttttattgcatctatttgattttcctctcttttcttcattagttttgctagcagtccatctattttgttgatcttttcaaaaaaccagctgctggattggttgattttttgaagggtattttgtgtctctatttccttcagttctgctctgatcttagttatttcttgtcttctgctagcttttgtatttgtttgctcttgcttctctagttttttaattgtgatgttaagatgtcaattttagatctctcctgctttgtcctgctttctcttgtggggatttagtgctataaatttccctctacacactgctttaaatgtgtcccagagattctggtacgttgtgtctttgttctcattggtttcaaagaacatctttatttctgccttcatttctttatttacccagtagtcattcaggagcaggttgttcggtttccatgtagttatgtggttttgagtgagtttcttaatcctgagttctaatttgattgcactgtggtctgagagacagtttgttgtgatttctgttcttttacatttgctgaggagtgctttgctttcaattacgtggtcaattttagaataagtgtgatgtggtgctgagaagaatatatattttgctgatttggggtagagggttctgtagatgtctattaggtctgcttggtccagagctgagttcaagtcctggatatccttgttaattttctgtctcgttgctctgtctaatattgacagtggagtgttaaagtctcccattattattgtgtgggagtctaagtctctttgtatgtctctaagaacttgctttatgaaactgggtgctcctgtattgggtgcatatatatttagggtagttagctcttattgaatagatccctttaccattatgtaatggccttgtctcttttgatctttgttggtttagagtctgttttatcagagaccaggattgcaacccttgcttttttttttttttttttttttttttttgctttccatttgtttggtagatcttccttcatccctttatttcaagcctatgtgtgtctttgcaagtgagatgggtctcctgaatacagcacaccaatgggtcttgactgtttatccaatttgccagtctgtgtcttttaattggggcatttagcccatttacatttaaggttaatattcttatgtgtgaatttgatcctgtcattatgatgctagctggttattttgcccattaattgatgcagtttcttcatagcattgatggtctttacaatttggcatgtttttgcagtggctggtaccagttgttcctttccatatttagtgcttccttcaggagctctttttctttttattttctttttttttttttttgagacagagtctcataaggcaggcctggtggtgacaaaatctctcagcatttgccactttgagttttccttacatagaaaatgtatttatcatgtgttttctgtacccagcacagtgcttaatacatagaaggtagttaaggaatctttgctaactaaaggaatcagtgtgtttttgtactgaatatgtaataagcatttagttgggcatgtgtctgagacatttgggaaggtaattcttcctcagcatgacctgacgatttctgtcccatctcagttcaactgagtaagtccatctgcatcattttcttctacttcagtctggggcagccctggcacaaggagcatagagtacatgccaccaagatgtccccaaatcctccctctggtcacctgaaaatgacatctctataatcagtccccttgaggttattctctaaattttgtcctaagagattaaaaatagaactagattatcagctctgggagtggtttataaatatgtttattaagtaatagcaaaacataccaaaaaaaaaaaaaggtaaagcagcatgccttatcactctatagatactatacttccttacatgactatgacaagagactgatcaggacagcaaggcaagaatgaaaagacgcatgaaaaactttgaaggactggatttaaaacatccattaggccagtcagacaaacctgcataggcatggaaggcagcaataatagccaagcttagaaaggattattgtacaaaagtgtatcaggaaatcctaggtgctccaggactgcatacttactcgaagctaaactgtagtaggtcttaaaaaacaatcaaaagtaacaaaaagccctgaatgacctcagacctaatcacaaatttaggtgttgttaatgctagtccttcagagtaatttcaggacactttgagcaatattgtatatatttagctgatttcaaaatttaattctcatttcaatttggtaaatcatttaaaaagaaggccagttaaaaactgacttttagagaaagcccagatatgttgtattacaataagaatatgaaaaaagccattagattatataagtagatgttttcacaattttttttttttgagacggagtttcactcttgttgcccaggctggagtgcaatgacgtgatctcggctcactgcaacctccacctcccaggttcaagcgattctcctgccttagcctcccgaatctcattgccaactattatgttaattgaaatatataaaatctactttgaatacttatttgtgtactcaaaatacctttgcctgctaatgtgcaatttcatatgcattttttctcataaaattctataagaaaagtatgctatcagcatgatttctgaatccactaaaaagcacactatattaaagaactattaattgtctttttgttaagaagcctaattattgcatatggtctaataacccagcaggtatgctatctttttaggtacgaaaccaaacatactaatttttaaagcaacggggagatctttttccagatggaatcttctactttggtttcaggtaactagattgtcctctcatagtctaagaccaagcttattagtcagtgtctctggcatgacttactggatgcattagggctgaactaaccccctcacctgacctgtgcccatagaaccttttgccctgtcatcccttctgtcagcctttcctggtgtatttcctcacccacaatgttaggaggggacttgttcccagactgtgtcgagggcatcgtagcacttaggaatgttggctgagtgaattgcaccacaatatcagcttcatggggcagggacttttgttctgctgtttgcagctggtagaataaaggtatctgctgcagaaacaagtaatttaaagtataattaggtctttaggaaagaaaaggggaaaattctattaataccaggattcttgtgatattcacccaagaacagattattagaacatgtatgagtggtagaattaagactcagtaggcgaagaagctaaagacatgaaatttaactcggcctggtaactagggcaagttactttaatccttctgatcatgtttcctcatctctaaaatataactgcaaatatttctcctcctcctggctttacacaattgttcaagtctataagataagatatggcagttttattcaaatatatgtcaaaatgactttgtcagtcttgttttatatacttggcccaatcacatatatcatttgtgcttcagaacagctacaatgaagtgggaattattatgcttgtgctttacagctaaagattctaaaaatcagagattaaataacttgcccatggtttatggctgcctgtggcagaacccagattataacccaaagcttttaagatgtcacattaattcactccaagtcctggactaacgttattttttataacctggactcaaattacttctgcagcttttcaaatttgttttgggtttaacatgaatgtaaaattttctaataataaagctaaatcattattgaaattgattaagcaatgaagtgagaaacaagggtaactaattatgtgcaaagtgagcctgacctatagaggaaaatacatgtttgaaggaaagatcgctaccaatttcttcattttctccaattccccttagttatataattgaattctctgccatgcttttcaagattttaagataatatttcaacgtcaggatcattccatgtcaatttcatttgcaggcatgctttactgtcaggatcaatggttctttgtaatttcaacttgaaattcactctgcctcttggtaccacctgccaccgaactagctaagcttggttttgacacagttcccactttctaagtcattaataacactttggaaataccttcatacttgctacaaatcactcagacaaaggcatgaaaaattatcaggtcgagattgtgtgtatgtgcacacacacatgcacacaggactatatgaagtattgtgtaatctgattgttttaaatccgcttctcattcattgtaaggaaatttgagttttttaggttaagggggtaaaagattttgccttttgcctcaccttttggaacccacagactcagaggctgcaagagctacaaagtgcccttgacaataagctcctttctaaaaatgaggggagtttggatggggtgaggtggggttgctcacgtttacagagccactgtgctgagtccactctgcttccagcctctctccagctctgtagtgttgattccgaggcagccaccacatcaccaatagtgacccaagtagctaatctttacatagaattggtcagttcattcattcttttatctcttaggcttcctctgtagtagaagtcataagatagtgaatacagtgtatttcctgacttctaaagatcctgcaaaatattagcaaaattcacaaccttaacagctactatgtgacagatatgtgttatatgtcagatactgtgataagcaatgtatatataaaattcattcattcaaaatacattttttgagtgcctatatattctgggcattgtcctagatactggggatatggcagggaacaagacagacaaaattccccatcttcaaagaacttgttttcctttttggtacacaaacaaaaataagtaaaatatgtagcatattaagttgcaataaatgctaaggggaaagaatgaagcagagaaggaaaatattgcagtgtgatactgaaattttacctagggtacccaggggaaaagctcacgagaaattgagtttttaattgcatttcaaatgacaaaactacatcaaaagcaataatgtatcaggagaacagtttgcacacaattcgcctcactgatacaacttccctttggagtgtatttgcttccagcctttgtcaatatgcatgcaggtgttccatattagactcagcagcattttcttctctattgtagctataggatagaatatcagtttagtgaaaatatttggaaaaaagcgagggagatagccatgcaggtagttgtggggagggcactctgggtagaaaatatgtgccttggttatttcagggacaacacagaggtcagtgtggctggagcaaaggaaacaaggagaggagatgaaagtgctacactgagtatgatgagaagtcagtggaagccttcaaaccttcacattatctactgtcctctgaatttcacgtatgtgaaaacccgaggctaagagaaggtaaactgctttccccagatcattcagctaagtggcaaagctgaaatttcaaaatcttatacgtctgattccaaaatccatactaatgatgatactgtcctgcatgtattaaaggaagaccaatatgaagacctgaatacactgcaacaagtgctatagacaaagtaaaatcaactgctgcgtgaatgttcattacatctgggaggatgtggcaagatttcttggaggagttactgttcaccttggatcttttcgagagacatggatgggctaagggcattccagacacatggtcaagaaaaatatcccttttgattttgtaaccattaaaaaatctttatgtacaaattgctttaatattcttgtagttgttgtttgcctgttttttctttcaaaaaggcattacaaagggggaaagtgcaatgaactgtgagttaaaaggtgtgattctcaaggattttgacgagatctccctatccacatgcctcctagacattccttcatttgatccgcaggttcgttgaactagacatgcccagaaatacactcattctcttcatctgtgaacctacccctgggttttcactcccagtgaatgttaccatcatccactgagttgaccacacttgaaatctcaaggtcattctagattagttctttttgcctccaagtcagcctctaactccaaggcttgtcaatattcttacttaaatatctgttgaacccatcccttttctgagccccctgccaccaccactattagatccgtatcaattctcatggattaaggaggaaaaagcatcttaattgaatatttgcttgcagtcttttccattcatttgttcattctaaacatattaaatggctacttatagatattatgacagatgttgggaatagaaagccagatgactgccttcaaggaatttaccatctgtcaggagaaggggaaatagccaagttaaacaggtgaatatgttgcagtatccatatactcaaacagaagtggatccagggggcactcatcaatttttggcaaagagaacctaatcaggccatcccgccgattaaaatcttttaattgcatctcattgctttcaggctaaagtgcacatagttgagcagtgtgtttataaggcctgtgatggttgatactgaatgtcaacttcattggattgaaggacgcaaagtattgtttctgggcatgtctgtgtgggtgtcgccaaaggagattaacatttgagtcagcgaactaggaaaggcagacctatcctcggtctgggtgggcaccatctaatcagctgccagtgcagctagaataaagcaggcaggagaagacagaagaacagacttgctgagtcttctggccttcatccttctcccatgctggatgcttcctgcccttgaacatcagactccaatttcttcagcttttggactcttggactgataccagtggttttccaggggctcttgggcctttgactacagattgaaggctgtactgttggcttccctacttttgaggttttgggacttgggctgatccaccactggcttcctcgttcctcaacttgcagatggtctctcgtgggactttaccttatgatcatgagagtcaattctccttaataaactccatctcatatatacatatatccaattagttctgtccctctagagaaccctgactaatacaaggcccttcttcatcaatccactttgtaactacccagccctacctctcactattcctcatgtgcaacctacaaccagcggtacaaaacaaccaccgactgttggattttctctaacctagcacctgccctctgttttgctgatttattctctgttctgcaggctcccaacacacacgcactaatgcttcacctccctgaagggtttgctgaccactcctgccacctctcaagtgactctccaatgactctcctgtaatgactggatcctgattcactcaggcctctttgagctctaggagagatggggcaacctccatgctagtacttatcacactgaattgtagttgttactttccttacatcatctgcctagactctgaattcttgagggaaggagctgtgtctttctctctgtatattctacatcaattcagtgcccaacacgcaagcggtactaaccaaaagcaatgagagtaatgacaataacagccctacatatagtgagcatttatccaggctgtttgctgaaggttaagtctggtaaaacatacaaatatattttctcatttaaatgctatataaatatagattatacataccccacattacaaaagaaggaactgaggcacagagggattaggcagcttttccaagttttcattgcttgtgagtagtagagttgggtattaaacccaagcagtctggctccagattgtacaccattagctaccacactatagtgatttgaaaaagaatgttttattcatagtataataactattgcaccatacttatctctattttgtagatgaagaaaccgagaaaatcaaatgccttttctaaggttacccagataataaataaaaaaccaggattcaaacctaagatgaatctgactccagagcttgtgctaaaagaatgaatgaatgtgtgaatgaaatcacttcatctcttaaagtctcaatttcctagtttgaaaagtaaaacagttagacaagataatctttaaatttccatccaatttcaacaactgtattattttatattataataaaagtaggaactataggcgtgtgtcaccatgcccagctaattgtatcttcagttgaggtggggtttctccatgttagctcatgctggtctcgaactcctgacctcgggtgatccacccgcctaagcctcccaaagtgctgggattacaggcataagccactgtgtccggccaaatttaaattccctcagaatgttttggaggtgcttcaataacaaaacaaaacaaaaaatactttgctggagttcacatacaaatatgatacactaaatagcacaaaaaagattacatttcaagcaaaaagaaaaaggaagagcttctgtcatcacgtaactcatcctgatttctctaagggcatagagacctaagggcttaagggagcctggagaccattgctccagcttgtggatcctgtcccaatagcgtttcttcatcttgggtcggtccactgacatcagcaactgatatggggtgggtacggctgtgccagccttccaggcagccagctgccctggcctgccaatccattcttcacccagcagcagcactcatcactgctgttgttttagtcacatcaatcactttcccaattcagctttgtatcaaatccaagctcccaattataggtttcaaattcctctcccaattattcttccctccgcgtaaatagaaacatctcctcactgcctgcttttgacactgctctagtgaacatgcttgttccaaggattcacatgccacctccttcctttacctcctagcttctcaaaggtgttgctttctgcttacaaaactactcaaagtcacttcctctggctagcttttccaaaccaacaactccagactttggtatttctagtctctttagtatctactgagaggttactaatacaggacacacatcttacaccaggttactctcattgcctaatggaaagcctgtgactgaggcagaaggaatcactctgagttgcagctctgcaaattattcccgcatcacctttattcatctataaagatggaaatattattaatgcaaagtcctttcattatgagaatcaaatacactttaattcattcatttactaattaatgctcagattgagtacctacgatatgtagacactgctgtataacaagatatgtgttcagtagatgaaattaacaatctctttgtgtgtggacaatcaaaactgtatttgtacattttcctcatttaactttagatgtttcaatattaatcatagtttttaatacttagtatataaatttttttaacagtagagaataatcatcaactgaaaaaatttttatattttccatttcaaaagaaataataaaacccttttttccctatacctaacctcccatttacactcaaccatctgaaggatctgatatggtaaagatcaaacaggtgttctaacgttccgacaagctcaatgcttgcaaattctgccaaaatctactgttttatagtaagaacagatggtcacagatgagcattgcttcagctattgatgatgttgaagacaaatctttatcacagaaagggaaggaatggaatttttagacataaccattttctagatgtagaatgcattatgcacgccacacaggctatcattgtgattataatggaatgaaatccaaatgtaaaagcatgttgataaagtacttggctgccttcctacacagggtatagactcattcccttctccacgtttgaatcataacataaaaatattttatgtatgatatttgcgtgagattctcgatgatactgaatgatcggattcctgctagagatatttcactttttatgacagataagtgtttggcattttctttggcttttccacacaagggatgatcaaacagaatgaaagaagaatgagtcttatcaaatatcaaaatgatctaaaaatgactagtttcattctgacagaacttgtatcttaatgtaccaaatagtccactgaggcatgaacattcaattaagttttgaattaaatatcaaaaaaagatgttatatcagagattttgtgtggctcagtttaagatattctagtctcctcagtattagctaatagcttcttgatacagataatttataggtgatggtgatctatgacacatacaaaaaacagaccaactggtttctttgattttctttttctggcacttcattatataaatgggctctgtttatctccaacttttccatgccactttgtgtaacaagggcatctttttacagtcttatgtgtttatgagtgtgcgtgtctatgtatgtgtgtttctctgtatgtgtcacttatattgggttcctgccaagtagtctttgctataaatttctggagaacctgatgactttgaccagattggcacttcctgttaaaatactgaagtcttaattctgaagcatttcagaaacatttcattgtgttctttaattatactagtattatacaacatgtgttattatatcttcagaatggaagacagatctacaactgtacttacaattacacagacttcaaaaatgtgggcctgatttctgctggttgagggagtcattattggatgatttcttgattccttgagtattgatgaagagactgcacaatgagctttaggcagaaaattcaaaaacttaaagtcccagcagaaagcaaaactaaagcacttgaaaagaagtttctgccaaaaatcctttaagaaaattcaaagtaagtgaaaaattgatttattttacatattgattttctgtattaggtagtttctatatgcacttaaactggattgtgatttgtaaaaagaagtttatcagttaagcttgagaaacatagtttgtaattaatctagagcctatggtgtgtaggacactgaggaaaatcagaatattttgtgaattttgaagtctaattggggaggtaaataatgcataaaaatatttatgattaaacattaaagtataattcagacaaacagtatcacatgacttattgtcaaatgacagataaatcttgaatttagggtagatacaattactctgtcccaggagatctagacattttcacagataagggttgcatcggtgtttcagaacaactctacaaaggacacagttattcaaaataaatattattaatttttataattaaaacttagatgtataagaaacttatacttagctttatcttccttctttatggataattctatttaatacatttaaaagttacttaaaatacaggatgccaaaatataaagtaaattagtctttaactcacttatttgctctttgctgaaacacactattttaaactgaagaagaggagatagcacaagccacagaaaattagagatggtttctaaaatatgagatgattttccttactgggcagtaatttagatcctgtaatgtatgttacaaagattttgtaggatgaataaaagatttatagggtgcaatgtcatttaatatcatactgtcaaatgcctatagtgtagcaggatatttactggaatagaagaacaagaggtggaggagaaaaaaaaaagaaggagaaggaaaaaattgaaacgcaaaatgttcagggatcagtacaattatagattttccttgtgattctggatttatcctggatggagtgaaccacagtaggagtatttactcttgacttataattaaaggtttcccatatcttttaaaagaactcggagaatggaaagaaggacaaatatgttctccaccttttttatgttaaaaatgtgtataaatataacctttaagaaaaaatacttaacatatattactctcattgtattctaactttcccatttttattaccttgtccatgcattttattcagttcagtcattatctaaaatttatttggtattctgttgtcaaaaatgtctggtatactttttaaagagttgacctactttgtttcaagtaagaagattttagaagtccaatttccatattctaagaggtccctgcaaaggtttttgcccttgagaagtcaacttcctcatagctattttgagaagaagaaactttaacagatttggtgcagaagatttcaggagaaagttacaaaaaaacaggatggaatattttgtgttgccatttataaaaagggaaacctttccatgatggaaggccaggacaaccacctgttcttcaaaagatagtggggagggggaaaaaaaaactcctctaatctaaaacgccatcatagtggagaccagatggtggatttctttggtgagtacagctatctggcctttaaaacctgcttcattgttgttacaagtgtgtataaaaaggcttcaggctgttgcaatgctgcacatcagttgtcaattattgcatagttgactgttattggatttagaaatatttgtggcatttgttagctgttgagtcacagctttcagaaatagactagtctgtaataaaaccttaagaagggaggggctaggccgggtgaatggctcacacctgtaagtggttcccaacagtttgggaggctgagatgggtggatttcttgagcctaggagtttgagaacagcctggtcaatatggcaaaacaccatctgtacaaaaaagtacaaaaattagctgggcatggtggcatacatctgtagtcccagctactgaggaggcctaggggtgaggatctcttgaacccaggaggtcaaggctgcagtgagctgtgatcatgccactgcactccagccttagtgacagaggagaaactctgtctcaaaaataggaaggaaggaaggaaggaaagaaagaaggaaggaaggaaggagagagagagagagagagagagagagaaagaaagagaaagaaagaaagaaagaaagaaagaaagaaagaaagaaagaaagaaagaaagaaagaaagaaaggagggagggagggagggaggggctataaaatggagacaaggaggcaaggagtgcaggcttctccctcattgatgttcttcctagtcctttgaggttgttgggggaagcaggcccctcatttctagcttttggggagttggtttttaccatagttcacctgatacttctagttgccaatctagtatttattctaccctttttcctgcagacagaaagacagaaccctgattttgtttgggaaagcattatccctagctctggagggatactcattttcccagtctcccttggattggccatagtgtacagctctgggcaatgagatataagcatactggaaatttcttccacattccccttctcctgctgtgaacatagatatgatttctggaacagctgcatgagataacaagcctaaggaaaaaaaatgccaacacactgaggaaggaagagggaaaagattatagtaacttaggtccaggctggcattactgaacagctggacccaagcaagcaaccccttacctctgactttcttattatatgagaaaaaattgcctgaaatgtgtacaagacacctggtggttatgtatgttgttatcagtagtctagcacagttctgatacccttgcaatggtagatagaggtgtgctaacatgattgctcaatatcttgatctacccatgtctgacatcaccaggtgactacttaatggaagcaaaggctgtgatgagtccctcagaagagctcaatgtttcctctaaataactcagattgaagtggaatatgggagtcagatttattgacttgacctggattgttaggttagaacttctgtacccccatattcttccaaagaagtaagtgacacttatttcatgtgaattaaattttaaaatgcctaaaatttttgggatgcaacaaaaatgtgcagtgtaggcaatgactttgtagtctgaaaactcataacactctagctcattcagtgtcatgaaagagttaatgtaaccttcaaagttgtctgatttagaatgaaagtagtttcagctagtcagataatcttcctcgatacttataaaaccaccatacaattagtataagttgacatgcctatggtgaataaagtaaatgagaagaaagactaaaggaattttaatgagctatgccttaatcatccccccaaataaatctaataaggtgtctctctttaactttcactgatgttttttcttcccctaattgttccagctacctatgtgtggatatgtacatttctctttgaaaaaggcttagttgccatttctctcataactcacagttcttctcctttgtttctgagtctatgagcacctaccaggatttatgtttacggatgcactccgatatttggctgtcaaatttgcctagagttctattaacctggtgataagaaaggatataataagccaggcaacagagttgaaaggatccattgtaagtaggaaaagaaaagccaaaaaagcaagtgtttggggtcttttgaacttacccttaaagttattgtacacacaacaagatactttttttttaagtacgaagttgtaattccctacagtgtcttgtacatagaatagaagtcattcaatagaaaacaagtgaatgcccttctcctccatctttataataagtgtgttggaatgcttttcttcctgacagaagtgtgctggtgggccttccagtggtagccaacacaatgaacacactgcagtgtcagcccagttctatatcttcaaaactgttccaatattggtattcctggaaaatatgtgcaaagaacagaacaaagtcagcctgaaaaagaggtgaaaggagtgaggcaaaagagagcatagactttatatttttttctctggatgaaagcaaaatgcattaatattagttatgatcccttggaactcacaggcattttctgtttcaactcaagttctgttcagctaatctcatgttataagtaaagatttgtttcttttaagtatccagcatccatttgactcttgtgtcatttgggaggaaagtgccttgtttattgagcattttgctggtcagcctgaaacattggcaataacacattctaaatctataggaagagtgtttcataaaaaggactagattgacatcaaataggccatgagggattcatacattgatcttcccctgatgtttcctctgaattagctaagacagctagactaacaatggttctaatgggaaagataaagaagaccaaatggtggagaagcagcaatttaaacgtttaattctgattttcctgtttatatcagttataaatttagataattggaggtattcaaaggagaacagctctgaatgcttttgatggtttatggcaggtcattcacctcctaagttttattgcttaacatgagatggcacagcagtcctccttgttagaaaaatgttgctgacagtgatgggcatttacagcaggcagtcatcagtacattaactcatgtaatcattgatgctatgatagaaattttggcagtatttgtcactcattctaccttttcattaatgtttcctttgaagcaagttttctaagacaatatctttcactaaaattctaaatggcaaataggtgctgtatttaatcaagggctaaattctattccttcactcccaccaattctatatcacaagatttttttgcagatctctaggaaggaatttatttttcttacgttaagaaaaaataattccatccatctgagtcccactgtaaaccaactacagctaggtcagggttgtggtatgagaagagaacttttaatatgcctatatttagttaaaaaccatctagcaaaggcttagaagaagaagttgaagactatttaaccatacaacgtccattgccctgacatgaaactctgacatacatatgaacattcatgaaagcaaatccacggtcaacacaataaataccctgatttgatcattatacaatatatgtatgtattgaaacatcacattatcacatttttgctcaataaatatgcataattacaatgtgtccattaaaaagtagtttttaaaatgcagctcattctcatttactcaaggagacctaaaatatggagatttttccaataatgaaaataatattgaaatgtttcatttgggattagaatcttttatggaacagttttgagcaacatcgtcaccaagtgaaccagtatctgtgtgatttgggaactttttctggatagctctgtgggtgaacactggatgtctgttgaagattcccttccagcaattaagtaatcataactttatgcatgtagctatagtgagagattaaaattaagaggtttagtgtcagttttaactagtcaagttacttaatttctaaatctccgttgtctcgtcttgaaggtggagataataactactttaagtaaagcatgtagcacaatagctgataatctatgttttcagttattactagtaatgcaatgtagctcagaaatccacaaactttatctgttaggttagaaacattggcacccactttcatgttttcttatgttttacgtcatcaaatggcaaactgagagatgaacatggccatcaagtaactctctccctgacttagtaatttcctttctgtttccctgtccataatacaaagagtcgggggtgggagtagagggacgaaagtcctcatatggaaaaaaatacaaccaacctgttcttcctcttgaccatacttagagaaatggtaagtagactctggttaattcaaaaacattttacgataggatagtaaaatgagatttgttttaaaaattactctggaaaaaggatttataatggacaaatgtatatatttagaagattagaccatatcttggcatctggctttgtgaaccatacatgttggaaaacttaaccctctgcctgttctttcaacttccattaaatataatatgtttgctcatagcagcttatcgaacagtgatatgggcaggtaacagaaccatactacaaagaaaaattatttaacagtagacaatgtgtttccctgtataaaatggagcagcacatgggagtcaagatttctgtctacctcctttcttatcaatagattacataaagcatcccccccttctttttaggaagagtcagagtggaaaaggacttcaatatctcaggcctgaaggaaacctgttgaagcctgtcgggttttctttgattggttttctcttaggtattttctttctaattattctgtggtttcactggtattcactgcagaatatagctattctgtgctgggagattttgaaatgtgtctgttctaattttcttgcaatgagaaaaaaaagaaagtggactttgagaaaaaacacataaatatttttaaattttaaactatcattgtaaaccagtctttccattcccattcagaatgtcacaggattatagtctgatttctttataacctgatacctgataacactgatgccttcctgggtgtcttgagtgtgtctacagaagatcctgatttggaaggtctaataagcttttatatttcatttttattttttctatttggaaggaaaatgtgcaccacttgctttgtggcaaacaggggacctcagaggctgatattaagaactctctgcttgttagttatgactttctttcctgaaacaaccaatagtcagtctcgctgagtgacttaatgaagtaaaaccattgcaaatctatatacttgagaattctttacttgctaaaggtcaaatgtgaagccattatttttatttgactcaccagcctctattgcacttattatcagttctaatactgtttcatagaaccacaagagtttataaagtaaatttaaatggttgctgaaagttagataactagaaatattttgtagaatatacaaatacattttcctacttcccgatatctgaaaaccactaaatgggttaagttaccttccaaatatattaaatactgcttccagatgagcatgacattgttgaattagtattggattgagtccctcaggtattagcaacagacaagccacgattccatgaacacagaactatgttaaagcctgaaggaggtaatgactaaggttaaagctggacttctggtttcaaggaccttgggggctggttggaaagaaaaagtaattagacatcaagaaagtaaagcaagttgcagcccctggttattagtataaaaataaataaggaaaagagagctctgtatagatcgtggtagatagagaatgcttcatggaggaggccaatgttcagttaagacttaaaggataaacaagaatttcatgtgtggagaaatagaaacaaactttccaggctcattcaattactcatgcacttttgcctagcacttatttacctaggccagggaatatgcatgtgagataattctctgttcccaaggaccctcatttcggttctgtgaatttgataagctttttccctttgtaagttctttgcgcatgatattccaactacattgctttggattcttccccatcatgagctgcttcttccaggcgtcaaaccacacattggagtgtcattgtgagagcacagaattcagagggagacatcatgagcaattcttacccaccagccctcctttcttcccacattcttctcaatcgtggagtatttctaccactagaaccatttcttcaatgacagaaggaaagggaataaaccagaaggaaataggcaatagaaggttctatattagtaaatgttaaaacgtttaaaaatacattaagtatgggccaaactcttttaaaagtcaaaaaaggggtacctaggaataatatggtagtcatcagggaaccatggaattaatggaatgtggaggatagaaatgaaaccacaaaactcattttccaaacagtaaaaccacccaaaagtcccatctcttcctaaacggacaacaaatgcctgttatggcctttttttgatgtcattatttattgttactgttgtttgtttgtttgtttaatttgtctctgttctgatctgtgaaggctttgcctcagatacctttaccccaaccatctgttctcctttctgttctacgaatcccatgatgccaaggagtatgttttattaatttttgaattcctgcctccgagcatagtgaatagaaaaagcaaacaaatggatggttgttgggagaaaatggaaatgtgtcaattgtaaaagattgtcttttattttttacaaattaaatattacatagtattttgaataccattgtggagcacactttactgccaaagatagtaaatataaaaagtcttttatatcaagggatgattccaacacatgtaagagtactgagttcccactctagccaaaggagtcatggtgcagtagaagaagaaagggacagggaattgaagaatcttgttcatatgccaatttcacctctattaaccagtcaaccttctactcatgccttaaccactttagacattggtttcctgatctataaaatgagggacccagtaagggataagccatatttttatatgtaaacatttccaatagagttccagatacatgtgttagatgaatctgacccttgcatggaataagacacttatctgctgtgtggtctggagcaagcgactcagcctctctgattcttaattctttaaaaactgagtatctccaaactctggagcccattttattttgttttattttattgaaattttatgaaaataaaataccatttttaatccagttaagttaatcttcaataagcatgattacatatatacccaactgcattttagaaccaataggaagctatctagcactcagattaggcaaataaattggacataaattacaggagaaataaggcaaagctatactaagagggaaagtgctagcaaaacttacaagtggttcagagtactttaaatcattttaattaattttcattctacaaacatgtattgattatttacagtgtgccaggatctattctgggttgtaataacaaatcaggattaggcttttccacagaaatttagtcttgagattgttgtgctcctgggtgcttctcaaaacaaattacattggtgttgttcagtggcacccaacctggggcactactaacctcagagatcttcaccttatcacctagccttcctggacttccacctatgcacttatcagatgatggtcccttccagcttaagtgttttaagagggacagtgggcaacactgctgtagtcataaacccatggttgggcctgagctcatgccctgctcctgggtctactatcaagacatccctgagcagaaagagcctgcagcattgtcctgattgccacaaatcagcattaaattaggcatttatcatatgtgaaaagacactccatctgcagatctccaccattgtgtaaagttgtcacagacaatatgctacttggcaatctgcacatttaacaacaaatgggaaagttcaatagcaaccagaaataaacttgggctttagaatttcatttcttagatgtagttagtgtttggccagttcccagaacattaccttccatttatgagaatgtagagctaagcaaattcaaacctaaaaacatcttttaacttcctatgtgaacaggaaggaagagagaggatgaatgtaataagattctctgatcataggaaattggaatttgctatcttgccagaccatttttcttaatgcacatctgaagttggcaacatttccttggcagaaaaatgaaatcattctgattcaaagaaacatgaaatgagttggtaaagatttttctaatgacagtgtaggaagttttatgctgacaaataaaaggtaaatatacctttcctgtcaatacttaagggatataaatggtacactgaataatatagacttgaggtttttttgtgtttagcacctcaatatttgattacatcagaggtgaattagtgctatgtttgaaatacagtgaagcgtgagtaatttatttttctgattagggttattatacaaatcgtattctgaaactctgtagtcccaccataatatgaaggcccccaggggcttcagggaactattactgtaacaattgcatatgtaaactcttttcaccacaaaatattaagaggttaaatgctaataggcctttaagatggttggcttgaggttttcttcatctcctgtttgatgttaagcatttgttaaaaaaaaaatcaaagaactggggctgtgtgaagaggttgttattatctttcatctcagggaaataagcagaagacagttgcaaaattgcttggccttattatcctctttctttttaataaactagctccttaaagagctaccgtttttcctaaaatgtctttagatggaagatcgggactgctaattgttctactagttttaactataggggaaaaaaacagcaataacaaagaaatcatgaatcaacgttacaattaccaggttttaagaggataagtaaaaccctggagccaactctaaatacaactaattaaaacaaaaataggaaagaaaatactttctcttaaagtggtcagatatacttaggtacatttaaatgcatacctagctatctagtagtttcttccatgtatctcgtgaacctgaacaatttggtagccagtgtaatacaagtcccttctggatgcctttcactaactcttcccctttgacagctccctctttactcttttgcttctcctgggtaccacagttggcagctctttctctctgttgatcactctaacatagatacctctatacctgacttccctaagaactccagaccaccaattccaacagcatttttagaaatttctaatagcttccccgctattgtttcaaacccatgtgcagagctgagccctctgtcttctactgaaagttgttccttcttctatgctgcctaattccattaacaggattgacaagcttagaccctcctgctcagaccaggatgtttagactcatctttaactcctctctgtcctgctcctctttcaaccattgagtggctgtcttagttaatcgagctgctatgacaaaggaccataaaacgagtgacgtacaaacaatagaaatgtatttctcatagattcagaggctgggaagtccaagatcaaggcgctggcaaatttggtgactggtgagggcccatgacaaaggaccataaaaatcggtgacttataaacaatagaaatgtatttctcatagattcggaggctgggaagtccaagatcaaggtgctggcagatttggtgactggtgagggtccacttcgtgctttgtaggtggccttcttagtcttgatgtgtcttcatgtgatggaaggattgagggagctctctagggtcttttttacaaagacactaatcttattcataaggccttcaccttcatgacctcattacttcccagagaccccacctcctaataatattacattagtgattaagatttcaacgtatgaaacacaaccattcagtctatagcagtggctaaatcctgttgcttcccctttgaagtctcttcattccatcttctcctttgatttcttccattttactttgactgctcctttcatccccattccagatgaggtgctccacctgaaggtttctttggtaccctaggcttacttccatcatagcaccattcacattgcactctaacctcctttacattcttgtctccatctcctagcaaaagcatacaataggtgctcaataaatgctttttgcattgaccttctgagtcacctcaacctcacttccttattaacccttgctgaggctataggtgacctcttttgcctgctgtcttctacctacaaaccaagcaaatgcagtcatttaatcactagtcagaccactttcctcttttcctaccaattccattctctaaattgtactttctaatctctccgctctcattcatttcaaggagaaatacccttacttcagcctgtctctacagaactgctatctattcctaaggacctttttcaaatattttctccaaaaactcttcccatagtgcctcctaggcataattaatctccccacattccacctatattcaaaagtgttctttcctacttcttttatcgtgttttttcattggtcttgtattcaagctattttgccaggactgattttcttactcgattggggagcatggagaaggtgactttctcatctctctgtctcccacatacacaaaaggtacaaagtgctatgtgttcagttacactacttttacacttgatttcatgattctcaactaactgagacaccgccacaaaataaaaagctttaagttagattgaatactatttactccaataatcatgttaagaataaactcttgacattttaaacaatactgacaacataaaagaataataggggttatatctgctaccaagtgtttccagtatgattcattgcaaagttgtgaaaagaatctaactcatggtctgtaatacagcatgagatactttgtgatctgggtagcacttagtcttaataattaaattcttagtgatttatatatttcattctataaaatttagttaaggaattacttgatactctagctttctttttgtgaacaatagtaatataatcgttcttattttgtctaaagcctgttatccaagattttgagaattaatgagaaaatactttgaaacatttcctcattaatcctccaaaggccactctgcaatagatttatataaatgattaattaaggattaaaagtccttcacaaagaagactacatctctacactattccttgcctagcatcaatgaaaatttaaagttataaaatataaaggagctgtaaaatattttattactgcaggccctagaggagaaagacaatactgctttttattgtaaaagcataaataaatattgatctttgtcatggcatatggagatacagatttctaaaagatcagccttagaaatattttagcaaacttttattctaaatatagttgaaagtatacttttcaccatacatcttttgagctgtcattttgtgtttaagcctcttatttttggaactcattttatttacatcctttgagctaatgcttgctaatttgcaggttattaagtagattgtaatttatcaggtagagtatatttttggttcagtgattcttctaggaagcatagctgatgaaccctaattatttcccaaaagccaaacgaattgcctaactttagttattcagtttatgtatgtggtaaaagttaagaattctccaaaatgttctagattctgtaaaaaaataaagcacgcttacaagactttccaaatctgagtccaaaatgaactccaaagaacatattagatgaaactgcctaaaagcataactacgtgatttaatagcactaggataacgtgggtgtaatcccaacagattacatttccctgggcgatgcaatgtgaatagcagcaacatgtatagaaaaagcagcataaaaatcatgcatgctgaatataatttgcaaaaaaatgaataaaatgatgaaaaatgtacaccagtagggggtagattctggtatcgtcaaagcatctgtggaatcaagataattacagcattcagaacttgggacaatgagacacaaatatattcctataatttcctaagaaataatgtatttgatgtaaagaaaaagagaagggaaagagagattattagctgctactgattactcagtgcatgccagatatcacactaagcactttcaataagctgttatgaaatggcccaatgatcctatgaggtaggtattattaacaatatttttatattaaaaaaactagatccagatgtctacccaaaacccaagtacctagtagttaacaacagccaggaaagacacacacacacacacacacacacacacacacatatctatctcctccccttgggattgtgtaataagaacaaacaaacaaccattaggtgtgactctgtgcctagttgacaaaggtgccctttaagaattatatcaccatttcatgaaacagtgggagctcacgtgcttgcattaagtagagtgttcaggacaacctggaccttctagagggctgagagatcagacagatattccagcttttccagcagggactatcaaaatttttcataaagaagacaattatgagctaaaacaaagaacctccaacatgaggaggtttttaggagttaaagcatgagtttttgagtcagccagactccaaaatcccgatggatatttctgagattcagttttcttttctgcaaagagtacatcataattactaccttgaaaggttgtaagcagattaaactaaaataaacatatgaagggctcagtatggtatttgggtcatggtgggctctacataaatttctttaaaaagaagagaagggggaaaaaagaggagaggaggaactgctgagaggcattgtttccaggtgcttccctcagtggaagcccctaaggataccaggcgtaaatcattgtggttgctgaagtccgtaggaaatgctgttgcagctgagtgcaaaggtattgggctttaccaacaggggtgacaactagtaaaaaatggaccattgcaagcagtggaaagaaattgaaaacaagaccactttggagcaaaatccagctctcccttatatcctaggatgagactcctgacatttaggaaatgtgtagtgattattgatttcaatgcctcactgaatgaagaaagagagtaatcatttctaccaggtttcctggtagaaatgatgctccagggactcggagtgttttcttgggccaattacagagacactaaacagtaatcttgtcctcagatgtctaaggtagacaggctataattagaaaggagtattgataaagtggtgctgaggtaaaaataaatctagtctttgcaagtctaattattttggagaaaatgagaaaaagaaattgacaaaataaataatgtttgcatacacacgcatacacacacacatattaaaaaaaaaaaaaaccctgaaactattatatatgatctctgatgaaaaaataacaaaattaacaccataagcattcttaataaatagtcattttggaaatcgtttctgaaactttgaaataggcttttaaaatgtaatcatgaatcaacatggctgatatggttcaaaaaatgtggaacccagatgacccacggataatcagtcactaagttctctccatttggagctttattctgtctctcacattcaacctcccactactttctaccatcccagttctgggtcttctctccacatacagaattactgcatttgtcttccaactggttgtccatactctattctctcccacccaaatcatgttatattaatacatgctcctaaaacaggggtcccaacccctgggccataaaccagtacgggtccttggcctgttaggaactgggaagcacagcaggaggtgagcggcggacgaacaaatgaagcttcatctgtatttatagcctctctccattgttcgcattttgttctgattggtcatggggacaaacagttcagctaatcacgtatgagacaaagaatgggaatttggaaggtctgcatctggcctcgccctaggtaacaaggaagtcatccccaagccttatctaagtcattatggggaagggtggttcatgcagtaagccatttctaataacagaaacaatggagagatttctttcatcattgctgatattgctgatatccaggggtacagggctcgggtaacatttaacatggccacttccaatggctttcccgtttactcagagtaaacccattatttttcagtggtcgatagcaggggtccccaaacaacgggccatgtggcctattaggaactgggcctcagtgagtggcaggcgagtgagcgaatcttcatctgtatttacagtcagtccccgtcactcgcagtatcgcctgagctccacctcctctcagatcagctgcggcattagattctcataggagagggaaccctattgtgaattggacatgtgagggatctgggttgtgcgcccctcacgagaatctaattaataatgcctgatggtctgaggtggaacagtttcatcccgaaacaagcctctgccatccgtggaaaaattgtcttccacgaaactagtccctggtgccaaaaaggcgggagaccactgtcctaaaacgcagattttaatatggtcagttggaaactttccaattttttacaggataaaatctaaacttgttctgacattcaaggcccttcaaaacaggacccaacatttctcaaaggcaataaactagatcaatattttccagtgtatatcctgagaaacactgtcctgctagatgcttcataataaaaaaggtccttgtgaccaatcatattagaaatgaagaacaatataatcataaaagagctaacatttgttaggaattttctttgtgccggaaaccaagagcactacacacattataatatttaaccctcacagctctatgtggttgatttacagataagaaaaccaaccaagacttcggaaaggtaagaaatatatccaagtttacacccctgttaagtgtcaaagcagagatctgagccctggtatgccagactgagggctctgaactcttaaacacagaaatgcccaattacttttatgtggggttccaggagattttaacatattaaaatccctgagaagtcctgatgtgcaaaagcttttggaatgctatttaaactaattaaacgacttcattataggaaatgtacatcatgagatgccttttaatatctccacaaacctgggtttccaaatagtccatttcaggaaacaaactatgagatttctaaggctctttttacctcaaagattctttaattccttttttcctgtacttccaaattctctcctcaatgactttcaatttatgtaaatagttagttacaagtccctaaacatactttagctctaacctcatttctcatcctcagaagctgtccactttcgtctcaatcttattggtaccttccatctcctctctgaagcctttcctaactggccacaaatatattgggtttgatatggtttggctgcatccccacccaaatctcaaattgtagctcctgtaatcaccatgtgtcatggaagggacccagtggggggtaattgagtgatgggggtgggtcttcccatgctgttctcatgataatgagtaagtctcatgagatctgatggttttataaaggggagtttccctgcacaagcttctcttttgcctgccaccatataagaccgtgcctttcacattccatcatgattgtgaggcctccccagctacgtggaactgtgagtccatcaaacctcttttttcttaaaaattactcagttttaagtatatctttatcagcagtgtgagaacagactaatacagggtttattcttcctcagtgtttctgtggcaccaggctgaggcgactttgagttatatccacatacaaaagagatgctgtataatttgcgtgttaagaagtcagagcaggaggcagaggcgggcggatcacaaggtcaggagatcgagaccatcctggctaacatgatgaaaccccgtctctactaaaaaacacaaaaaattagctggcgtcatggcgggctcctgtagtcccagctactcgggaggctgaggcaggagaatggcgtgaacccaggaagcggagcttgcagtgagccaagatcgcaccactgcactccagcctgggcgacagagcgagactccgtctcaaaaaaaaaaaaaaaaaaagaagtgagagcgtgcatattttaattagcttgatttagacaatccacaatgtatacatatagcaaaacatcatgtcgtacaccattaatatttacagtttttatttgtcattttaaacatattggcccttggttggcatggtggctcatgcctgtaatcccagcactttgggaggctggggtggatggattgcttgagctcaggagttcaagaccagcctgggcaacaaggcgaaacccactctctacaaaacatacaaaaattagccaggcatgctggagcatgcctgttgtcccagctacttgggaggttgaagtgggaggatagcttgagcctgggaggttgaggctgcagtgagctgagatcgtgtcactgcaccccagcctgagtgactgagcaagaccctgtctcaaaaaaaaaaaaaaaaaaaaaaattaaaaagattggcttttggtagtagtcacttttccttatttcttccagtgtgcaggtcttgagaaaacacaaggacttacgattcaaaactttgagtccagggtcctttctttttttccctcctttacaacagcatacattgccttaaatcaccagatacatatccatatttatgtctcttcctgattttcactgaaagctccttcgtggtagagaccagatctttctgttcccggtccacttacatagtgaaaattttaggtcgaactcagtcagattctagcttttccatttctaaactgtacataaataactacttaaacaagttgtttaatctctcttagactcagtttcatcacatataaagtaagtggagaatatgatacctaattcgttgggtttgtgtaagaatgaagtgaattaatacagataaagggggctttgcaggatgcttcacaattttaagtgttctataaatgctggttttattattgttgtttttgtaaattggccacctatcatgctccaggcattttactagaccatgaaaccgaaggactaggatgcaatccctgccctctggaagcttgtgtctagttacagaagagaaagaatgcaagtcaggtggacatgtggggccagccttatccagggagagcagaagagggattgcagcaaagcagcaatcctgcccagccctgaaggacagaccggaggtagaagtgctttcaggcagagtcagaagcatttgcaaggcaccttgatctgtgacacggccagaacttgagagctgcaagtcagttcatgtgactgaaatgtgataggtgaagggcaggaggtaagccggtaaactagatcagccaggtacccaaaagtttacgtctcaaaggcatttaaccgtgagcccattgttagtggggtggaaggaggcaggtcaaagaagcatttaaagaatagatgaatatgatcagatttatattataaatataattctggttctactgtggaggttgacagaaaactagactggatttaggaaaaagctaagtgaagtatgaagaagctctgaatagacaaacgatggtctatcaaatggaaacttacagatcagagaagatgcaataggtctgagttgtgaaacagaaatttgctgattgctttaaaatgtatacaatgaaatggcgtattttaacataaagttattaaatgtaatgtatttaataaaatatgttatatgtattatttataataatttaataaaattattaaaatgtaaaacattttatttagtgtaaaataagtgttctattgttcatcttctaaactggctagatttgtacaaagtaagtataatgctaacaaaggaaagataaaggcaatataaactggcaattgatatcgcaaattgaaaatcttgttcctgctgttgggcctaatcatttcatttttagtcatttctcttgggaaaatcatataaaatgttgcaatacttatctcaattaaaaaaacagaaatgtgtatttctaacagagggaatggatatgtacacaacatgatatataaatgtaatctaatatatgaagaaatttaatacactattatgtgtttaaaacagggttgctaggtaaaatacacaatgctcaattgcatttgaatttcagataaacaatgagtaactttttagtataagcatgtcccaaatattatgaggaacatagggcataaactaaacaattattcattatttatctgaaattgaaatggatccggatgttctgtatgtttatttgctcaacctgacagtcctagttttaaaggatctgcaaaagtgcagtttacactatattacataaaaatatataaattatactcagttatggggggaaatatgccttgaaaatagattgtgagaaaatacagtgtaattaagttagtggttactagctgtggagggtttgaatatagattttttaatgtttgtttatgttttcctacaatggatatgagttatttttattagcagaaaaagatgtacatgtattttatatgtccatatagaactctattctgcttttaacatgggcaggggtttactcttaagagtgctatacgctaggatacacactgcttcccaatttactaccagactcaaaactttctcaagtaactcctagttcctatggaataaaagactctgttttaattttcagcttaaatatcatgccggtagtaagaacttatccacacactgtatctcagttcttcccaccaccacaatcaatatcaatgctttcctatttcattattccagagcaaactcttttcttccataccacttagcagagcttcagttttgttgaaagaaagagtaaatgaataaaggggagaaatgagatcagaaatattggatggcatttctcactaggcttaacctggtatgtatttaggtcccggttgcataatttaatggccctccaggactgccttggcaagtaccagggtagaaatatatgctccataaaaatggatataaagaaaaataaagaccagtaaaaatatttatttgtagagaaactttagtggactcaggagtcggaaaaggtctgtgaaaacaacaaaactggaagaaaagataccaaagcatcttatagcttccagaattttccccaagtgaacgtcaatgttttcccttgaaaggtgatttctgggggatcttgctgcccacacaggtgatgaaaactgtatgccaggctgtcttgtttaagacatatttacttttcatttcactgtattttaaatttgattttatggacttaccatggaaaccatcatttaaaaacaaacaacaaacctctgttttttcaggcctcattttgagtagaatattgttggaatcctattagaaagcaggtgtaatgtggacggatctgtggtgcattccttttcccatatcttccttcttgaaaccttttcaaagctgtttcctgacaatgatagcaaaagaagcaatgcattacaggtgaataaaggaaacagaaactaagcttaaaaaatagaacaaagtgaagaaaaaagaaagacaggcgaagatgaggaggaccaggcaggaaagagataggagggctgaagagaggaggaagggacagaaactcctagtgtgtacctaaattacccctagaaaagtgatcctacagcttcattattgtatcatcaggatttctaaaaaagccaggaagtaggtgatgaagggagagaaaaaaggtttcaagaagaagggtatgggaaaaagaatgcatcacagatccatccacattataccgctttgtaacaggcttctaacaggattctactcaaaatggggcctgaaaagacagaggtttgtttgtttttaaatgacagtttctaaggtaagtgcataaaaacttatttaaaatacagcaaaacaaaaagtaaatatgtctcagacaagagagcctggtatacagttgtcatcatctgtgtggtcagcaacattcctcagaaatcaccttaaaggaaaacatcgatgttcactggggaaaaattctggaagctatacaatgctttggtgtcttttcttccagttttgttgttttcacagatcttttcagatgccttttcccataccttcttttttgaaacttactttctctcccgtcatcacctacttcctagctctttctttctccttcccttccttccttccttccttcctttctttctgtcttttctttctttctttctctccttctctcctctttttctctctttttctctctcattttctctctctttctctctctctttctctctctttctctctttctctctctttctttctctctcttctctctctttctctctctttctctctttctctctctttctctctttccttccttctttctttctttctttctttcattctttctttctttctttcttctttcgacatagtttcactcttattgcccaggctggagcgcagtggcatgatctaggctcactgcaacctctgcttctcgggttcaagagattctcctgcctcagcttcccaagtacctgggattataggcatgcgccaccatgcctggctaattctgtatttttagtagagatggggtttctccatgttggttaggctggtcttgaactcccgccctcaggtgattcaactgcctcagtctcccaaagtgctgggattacaggcatgagccaccgtgcctggcccttcgtagctttttctgaagtcgtggtgatggaataatgaagctacagattcacttttctaggggtaacttaggtacacactaggagtttctgtcccttcctcctctcttcagccctcctatcccttttctgcctggtcctcttcatcttctcctttctttatttttcttcactttgttctattttttaagcttagtttatgttttctttattcatctgtcgtatcgcttcttttgctttcattgtgaaacagctttatagctgttgtctctaaggatcttttattctaattcactaaagcagctccacactaagaggcaagctaagtggtcttcaatgcttctaaattctaacagatttaaaagtcactacctgcacccagaaacaagagacatggagtgttttccaaaaggttattgagcgtatactaaaaatgtcattagactttttgttcccaaatgttttgtatgtaatttattaatgatgacataaaggacagaatacaaatctattgaccatccactgggttcaaacaaatatgtgaggctcacatgctgaatgaattagacatttgaaagagccaaactgagtgcaggactcaaaaggccacgtagatattcaagtgtactttgtttgatgaaatttgtttttctctactctatatatacctagagtttttgtgacaagaaatgtcagaaccaattttgaatacaaagctcaaaatttgttttcttttgcaagaataacacttcaaaacatcatttgaattttgtgtgccatactgttatttcaacatgctttttaatgacatgccgtaatctttgacgtcttcattattttgtacttgctcagttcatcagaagtgtcatccccacttcttttgttttcacttcccaattttagatccaaaagtcccccatctttacccaccactaccatggccaagtttccagactgtgatttattgttaataataaaaataatgctcattgtgaaaatgtcaaacagtaactaatgggctaaattgaaaagtagaaattttgtttctaacttccattccacatcccagaggtaatagcaggtgcagtttcatgtgcttcctttaaaaaaaaaatgaaagcaattaaaaacaattaaacatgtaaaaattctggcttagtggctcatacctgtaatctcagcactttgggaggctgaggcaggtgcagatcactttagcttaggagttcaagaccctgtctctacaaaaaattacaaaagttagctgggcttggtggtgtgtacctataccacctactgtgtttgcctagtcccagctactccagaggctgagatgggagattgattgaacctgggaggttgaggttatagtgaaaagtgattgtgccactgaatttcagcttgggcaacagaaggagaccctatcttaaaagaaaaaaaaaaagtaaaaactcttttggtactgatgataaacatggaatgtgctcccttcttagcagatgtcagtcatccttgttcttctaaatgaccactgtccagggcattgcatgcaagtaccctggtttctgtgctttatctaacaagcctaccaagacacattagggctgtggcttttgccatcgtcacaaacgatggtgaagatctttatacaaacatatttgcacatttgggggtcatgccacactatagatttgtgaaaactggaatgacttggtcaaagaatatacgcatattttattttgaaaaatatttccaagatttgtttcaaagttactatgcatctttcacttaatattgggacacacatttcttatgtcattaattcaaaaacttctattgttaatgaatgaatggcattttctcacatatatgccccataatttatgcaatcatatcctcctttaagtgatgtttgaggttcccagtgtttgcaaaattagtgcccttgctgaaatctgcttgtcttcattgtgtttacacatttcattgtgtttacacatttcattgtgtttactgtgatagaactagcagagctgattattacttctcaagttgaagcccagaattttacgtatttattctagtaaatggtataaaagtgttttcatttttaaaaggtcagatttaatgtatttatgaacatttttaggaaatatagaatgctaaatgaatagaggcccagaaaagttgtttttatttggagtggggatgtgagaaatgtaccgtaaataatcacagttatgtctgaaataaattatagtacataaaattttgaattgacaataaacatgctttttgaatcatggtgctactataacattatgtctaaaatattatttgactcacctactgtaggcaggagttcagaaaattctgctttgtaaaaatagacacaagggaaaaaagtcctgtatacagtaacctgtggaagaatgcagcagggaacttacttcctgatcactctaccttagggtttatcaagagtggcatcagtgatattcagagctggataatgcttcattgtgggactgttctgaatgttgtaggatgcttagcagcattacttggcctctgtcccttaaataccagtagcaaccccaacccaatcgtgaccatcaataatggctttagacactaccagatttcctgtgtgggcaaaatctccttgggttgagtagagcttcctgtatggtaaagtccgtcaggtcccacacaggctgacagagcttctagttccacatacttaagaactgatggacaacaaacgatgaacaggcacttacagaaatttcacattaaagacaaagtgcataatgaacaaagagaaggaaaaaaataaaattaaggcaatataagaagcagaaaaaaagttcaaactacactattataatatcttcagggagatgagattagatagaacatccatcaaataataacacattctttttaaaataagagaataagaaagacctgttggttattaaattatgatgtttgaaataaaacttaatagaagggtttaaaaggtaaaattgagaattctctcacaaattcaaataaaacggaaaatacatagaaaatggaactttaaaggtaagatttgagtattgatttaagaggtcaaaattcagagaaagtagggtagaagaaattttttaagagaatgagacagagagagaggaattccctgcatgtaatgcttgtaaagcagaataacatcagactttttgtggccaagaaaagtaaaaaataatgaaattatgtctttgaaattttgacagaaaatgatatttaactaaacatttctaataagcctggttatcaatcaagcatgaaggcaaaattaagacctgatcacaaacacagtcttcacaatatacctccaaggcatcttgtcttggaaaaaaaaaaaaatctgttaaatatacttcactggaatgagggaggatccaaataacagagagtggccagagaatctccaaaataatgattaaagggaggtttcacgatatggcagacctagacaacaacgaattcctattggaacaggaggatgaagggatgtaaacatgaggactccaagggaaaaaaccgaactaataaattatttaatgtgcttggccttattgagaagaagtatgtaattctgtaggtgactgaaggggaagaatgtgtgatagctatctgtaccaaactaaacaaatgagtaaaagtattacctgccttaaaaaacacagggctgcgcaaaaacataaaatagtttattacattcctccaccgtgaaccatatttaaagagttgtaatcatgaaaatactcatggctgatcttttaaaaattgtgataaaacaacattggaagaatgacaggagtacaagaaaaagcaggtccgtggtttctaagtgagctaaattctccttttgcataatagacaatgtcaaaagaagaagaaaaccaggacaactagtgtgaacataattttttaaagtgtctaaatgccaaatgaaatattaatagctaaaagagttaaaagcagatgagctggggtttgggaatctagtaatctgaaaggtaaaatagaaaacctctctttttttgtacagtgagcttgtagttttgtttattaactctatagagtacaaactgatttaaaaatcaaagcaattctgggcaaccacacataaaaagttttggggtgctgttgacacacgtgatatatggtttttggacctccacccctgacttactgaatcagaatttctagcaacggatatcaagaatctgtatttttataaaagctctccaatagaagcttatcaaatttatgtgtggaaatcacacatatactgttcagttattgaagtatcagaatatgattttcaaaaacaacatcaaaataattttatggtccagtatttgtagaatatttgagtacatggattcacagacacatatacacacatagatacacagagataaatacacaggtactgtcaagagttaatccattaaactcagagaaatcagaatctttataaatctttatacagttgtccatcagtattggaatactgccagcagaccaaatattgaggtctttgttgtcataaaaatttcacctgctgggtaattagttttgttctgtgtttagcatagcacataaatcttcaattccagaccctggatagtggtaacataaatataaatagtctgcctagggggcatttgactgatctgtctttacaaacaaggggttcattaaaagcatatgacttagtttcactgaatgtttgctattgcttcctctcctgtagtgtttttttgtttcctacagtaaaccaaagaacataagttacacctgcacaaagcgatgatttggagtccaagatgtcatgataaatgaggaaggttataggaggatgagccattgcacccacacctcatgatggatgactttggggagctggagcggatctgtagataccctggattttgatcttcaaactaggctgggtcatggagagctaataaatcctgttttactgttgaatgacaaacaataaattagacaatatacactgatagaaagtttttaaatttaatttctttaaaaagtccacaattaaaaataacatatttgattataaaatgtgaggtacaaaatagcctacaacaagaatttggtggaggaaaaaagatgaagaaaatattttcatataaaaataagtggccaggtgtgatgattcatgcctgtaataccagtaatttgaaaggtcaaggcaagagggttgcttgaggccaggagtttgagaccagactaggcaacatagggagaccctattgccacaaaaaaataagacaattagccaggcctggtggtgcacacctgtagtcccagctactggggaggctgaggtgggagaatcacttgagtacaggagatcaaggtttcagtgagccatgatcatgccattgcaccacagcctgggcaagactctatctctaaaaaacataaattaaatataagtaataattataagggcaatattacctagacaaagacaatacaaaattaaaaattgaaaacataacaaggactacaaaacaatatctctcaaagattttgatgcaaaaatccccaacaaaatattagcaagctgaatccaataacatattaaaaagaattatacaacataattaaatggacttattctaggtatttaaggctggttcaagatttacaaagaaattaatgcaatccaccatatcaacaggcaaaacaagaaaaatgcatataatcaaatacatttatgcagaaaatacatttggcaaaacccaatattcattcattagaaagattctcagcaagttaggaaaagaagggaatgagtttgattaagagtaagtgcagccgggcgtgttggctcacacctataatcccacactttgggaggccgaagagggcagatcgcttgagtccgggagtttgagaccagcctgggcaatatgacaaaaccctgtctctacaaaaaaaatacaaaaatcagccaggcttagtggcatgtgcctgtagtcccaactactcaggaggctgagataggagaatcacttgagcccaggtagcagagttgcagtgagctgagactgcactgctgcactccaacctgggtgacagagtgagaccctgtctccaaaagaaaaaaaaaagagtaagtacaaaaagctacagttatcatcttaatgatgaaagactgagtgatttccccataagattgggaacgaagaaagacattctttctcatttctatcattcaacatgaggctgaaagttcttgccactgcaataggcaaataaaagaaatagacaaccgggagattggaagacataaaactatctcttatttccagatgacatgcttgtctttgcaaaaaatttcaatgactctaccacaaaagtgagtcacatacgtaatttaaaattttctagtagccactttgaaagaagttaaaaaaaaaaaccagatgaaatgaattttataatatattctgttaactccatatatccaaaatattatcatttccaatatgtgatagttaaaattaatgtttttctatgtttatactctcttcaatattcatatctcctatttatatcatactcaatctggaccagccactggctctttcaaatgttcaaaagccacatgaggctagtggctactgtattgaaaactatggatctagatgttcttttgcactgcttctttcactctacaatttaaatttttttaaatatataaatatttaaacgatgcaataattatctaactctcctccaaattacactcatgtctcagctacatgctttgcatttaaagcaaccacattgccaaaggcgttgtcaacaaataattgcaatccaaaggtcacaaatcctacataccctcctggtgtggcacatagttatctttgacccatttgtggacataatttgtccctgtggttcaagtcattcaggaagggagctcaggtgagggcttgcagatctaagatgaggacagagctggtgagagaggcagatgagttccctatttgtcaaaatttctgtcttctggactctacttcctccctgcaggtgggcattcttccttgcccttgtcttgagccaaaagacagagaggcatccaattatgctgtcactcccccaggttggcagtaacagcagcaggctgtaactctgcccagggctcacaagctgcagctaggaggtttccagcagtcaaaaggcttagagtagatagcctcttattttctctggagtccccaagaggatcagttagacaccaggcatcttactcgtatgctattggtctcttaacaaaccctggcctagagtgaaagttaaaagtctttgattcttattctttcctccatgatgtgtctttatgaaacatcaagtgaggtccctttatgccctgcactttcttcctttgtaaatgaagagcaatatataataatcactggtatttattgaataaacacagtgtgccaagatgagtcctgagtactatagatggtttctcatttacttctgcctataaaccatgagttacgtatcattatttccacattacataagatagaactaagctactcaaaagttacaatacctgcctgggctctcccagatagaaaagagcagaggcagaattcaaacttcatttgtctgactacaaattccaaaacatgaaagagcattctcaggcctagcaagataataatgtggtgcttatcagagaagaatcgggagcccaggttagcgtccccacccagtgctgataaatcaaaatcatccttttcagcctcaggacccacctttgatgtcaactggccaagtgcattactgctggacttgaaagaagccttgcagtcttaccttcccagtgtgaggagacgggagtgccccctacattcaagtacttcttggaaatttcttagctgttgactatcattctgtgaggctagaagagagggcagtggaactgtcagtaatttaaaatacattattcctatcaataatgattcttgagccttcttacaatttatttttttttgtttttttatttcattttattttatatatatatacttttttattatactttaagttctagggtacatgtgcacaacgtgcaggttagttacatatatatacatgtgccatgttggtgtgctgcatccattaattcgtcatttacattaggtatatcttctaatgctatccctccctcctccccccaccccacaacaggccccggtgtgtgatgttccccttcctgtgtccaagtgttctcattgttcaattcccacctatgagtgagaacatgcggtgtttggtttttcgtccttgcgatagtttgctgagaatgatggtttccagcttcatccatgtccctacaaaggacatgaactcatcattttttatggctgcatagtattcgatggtgtatatgtgagttctgaagtttctcaggaaagtgatacaacataaattctacaaaaaaaatgtagaatttatgttgtatcactttcctgagaaacttcagaactgccaaagctgtggctaggatcctttgatcctgtggggaggtgtgcaaagaagttgtgtgtttggccccttgagtatatgacttctgagactgccagggtggagtgaagggcttttctatgaagtaaatcttcttcaaggagaatgagattttgcaccaatgaaaagccagactctgtcactgagcagagctacaggcatggcttggcaggagtggtatcatgagctagctgcttctcttgtgcagccccttagctcccgaaacaaactcctctgaagactttcatgcaattgttgtaaaaggcaatgctgtgaactgccctgatatttcacaacagagtagtccagctgcaactgggagacctgggtatttttctagcactgagaggaaataagaaatacctgggtccccataggaacagccgccggggagtcacttcctaaaggaaggagagctgacagaggtgactgataattgctgtcattaagaggttccagggagacactgggagcccctgacataggacctggtactgcagaagagatgaggcagaaggacaacatgcactgggtttcatgggcaaacgtcactattgaagaatccagccttctctgagtggagagagggtcattcttcattgtcaccttctcagagagagcagaggaattgttattctattacctttattttctctaaaaattgaaaaataggccaggcacagtggctcatgcctgtaatcccagcactctgggagaccgaagtgggcagatcacttggggccgggagttcgagaccagctggccaacatagtgaaacccttctctactaaaaacacaagatttagccaggcgtgatagcacttgcctgtaatcccagctactcggcggggctgaggcaagagaattgcttgagcctgggaggcggatgctgcagtgagccaagatcgtgacaccgcactccagactgggcaacagagcaagattctgtcttgaataaataaataaaaatggaaaaattactgccttcacaggagactagggggtgatgaaatttagtggtttgatgttcgagctgaaggtggttaaagtcttgacatgataactcaaatcttaaatccagtaatggccaagttagatccaaagaaaaacaatgtaaatatataatcagaggattattatttagttgttaatttagaaatgaagcagcttattatccttttaatattaacattagttgtttgttaagttttccatgtaaagggttacccttttcataacaatgaaaattatttattgttgggtagaagtcttctggaaatagccaatgtctaacaaaaaattctcaaaaatgcctgccaaaggctttaagttgtttctattgtgttttaactcactgttttcattgttatttcccagacagatctaacataaactccttatacaaatgccaagtttgtcacatttatgcattgttgtaagaaacatttcttagttacttggcgtgtagctatgtaactgactcctgcattctcgccagactgcaagggattgccaggcttggaaggcagtgtgaaatcatgggaaagaacacaaatttgaagtcagacaggtccattgtgggcatcccagctctgccacttaccgctttgctcatttctatcgcactatttcatgccactattttttcttgcctgggctaccatgatagctttcgcattgacctctctgcttccacgttactttgatgctcactcattatctacacctgcactagtgttttacatttgaaactgaaacaaagttatatccatataaccccttggattaaacccctccaataactttcaattttactttgaatgatgaaatctaaaatccttcctgtggatttgcatcatctgtcccccaccttagctctcttacctcatctcataataatctccctcttagtcctcatcccatcaatgcagagctcctggcagttcctcaaatataacaaatttattccaacctcggggtccttaggcttcgactttgtggtgcctaaaatactgctctctcagtgtttatgtctgccacgtctccatcctcctgttctttgtgctgagatttctgtaagctacctgcctctctcaggcactctgcatcctatcactctacatcattttcatcatagcatttatcatcatctgaaaataaattattgataagccttttgatgattgtctaactttattcactgcaatgtaagccccagaagagcaagaactgtatctgtattttctccttctatatcatcggtgcttagacagtgtctggtacttaggtggggctaagcaaatatttcagaatagatgtgtgaacgattttcagttcagcaaaaatgcagcactgggatcagcctgattttgtgtgtggctttttatttcacaggtattcattgtgtgttcacaacacacaaggggcattgcagtcatttgagagactttgtaattatcatgtgatcatgtcacatgccatttctctgtatttctcttgactcctcaaagttttcaacataattggctacttcattcttttggctgctctggtgctgtatgctgataattttccacctaaatcactaccagaacttctcattctcctctgctggttcatcttcctccacacagtctctggggccagaccaggggcctggggtcctctgcttatctcccgctatagagtctctctgaatgactctcccagccccatgatactaaacacccaccactgggctgactttcaatccacaactagctccaacactacttgtaccccagaaatctagacatatattcaaggaccagcttggaatctctacactgatgtttacgtatgaatctgaaacaatatttccaagattaagctcttgcttttctctccaaatgtgtttccccccaattccagtcttccatcctttaccaaacattcctcaaaccacccagttgttcaagccaaaactttaggagctagctgctcttgattcttctcgaaaaaaaaatctctcccatttcatctgtcagaaaatcctaccgatcgtgtctccaaaaacatcaccaatcagttaattttttcaccttcaccatcaccatcctctcatctgggttgtttatttggtttcataaccttcttacttgtcttgggtttcaagtctttcctatgcctctttccccagctgatctattctcaacccctatccctaatcttctaagaacacaaactagaacatcccactaatctgcttaaaaccctcctttggctgctcattacatacaaataaaattcaaataccttatcatgagctacaaggcccacctggcttctgcctacttcactggcaatatactgtacttggtctaagatgctgggcttatttcttatgtcaagttatatgctgcctttggtctagttatttcctctgctggaaatctcttcctcatgctccttcttgacattcagatctcagcttaaatatcactctttaaagatggtatttttggctggccatctgaagttgcagacagactgtgtagtacttcctgtattttaattgtctctatagactttatatgtaaccaatattattcttttttattttactactttaatttgtgtctctttcactccgtaataaaatatctcaatgggctaggaattagctttttcaccactgcttccctagccctaaggacaatgagtgatatctcacagggttccaatacatactagtttgatagtttgagactacaagatgactgtctatgatgtcagatctagagcccaagttcaggtcttgaaaaggcccaaagtgccctcaacagctcatgccctggtttgcaaaagtgacttagttctccagctaatgatttactttttgaattcaaaagtcaattctaaaagtccatttttaagaggcctttttctatgatgcaaatatccctggatgaagcattactaaaccattcgcaacttcacatgcattacatcagttcagccagctagtttcttagaaaaatctcaaatgatgaccccttgactgtttaactttgatcaaggaagagtgaaagaaatgatcagaagcctgggccttgctggggaagacaaacgaatgacatcactccccggatccttgaaccatcatgatcctagttcctgagtgcaactaaagcaaatagatgagaaaacatcatttccactattttatatatgatatttcctgacagtcatttattcactgtttataatgaccaaaggggcttatatgatcttcatgtgtgcctccattctctgggaattttgtctacctcattcccccacccaagtccattccaggcatagtaatttcttggttttttttctcattatttttggcaggctatttcttcaaggcctctcttccctctacctggaaagctcatctgccaagtgtttgaaagctcactccctgatatcatttggatatttgtcccctccgaatctcatgttgaagtctgatcccaaatgttggaggtggggcttggtgggggggtgtttgggtcatgggagcaaatatctcatgaatagcttggtgctatcaccaaagcaaagagtacattcttgctctattagtttatgtgagagctggttatttaaaacagcgcagccccactcgcttctctctctctctttcctcctctcttgccatgtgatgcagctccccttccccttctaccacaagtggaagctccctgagaccctcaccagaaggcatcatgcttcttgtacagcctgcagaaccgtgagctaaataaacttatataaattactcagcattaggtattcctgtatagcaacacagatggactaggccgctcactactgacttccttcaggcctttgctcagatgtcatgggggcagtgaggacaaccctggccatcctatttaaaattgtgacccacccatgctgcttacacagcatcacctattctttttactgttcttctaatttttgccttaaacttatctccctctgacatgctatatgtttcctttatatgtttgtttattgtcttgcttcttccactagtatgtaaacttcaggaaagcaggggttttggtctgtgtttctttcatctattttcccaatgcagaatggatatttaatacacgttgatttggtgaatgctcctgaagagtttgctatcaatatgctaataaatggaggaaatcagacattcccatgagtcatatgcagttgactagcggaaagcatagttggcctatttttctccaaaaagctagattggggagattaatttataaaaacacagtaagtagaattagtaaatacttttactactgaaatgattctccactggaggcaattttgcccccaagagatatctgagtactaagagatacttggcttcctaataaacagactttcagaattgacttttgaattcaaaaggtagctggaggactaagtcacttagttcttagtcacatcagaagtcattcttggccaagggtgctgccacatatcctacgatgtacggaacagtcaacaacaacaaaaaatcagaaccaaaatgtcaatagtgctgaggttgagaacccctgtactgctatgtaaatgttaagacttttctttcaagtattgagcctttacttacttgagaggaagcttcattatggcacaaatgtcatagttactttcttggaattgtgagagtgttaaagataacataaaatattttgccagtagagaatgaagaaaagtggtttacttaaattgttcagtgaggctacaattccttttatataaaagaatattttcactacttttagaatgacacaaaatagtactttaagagtgagaagatatgttgattttatgcaaatcttaaagctttgggatataagatcagaatgaattacattaccaaaaggtttttatctagacactctacatagtttattgataaatttggtatatttatcagggaagctttataacttaaagaagcactaaaataaaaatatatccctactgcaatttcaaatctaactttgaaatgtagtaatttgacacaagtgccaagatggaaaaaattattcctcaaactgacataagaaaatattctcctatatcataatgaaataacataacactttactttgtgtaaagcattcaccacttgaaaaacattttgataaatgtaaagtttcctaaatgacttgcatatttatgtggctgttccttcatttgcttcagctttcaggccacatttatttactgcctacaatgtgcccactaggaagaaaatatcagtagtgcactcgagtatcttccagtctagtaagagagacaagatgtacagagaatggaggtaggaagtggaactgataaggggccattgaagtttagctggaagttgcaggatgaaggaagtctgcagagtacatagattttagtctgaattttgggaaatgtatagaatttctacaggtagggggccttcttggtaggaggaacagtgggtagaggtgcccaagttactcagatgtgaatagtaacagtcactatttgcatttaagcgcaaggaaagtgaaaagtgctctgtgggagagaactaactatttaagtagggtcagattcctaaataatttgaatgtcaagcatcaaggtagaaggaagaaagaagtgacaaagcagcattaaggaaaatccttcaagaacaaaagagatgtgagctgaggctgacatcagagacaactgtgaacttagtgctgacaatgggaatggaggggtgggaagaaatgtgagaaactgtggaaggagaaatagtcagacttgaaaatttttccatagaggtaagaaatcagggagaaggatcaaagatggcactgatatgtcacatctaagtaagtgaacggaatggtagtgtctttaagagaaaccagtataccaggagtcagtgcagatttggggaaacagataatatgtttgattctaaacaacatgtattgaagacaggacatttcgtccaaggggtgacatcaagatttatgttgcaattagagatcaccagttcagaagagaagtcagtgctaaagacgctcttcttggaaatgtttaagtagctaagagagttgaggccatgaggtagactagtagccctggctctggaataggtgctgtacatgaatctcctcatagctcatgaagttagttattagattctgttttgcagaagaggaactgtgatcacacagctggtaggagtcagaaccaggactcaagctaaagtcattcagactctggcatttccactgcattatagggctagaaaagggagcaaaggtaaagaacagactgaaagtgagatcctagaagatgccatgttatgggaagaggatgttgttcacatttattgatttatatctcccttttgtctattattgcctttgtaaacaatctgtgttgctcaaagattgctactctcttgtctcaaaaaaatcatttctaggccgggggatgtggctcatgcctgtaattccagcactttgggaggccgaggtgggcggatcacttgaggtcaggagttcgagaccagcctggccaacgtggtgaaaccctgactctaccaaaaatacaaaagttagcttggtgtggtggctcacgcttgtagttccagctactcaagaggctgaggcaggagaattgattggacctgggaggcggaggttgcagtgagccaagatcttaccattgtactccagtctgggcaacagagagagactccatctcaagaaaaaaaaaaaaagaaatcatttctagttgattcattttcacagactgatctgtaaagcaaataagctaagagtttgtacagactgacagtaataaaaggtaggaataatattattggcatcttgaattcatttgtgttaatatcgtaagtaaaagtttgctctaaaagtctgttcttctaaaatattaaatttcctgctgagatactctctggcttttatacaaacattgttacttgttagttaccttgtagtagttatactatttcccctgttatactgaagattcttacttcaaaatgagctgaagatgtgacttatgagtttacataaaatgaaaaaagtagttttggttcttaataaagagaatttatgtgcctggtacattgctaagactaaggaactggcagagtccagatggaggccaagaatacaagatgttatgagcactaaacaaggactccaaaattacttccatcaataacctgtggcatctgcgaccaccttatccattcctgggattcgttttttgttcattgttgtggtggtggttgtccttgttgctttgaataggagtggccaggggagaggatatctgagattgggtacagggtgtgtatgcagttagaacattagggcgatagcagtattatctttaatcttgaacaccttagaaatggataacacccagagccacacatcgaaaagatagagattttttaaatacccttcaaactgcttaatttgtagtcctaacaaaaaaaaatttacatctgctgaattatgttcatatctgtgagatttaagaaatgctacccaggatctacataaatgttccatttatggcaaagagaagatgattttgtttatgaaaaagagataacaaatatttgagatagtttttaaggatcttctgtcagcaaatgttaatgcagtaaggaagatatcatgatccttctgaaagtcagcgaaaccgaaccaaaaagggatgacataaacttcacgggcatatgctattttaagatttgcacagatttctgcactctaaaaaacgtgagtttcatgggggctgtttgttctctcactccacacacatatgagagggtgagagagagtatctccagtaacaggggccatccactgttgggttcagtcattctctcttagaggcaccagagggcaccagagggcatgaagatcagagcagcaagccgctctacactctgcatctttatgctagcttccaccataattaacacctgcagaatcctggggtagttttctcaccatgcacttgaaatgtgccagcttttaagaacccttaccggcactcatctcgaatttaaggcacactctctcattagaggtaagctgagaaattggagtcaaggagttaagcagagagaaggggataagcacatggacacattgtctttggtggttaagaggaacattgctaaaaacaaacggccttttattggcctttcctccttcctgacatcactctacacttatccttaatgaagtagtacataagaactgtgtctgacgctctaaggaaggatgggcgcaggaaacaaagtataacaaaggaggcaacactacaatgacttagaggatttagtttttaagagcttttcccctattgatggatgctcgactgattttatctcatcatcaaccttggaagctattagcagaggaaattgcacttaccatctgtgatgtcctggcaataacttaatattgttctgaaggtttaattcaaatcgatttaattcagcaaacatttattaatctcatgaatgtttggcaccatactagaagctaagggataccaagatgaacaatgcaaaatgttttatttttacttcaaaggttttaaaacctaataaaatacaagaaaaatattaggaagtacaatacagtctgggacatgaaaagaaaaagtataaacaatatgcttaatcattcatttattcatttaataaatattttggcaactattatatgccaggaactatactatgtgtgtttgtagaccttggttaacaaaacagatttgggttctgttctgccttcacagagtcagtttgggaaatgacagagtgttatgataaagaaacatttggcatgggagaaagttccgaaaatctatttgaatagggtggaataaatgaacttccataagagacgacatttaagaagaatcaagtcatcctaaggactaggaaaaacacattttacgtataccaaacagctaaggtgaagatcgtggaaaaaaaaaaaaatatatatatatatatatatatatacacacacaacttggtctatttaaggaacccaaagaaggcaagctgtagtatatgtaataaacggtatgcaaatgccaggctatatagagccttgtagatgatattaagaactgaagaaagagagaatacatctagccacagggatccacaaatctttacaaagaaggtttccatttgagaaggatgaataagattttgacaagcatgatagtagaaagcaggatttctggataaaaacaatgttacgagcttagacacaaaagtgatagtttgtgtatgatttagactctaataagcatcaaggtgtgagtggaggattcaattgcactaggcaattgaattgtttgccatgaggccggaagcacaggttggaaaacataatggagaacttggacaaattactggttcattaggggcatgaagggaagtcacggacattattaatgccagacagtgatactgttggcattccagctcagatagtctaatttagcagaagcatgcattgtacattggcggggacagaaagagaatttagcatctctagatatccacattgatggcattaagggtcttagggtggtaaaagtgcaactagaagcagcgtacagataaagtcgttgccaaggcaaagtctgattattggacttgaattggctgagacgatcaagttagaaaaaaacttttaataataataataataataacttacgtttaaccctgggtaactgagagagtataaatgctactactagttaattaaggctaagtaaagcaatggtgaattttatgtgtatacacatacacatgtgcatgtgtgtgtgtgagagagagagagagggagagagagagagaaagagagaaacaatagtgttgcaacctgaataaacaaaacaaagtaattaggcagtatcacagcaatactgttgagaatgattaggtgtgttcttgaaagcatgatccagcatcccgatgcaaccaatggaaaagtggaagtccagctgaggatacagagaatgcaatgataattgtttcaaagatgtttgacttgatgtagtaaagagacaaccagccattgcaacaaagatgcagagcccagaaatagaaatgtgagaagattatgcagagaaaaaatagtttcgtgtttttgtttgtttgtttgttttttgagacagagtctcaccctgttgctggagtgcaatggcccaatcttggctcactgcaccctccacctcccaggttcaagggattctcctgcctcagctgctaagtagcttggctgacaggttcgcactaccacgcccagctaatttttgtatttttagtagagacggaagtttcaccatgttggccaggatggtctcgaactcctgacttagtgatccacccgcctgggcctcccaaagtgctgggattgcaggcatgagccactgctcctggccacaatagttaaagtatagaaacagtgaaactgctgagaagtaacttataaaagaaatagaagatggcaggagagaggcaggaaggcaaaatagaaaaatgatgggaagaagaaggaaaaggacaatgagagtgaagaaaagagcggagagctaagaattatacctctagcaagccttaaaattataaagaagaggaaaatggttcattaaaggacagagaaatggagaagataaagtatcaaaaaggcagaaagaagaagagccagtaaaataaagtgttgagaagagagtaggaggtcgattaaacaaggtcaagttcacaattttatgccatactgttactcaaatatatatgaaatcttgacatgtgtatttgaataaggatgggatatataatacacatgcatacacatatacacacatacatacatatacatatgaaaactggatggagaaaaaattttataatgaaggaaacaaacgaacaaaaaaacacaagaaaataattaaaacttgaaaccaaaaactataaagaatatttgccaactactgtcaaatctgaaccaaaatcaaacaggataacaaaaagaaaaagcataccttctcccttctcattctttaagcagagtgcagattttcctctacaaaatgtgtcataatactgcaaagtcctgctatgaagttttgagtaaaggaggaatatataagataaatcacagaaaaacaatatggatgtccttagtgcatctcagaacagctcaacagaatgacgggacaaatgcatgaagaagcatttctttctttctttctttctttctttctttctttctttctttctttctttctttctctctcttccttctttccttctttccttctttatttttttctttctttctctttcttctttctttttttttttttgactgagtttctctcttgttgcccaagctggagtgtaatggtgtgatctcggctcactgcaacctccgcctcccggcttcaagcgattctcctgcctcagcctcccgagtagctgggattacaggcatgcgccaccgcgcccggctaattttgtattttagtagagaaggggtttctccctgttagtcaggccggtctcgaactcccaacctcaggtgatctgcccctctcgacctcccaaagttctgagattacaggcgtgagccactgcacccggtcaagaagcatttctattctgtgtcttccattttctatttggccagtggggaggaggatccagggcgcaaaggaggctgaggaaaaaaacaggaagtagtgaccatacagcatacaaccaaagggcccgtgaatccacagacttctgagccctacctttttggaaggcaaaaacaagatgttcccctgtgacaaagcatgtaacagggtgagtgagagggttttcaggccacatgctgaatcaaggctgcagtctcttgccactcacttcctactttgcttcccctccacacccaattcttcaacaaactactaattccatagaaaaatgaaaaataatctcaaaggatccaatatggaacatgggtgtagatagtgccaggaaatttaaagggaaaaagaaaaataaacaaagagcaaatgagaacaagtactccaagaggaaaccaaaaattacgttagacaaataactttattttctcaaataaattgtagacaagatggtttcctgaaggaagaagcagggatgatgtcaatgataaaggcatgcaaatgagaaataagaaaaaaacaaggaagggagttaatataattaacaaagaaatgagagtaatataaacatttgagagaaagaaagccacatttgagtaaccaacgcaggattaacagaaataaaaaccacagaaacatgacagacaggcttgaaatatctcacaaaacaaaatagaaaagaatgaggattttcaaatgaccataaatatggtaatagcattggtaaaatggcaataatgtgttttaccataaatgtggtaaaagacataaatatggcaaaagacgtttggcattttttttcttaatcagtattcctgaaaaagagaactcaacaaataaaggagaaaaaataattccaagaatataaagaaaaaaaaagtgtttcctaaaataaaccaatagtgattctagataggcacccattgtttctggaaaaattttaacattgcaatcatcataaacatattctagtgaagttatttaattttaaagataaggaaaatatctcacatgagcatgcaggaaggaataatataaatatcctttgatttctctttctgcacatctcatatcaaacagtggacagtcttataaattttgaaagcaagaaaaagaatgttatactctcctgaattccccttctggtatagacaagtattctggaacaaaacgaaattttcctggaagaattacatgataagaatatccagaagaaaaaaagatacttgtaaataaagaatagagccaagatcaatcaactatgaaaagtatttatataaatgctataaacttaaatgatgtaaaaataatgacgtactataactcgccaaaacagaaaagtagcaaagtaaatgaagtgagaatatatgtgagggtattgaatggttttacggagtgaggagtccaggaatatagtctaaagttgaaatctgcagtaaaaatccataatgtgtctaatattcgtgtttttgttatattttccttaaatcagaagggatttgcagtagttgattagcttgccttgaagaaacatttacttacatttcaacaattcctgtagtttcacttcagcatctctttccttaattcatctaaaattaaatgtaatagctttattgaagaagagaagtataagacaaatcagcagtcaaaacttggggcttgaggcctttctttactggcgtatgtagaccccagctgagagtttaattttgaccctcaggtgttagtgctgctaggtgttagctgacgtcagatatttggtagcactgattgaacagtctaagaactgcaggaatatacatgttgcattcaaaggtaaaacaaatcaaggctctatatctgcaaaggttttttttttaaatcatattcataggaaataaaataaaattaagccaaaggaaaaaaaatgcaatgacaaagatatctattacagcaaacatcaaattaagaccaataaaccactgagtgcatactctggagacattgtgcctttccaaatggcgtaatgagagtgtgagtacaactcacgctgtcactctcctgtcagaaaatgacagttgcctgtatcagttctactcccagagcactgactatcacagagtgaaaacttggatgtgacagcaccaactttctgccctccaagtaggagtctgtggggactgaaccagtccagaggaagaatcatcgctctagaaggagtgagtgtgtaaatttaaatcatcagcaaagcagaacctggttactgaaggcaggagagctggttccaaattatctccctcagttagtccccctccccaactctgacaaatgaattaatttacaggtccatttctgctaagttaaaatgcatctatcttctcctgggattttcttcttccatagaaatggagttttctctctccccagtgtcggctgaagctttcaacagaaaccaaaattctaaaataagaaatcctttaaaatatcagatccacatctccttcacctaagaaaaatatataaggccttttacatttaaaaaaaaatcttactttcaacaaatttcaaaatattggcacagttggagttatgtaaccatcaatcagcagtgtcatatctgtgtaatgtttcatatctcaaaacatccatttgctcttcgttgtagatcagatgttagctctactttttgagaaaattacacactaaaaacaaaaataaatgaacaaaagcaaacaaacaaacattgtaagtcctcaaaaggccaagttacaatgtgagcagaattgggttgaactcagaggtcctgattcaaattctaggtatgtgtcactgtcttgcactgcaatagtcattacctgggatctctggagggcattagcaaccatcattcaccaatccaacaagtttttaaaatatggtactttgacaacgtgagcctactgacaagaacctgcccacggaatcattctcatgttctgtggatatttattaagccctactgaacatataccattcatgaggctagggagttcagaactgagaacacagatggaaaaaaaagaaggtaaacaaataattggattgtagagtcagaaatatataataggaaacatactcaaatatcctttactatatataccttattgctgcactattctgcaatcagtcattaaatgcaacatatgatctctggaaaggaagcctataggggtattaaactgtgagtgttgctggaaatgttcttcacagagtgcaaaaaatcatcaacattcgtgctgtattgaatgccaacatattaagatttcctccaggtagcaaactgtaaagctaaagtttttgataaaataatgacataaaaagttaatgtcgacttgtctgccagatagtttgaagatataactgcctgagttttgcttttcttttgttgattagaatgacaagagtaatgaattttcaccattggaattgaccgtcctacatgagaaaagatatttgaaaatctaagtaccaagaacatactgctctgccaaataatgaatgcatgttctttcgtctgaagttaacaatcttaaattaactccaaaatatgaggacaaaaacttttgaaaatttctagtaagccttcagaatttgaagtgtgctgacccacatctagtacagagatcttttcttcgcttccttttatttctccatttctaatttcactccatgttcctaagaatgaacataagcatcctcttgcaacaaatgttttattttccattctcagtatagttgcaaatcactatgaaaataaacagaaacggggagatgaactgtattacatttctggttgtcttttctaaccatcaacccaaaccaaaaaaaaatacataatcttttgaatattcactttaaaaagcaaagaataacctgagtgattcaaaacggcgtatttatcaagattatttataattggctttgtaatgcattacgtatttttggcagatcacactagtgagtttgctgaggcaaagcacatagaaaaaagggatcatctagagatttagaatattctgtaataattcacccagaaaaaaataaacatttgatcatacaagacagagtcaacaattaagtcaaagaagagttgcacgtgagaaacagtcaaatgtatttatagagatttgagtgttgcttattttgtagctgggtgaaggtaggcatttgagatgaggcaactgattcaagcaaacagaaaccattgtttccggaaaatgcttccaagagggaggggcaaagagagaaagcagttgtagaggaaataggaaatttgtcaaaactataaacaaaaaacagtatataccttgtccattcttttgcaacaatgatgacatgattctccaatagacagtggcatatagtgaagcctgacttgtcagaggtcagatatattcaataacatattttggcttaacttttcaatcatttatgttcctttgtgatgttgactatatgtggatcagctgacggctaaagatggaatcattattctaatttcaaagaaaatggggcaaaagagtgaatagggaagatcacacttattagcactattggaagaataactacttaacttcttagaatgtatcagaagtattattctcaaattagaagcagtctgacatcctcagatggagattaaaataattataaagtgttcaaaaatctctgccatgggatctaaatttgcagtgtttgccaaacagaaagaagccatagacaagcttagacaattttgatgcagactttacaaatttagaagcattcagttgcttaacttggcttatttttgctgaattcaataaagacatattgattttctattgacagtgggaaagttattatagctatcatcatcaatttaaatattactcactgtccaatttacggtagtgtgtgtgtacactatacaatatcataaaaattaaaatgtgtttaatatagctttcttatttgctagtataagtaaatttttaaaataagaaaagctaaatattacatatggtttttctagatggttaaacaatgccagaccatccagtgtaaagttcagttcagtcaactattgtaatcatccagttgctaagccatgtctaatttccatttatttttcaagccaaatctccatgttttggctccatgtttatgtttttttcccagctgttgtgtgtattttgtaaaattgtgtctatcaggtaggtgggtttggttgctattttctatagtgtattatttttggattcagccttaagctttcttgttctgcattgagagttatgttgatatttcagcaagagactaccagaaaaagtcattaattgttcagacacagtgtaaaaaaatattatgagccaaaacaattattgaatttattttgcaggaaaccattgtctcaccacttttagcccttagtcaaacttgatccaccctctgaaaggctgttttaaaataattgtttctataggttaagtattgatttctcaagcctgcaataggcaccctcttagaaagggtatttcagggattccagtgggataaatagctacagttgtgcctcatcctccccttgatttcaaagattctcaaaaattatgtgtaaaaaaaaatatgaaagacaaagctatttatagactatgaaacttaaattgtcccttctgatgcattgctagaaatatgaaatggcaaatggtgatttttagaataatctgcaagacaaaagttttaatattcctgaacactttgagacttcagatcccctttcctaaaatcatgtttgtattgctggtgaggcatatattccaatcttatttttttcttatttttcaaaactctgagttaaaataaaaaataagactgggatgaaaacattttccccaaattacagaatcatctaatttcaaggcttaaaaaggacattgactcatcaagtgcaacattatattcctatttttcaattcccactccacaccatctggaagtccatccccaacttcaaggaaaaggaagtccatacttgagcatcactgaccattaaaatagttcgtgataatgtcagaatctgtcttctttgagtttccaccaatttgccgtcattcaagcccttgaaactgtatagaatagtctaccttccttccacataaaaacctttcacactactgaggtcaactatcaccttctccaccaccagcgagattagtgttcttgataccagatattcccaatttcatccactattccttataagatatcaggatgagttctatctttgttgcctttctcataaatttaccctaaattcttctagaactgcaaaacccacaaagtattgtcttactccagatatggtctgaacaaataagtgggactatcactttctgcatattagagtaggatttttgcatttgtccccataacatctcaatagtgattccacctaaatttactatcagctcaaatccctaagtcatacacatgctaccaagtctcactttttcccttttgtaactgtcttatattttttaatccaagaatgggatctcacaattatcattgaaattctagactatcaatatagtctaccaaaaattttatattctaattctttcattccatgttatctgttagttttacaaatattttgagtaactttatggacaaagcctttactcaaattacaactagaaattccctggccaggcatggtggctcatgcctgtaatcccagcactttgggaagccaaggagggtggatcacttgaggtcaggagtttgagacaagcctggccaacataatgaaaccctgtctctactagaaatacaaaaattagccaagcatggtggcatgtgcttgtagtcccagctacatggaaggctgaggcaggagaatcgcttgaacctgggaggcggaggttgtggtgagccaagatcgcaccactgcactctggcctgggcaacagagtgagactctgcctcaaaaaaaagaaaagaaaagaaaagaaatccctatagtatgatatttattcattaatttgtactcttcaagtatagtagcttacttcgtttaataatttgcctaaattccttttttttccatcttgtccaccaaatagtgaaaaggtatgtcagattccttcatacaatttaagcaccaccaaataaatttctgtgatctgtgaggttagtaacttgtgacaaagaaagtgatgaatcttgttttcatgttttcttttttcaggcaaaccatgctagatctttgtaactgttattttattacaagagattacaggacattctttaataattttagagtctctgctgtaatcagtatcaaactcagagctttggcttgtaaaatccacgttattttgctgaaaactagatagtgatttgcccttcaccagtcttctattatttgctgtgatttctcttagacctactagttctgctgtttctgaagtcttgcaggcaggcaatatctttgagttcaacccagttaaactaggagccagaactcccggagagcagcagaagagtgagtaggggcaggagtcacttacaacttcttaatccatcatggatttcagttcccacttactaataactgtttcaccttttgagtttttttcagtacaaacaagatggaagctaaatggccaatgaggaatcttttttttttctgtgatatccgtcttcattgaagttcttcagagagctttagtactcttcatagtttaaaatacaaaactatcttcttggttgtccaattcagtttctgcagcccccagttggttagaactttgacttccagcactcctcctatgggcttctatgatactatattcgctactgaatcaagggctgattcctcttatcctattatggacccaatgagcttttaatgcagaaattctttgaatgggtcttttgcaaacctgcttattaatttaagaagtttcctcttttctcctttattgaaatcatttagaaacatatagataaaatttcacttttaactttttgaaccatcttcctcttcagattcttagtgtataatcaaacctattccctttccaaaattatgaaatttgcatttctacttagaatactggaaggtggattttagttttcccagaaatataaagtttcttggggcaaaatatagaatactgggggcttctccacactcggggctttggaagccacactgtataagactattgtgtgtttttacccaagtaccactaatgtggaacagtggcactgtttactaaacggtaagttttttatattctaaatcttatgatcacagtgggtctgctttaagtttgatatatttataaacaaatgtattttcttctggtttattcttcatatattctaaaatatttagatttaaatatgaactatatgctcataagcttggctgactctagcaaaaagtagtcttctataggaaaattgtctttgtttcccagacttctctttgctgtcattcccccccattggtggttgcctagtcctcctattcttcagtttctcagtgctctcatagtcctgcctcctgtgactctaactcaatataatcacatatttattatattcacaatgagttataaatatctagaagttgttcttccctggacataactatgttaagaagcatcagatgctgctaaaggctttcggaagagaaatgaggaagttcattgtcaatcactcatttattcttttactcaataaacacttgtagagcctcccctatgtgccaaaacggtgtcaggaaacacaagatcattgcagatgaagttcctgaactctaacaactctccttgtaggagagagagataccagaaaatataaggggtgtgaaaaccagaaaagattaattttgaattacaatttcagcttagctatccaaaaaacgattacatcccattcagaaaagcatgtgaaaagggtatgaactagcatttcagattttgaagactgcatcagggtgtacttacggtgaagggtcccaagtgccaaagcagctagagaaaaagcaggtgctggatcatgagggactttatgcctaaggtgagagttggactttatctctaaaactgtgggcaatatctaaagcataattttcttggctcctagagacaaaatgtaggtggcttcttctttcctctcagcccccattttaatagaagagaattttgaaagaagataactaagctttatacttctacactatcaatgaaattacattttttagcattaagaaaggtatggacacgttagaatttaatgtaatatttgtctgatttctcatgatgtgagatttgtgggcttatgatagtgtctgtgtaaatatatatatatatgcaacattacacatgtatatgtgtgcattatctattaaatatatacttatcaaaatatccaactttcatgtttataaacttataattcacaggcaacaatggcaaatcagagtggatcttatttttaatctgcctagcagaaaatttatttagtatatgttttactataattatcctaataattgttccactgtacatagggacttttcccagagttgagtaaattggttaggaaataaaaggagctatactgcataaaaataacctaaaattaacatctgcaaataagccaggggacgtgtgtctgtctctgtgtatcataagcatttctagagactgatcatctgacttagtacttttacatagctatcctttccctacttggccccaagagaatgttatttctcatgattggtttatccattgtattaaaacagaaagaaataatacaattttctcttaaatttcccagtgcctcagttcaatttcctgctggtagatttctgctttctttttatatctaagaaattatactctttactttacaaaggacagtgcactgaccgactgaaatgaatgtgcttgtaatagaacagtgggcagcagcctgccaggcttggtgaagagtgcagcctgctattgctttccaaggaacagtttctcccacagctttctttcaccaaagtgtgtctattgccatcaagtcagaaaggaatgaatatttgcgtggttggggaaaacaaacctgctgttgaggaacaggttactttaagccggaattatctaatcagactgtaccaaaatcaccaagcaattgctagctctggacttagcttttataaagcaacgacaaaatgagttaataagttaaaaaaaatagaggaaataatcattattgcccattgggttattctgaaatatggcttcttcagcaaacaacagggcaaaagtatattatctgtgtttagggcccaagaccagatggatttataggatataaaatatagccttaaagatcccgagaggtttgaagccccagaattcctccctgcactgactgttttaataccctaaaatgtcctcaacaaatgatcagttgtttggagatgtgcattatgggattgtgggattcagaggctctagcaaactcttgaaacaactgtgttttccacaaggttttgatgagtggatttgatgaacagtctcagagcaatataaaagcatgtgagaaacaaagaaaaaagaccagagacaaagaaacaagaccagttatgttaggactttaacccagagctagtgctcctggggccacgcctctcaaaaaacttctgccatttcccacttttccgacctgccccaggcagaggatctagccaccagcagaagaactaagtgagcagattaatgccaggggatgctgctgggtgctgcaggctagtagggtaggtaagtccccatgaaatttcagaaagatttgtaggaggcttacaaaagtacacaaaatacaaacactgttgagttgcaagtgaatcaaatcaagaaagaaaaataatattgagttaagtgcggtccagaagaagcctaaacagaggacattagcatgtgtggattgctacctggagcattagtgatcagaaagagcatagtagaaacgctatgcccacaggaagactgagtgtgaaaatcagaagagccaaacctgtgctaaagaccagagaaagagaaagtaagacaagggtgagaataataatgatacaaaaaaccctccagtactaataattaatattaattaatattgaataaataaaataatattcaattgtaatattgaataaataaaataatattcaatattaatattgaataaataaaatcattaatattggatgaatattaattaatattaataatattaatactaatgccagaaatgtgctaagcaattaatatatgttaactcattaaacactttcaagaactatgatgtataatttttattgctatgttatatattagaaagctgagaggtgaagaagtttcggggtagagtatgctgccagagccatgatttgaatccagctctgccagaattcaaggcccatgctctttatcactcttagacagccaagtaggaagtgaaggccaagtaaacagaagaatgaccaagaagtgaagaacaaagtggggggtgaaggaagcagatccatcagtttctctagtatattttcactgatggttagtagtggtaatgggttatagtgcagaagaataatctcttctattatctcgataaccatcattttacatatataatatatatgtaatacataaatatatatatttttatatatatataagaatattgccacttctgtttaatagttttcaaaaaataaatttccttccaagttcctattttgggagaaattaatgtatttgcaaccgagggtagtaaaaatgatcaaattattgttctaaaaaaatactaaaactgcaaaaatacttggtcctcaaaatttaggataatactatctgatttccctaatgtatctctctttcaattcattcacttctttcttcaataaacctaccttaagagtttactatgtgataggtttgcaataaaccctttgtaatgcaaaagactaatacatttgtatacaattatataaagcactttacttgaaattaattttatacataaaattgtatttatgtgtatgttatgtatatgttcaaatcagggctgccataaatgccatggagaagttcatggtgctgtgaaagcatggagattctccatattcatggcagttaagaaatggtttccaaggggagtggtgtgtgctgtgaaatctgaaggatgcctgggagccaccttgttgagagagtgtgtgtgtggtgtgtgtatgggtagggggtgatatggtttggatttgtgttcctgctcaaatctcatgttgaaggaagggcctggtggcaggtgattggatcatggaggtagacttcccctttgctgttctgatgacagtgagtgagttctcatgagatatgcttgtttataaatgtgtagcacctaccctccatctcttttcctccttctccagccatgtaagatgagctgcttcccctttaccttctaccacaattgtatggttcctgaggcctctctagctatgcttcctttacagcatgcaaaactgtgagtcagttaaacctcttttctttataggttacccagtctcagatggttctttacagcaatgagataactgactaatacagaaaattggtactgggagtggggcattcttataaagatacccaaaaatgtggaggtgactttggaactgggtaatgagcagaggttggaaaaaagtggaaggcttaaaagaaaacaggaatatgagggaaagtttggaacttcctagagacttgttgaattattgtgaccaaaatgctgatagtaatatcatcaatgaagtctaggctgaaaaggtcttagatggagatgaggaacttatcaggaagtaaagcaaaggtcacttttcttatgcattagcaaagaagttggaggcattgtgcccctaccctagagatctatggaactttgaaccagagagtgatgatttaggatatctggcagaagaaatttctaagcagtaaaatgttcaagaagtgacctggctgcttctagcaacctatgcttgtctttgtgagcaaataagtgatctggaactggaacttatattttaaagggaagcagagtataaaagtggaaaatttgtagcccagccatgtggtagaaaagaaaaacccattttctgggaatgaatccaggcgagttgcagaaatttgcataactaaaaagaagtcaaagttaatggccaagacaatgggaaaaaatgccttgaaggaagcatctcctcctgtcacaggcccagagggctgggagagaagaatggttttgcaggctgggcccagggccctactgtcttgtaaaacctcacaacgctgttccctgcatcccagcagctccagctccagccatggctaaaaggaccccagatacacctcaggctactgctccagagtgtacaacccataagatttgatggcttccatgtgctgttaagcctgtggctgtgcagagggcaagagttgagacttgagagcctctgcctagatttcagagggtgtatggaaatgcctggatgtctaggcagaagcctgctacagtgacggagccctcatggagaacttctactagggcaatgtagaggaaaaatgtgggattgcagcccatacacagagtccccaccagggcaatacctagtggagctatgagaagagggccactgtcctccagacctcggaatggtagatccactgacagcttgcattatacacctggaaaagccacaggcactcaacaccagtccaggaaagcagctgagggggatgcaccctgcagatccataggggtggagatgcccaaggccatgaaagcccaccccatgcatcagtgtggcctggatgtgagacatggagtcaaagaagattattttggagctttaagatttaaccactcccttgctgggttttggacttgaatgaggcctgtagcccttttgtttcagctgatttctcacatttggaatgtgtgtgtatacccaatgcctgtacccaccattgtatcttggaagtaactaacttgtttttcactttacaggctcataggtgaaagggacttaccttgtcccagatgagattttggactgtagatttttgaggtaatgttgaaatgagttaagactttggggaactgttgggatgggatgattgtattttgcagtgtgagaaggacatgagatgttggaggggctgggggcagaatggtatgtttttatttgtgtccctgcccaaatctcatgttgaatttttatccttggtgttggaggaggggtctggtgggtggtgttttgatcatgggggctgatttccaaacccttgatgttcctatcatagtaagttctcatgagatctggttgtttaaaagtgtgtagcacctcccccttcactctcctccttctcttctggccatgtaagatgttcctgcttcccctttgccttccgccatgattgaaagtttcctgaggcttccccagccatgctttctgttgaaccatgagtcaattaagccttttttctttataaattacccagtctcaggtagttctttatagcaatgtgagaatggacgaatacagggggtagatagaatatttctgccagaaggcatagcgtatgcaaaagttctttagtgggtgggagcagagagcatttgggggactgaaggaagccaatgggactgaaagatgggaatggtgggagtcaaagctgcagaagtaaagaagagcccaaccagacagtaccaagtgggctgctcaaacatttctgccttttctcactccttatttatgaaggttgggcacaaacatttgtctctagctctattatgtgtttcagcaaaatctaccgaaactgcttcagtatccaatatttttatcttttgtaataaatggtagtaatagaatgctacagtacacaccttaaatgagcagattttcaccataagcatttttaaaatgtccatatagacaaggtggaatgttgcttttctgcttgtgttttaaaatatcccctcccaactgaatgattatggtgacctttgtttgtgatttagcttcaaattaatatcattaatatatttttgtcattgttgcactatttcatcaccttgaattcttacattttcatctttattggaatctctatgttcatcagacacattggccagtagcataaataatcatgttctgatcagtatttacaaacttgtaatatctgaaatttatgaactgaaattatttctatagcagtaaattttatgaattttattcattaaatgtatgtttaccttgcacttattatgtgaaagattgtaaaacttcctaggacacaatgaaaataaactttaaggagatatactaggttaaatacatgctgtggttataagactctgagcttcatggagcaagcactctatctatcctgctcatcactctacttccagtacctcacaatctatatggcacaaagcagttcctcaatgaacagttatttgaataaacagaacagaaattaaaggaagaagtggaatggatctatcacattttctttaaatccaggattggttctgattttatttctgctcctttgttttgtataagaatatgtgtgtgagtgtgtgtgtgtgtgtgtgtgtgtgtgtgtgtgtgtgtgtgtgtgtgtgtgtgtggggaggtgggtgggtgtgtatctaatgcttaatcaagagtttatttcccatgaaaaacacaaacaacacacagacacacagacactctcacacacatacaaacatacacacaatgataattaattcagaacagtgttcttgattcatacttttccatggttggaaagatcctatgtgtagattttccaagccagtgctttgcaatcattgccagcaaagtaccctattttagaacatatggtgtcagatttcacaaaatgattcatatttcctaggccttgtgtgaaagtaggtgtttctatttgggaattactgcttaaacaatgactattttgacaagaagcaacacattttttttttcttccagcacatctcttgcttaggtggaagctggagaaccaattactagtgtgattatcctaagtgtattcttacatgttttcttctctgtgaaaatgtttctattctttctgattataaatgttactggatgtgatgtgtgaatcaatcctatctgtgcagacacagcagaatgaaaggtataatgatgtaggagtgaagtgtcaatgaataattcatatctgacagcatgtagcattggattctatcaggcaacattccatggcagagaggtcctcaaaggcttcttaaattcatctgcatcagctcattgtgtttctgctcgggtggcagaatcgatcatttagaatgagggaaatgatactgagtggcactgcttgctaacacagatagaaaaatatgtagctatttttgtcaccatcaaacattaattcaacaaatgttcattgagctcttgcttggttctcatagggtgttcaaagttggaggatccacggagtataacacattctctgactccacagagcttatcaccattactatagatacataaaatattacacctgactatgattcatgttatgaagacgtccaaagttagctgagatacattccctttgcttcaagaagaatttgaagagtgtaatacatgaagaatatacttccatataatggtccagaaacaggttccttttaaaagtgatgaatatgagcaagcctttttcttattagagtcttagagaggtcactgcagcatgtggtgagatatttactaatgcatgccgtttttacctaggaaacaactttctatgaaatgtaaacacagctgtggagtttaattcaggatcctcatccttcttgtattaagctacattggaaaggcgttcaaatcagccttaaaaaagagaatcagttgacttcatggcagtagacccctgaaattttggaaaccagatttttaagactattacagttagaagagctgagttaaaaggtttgctttggagtaaaactggtttggtttgaatatcgctctgttatgtgaccttgaacaagttttcagcattactgaactaattcctcatctgtaaatggggctaatatttgaacacctatcaataggtggtataagaactaaagaaaataggaggctggatgtgatgcctcattcctgaaatcctagcacttttgaaggccaagcaagaggattgcttgaagccagaggtttgagaccattctgggcaacatagtgaggctctgtctctgaaaatttttttaattagctgggtgtggtagtgtgcagctacagtccctgctacttgggaggctaagatgggaggactgcttgagcccaggaggtcaagcatgcaataaaccaagatcctgccactgcactctagcctgagtgacagagtgagaccctgtctcaaacaaacaaataataaaaagaactaaggaaaatacataatataaagtgctttcaccattcctgcattttatagtgtcaaataatatcaaggctcctaggaaagtctctattcatttataatattaaatttcatttagcaacatgtaaatctacttaaaacataggcttatctacacccaaatcaattactaaggtttttcggtataaatgatttagggtttgtggcagtctgttatgtaagtgacttctagtaaaccatgcctcctggtaatcatgcccttccttgtgtagtgccctcctcttgaatatgggcagcctccctgaccaatagaaggaagcagaatatgcactgtgccaattccaggactaagctttaaaaaagtctggtagcttctgcttttgttgtctagaaagccccgagccaccatgtgagaaagtctattaccttaatagagacaccctgtgtttcattagacacacacccacacacacacacacacacacacagagagagacagagagagagagagagagagagagagatcctaactatattatagaaagacatgagctcaaaaaactcagtggcccagccaattcaagcctctaactgacccatcagctaaataaagccacacaagtaaccactggcaagaccagcagaagaaccatccagcagaacctagcccaaattgagaatagtaagcaaacaaaatagttttttgtttgtttgtttaaagacgctaagttttggggtgtttacttgaacagcaatgggtaacggaatcagggttatttccctttctttcattccccctttctaccagacacattttttagattttttctcatatgtcctcctttcactaatcaccatttggtagatccattaaagtctttttacgttgatctaaaatgtaactcttgagtcatttacgacagttatgacatgtgttaatcaaaataggatttggggaaacctgagatgtccaccctacttgctgcaatggctgaacattatatcaaatctggacttatgagtgccatacagcttcataaacattgaagcacctaacatttttcatgcttttgcaacttactatgacttgccgttgactcatcatggcctgagcatttaaaaatattatgaaatatatttgaattcataaaactctcattttccattaatctgttcttctattaggttttaatattacttaaaattgcaagaataatttttgtctagggcctgagttcaaaataccacctgctttaaaatgtgtggtattttcagaattaaaatagcaatgtatatctcttcaacttgattctcactgcatttctttattaagttaggcttttctgataataattaaccagttaagcagccctaaatataattaattttttaattgaagatgagtttgaacaaattgaaaagtttatcaaaatgggtgattttttagcctcatgatctagctgaatcactttatcacaataacatgcttttgcacaaagactacttaatgtgtttttgaaataaacgcatgtggtcccatgagagtatctttgatctcagacatgttggtaccatgtagaagactttgaatttgttgcttaggtttataatacaagcaagtgattcttctattgatactttgaaaatattgtctactctgattggaggaataattaatttaagtccctctatccctgagtaaccctctgttagtgttctctggagaataagaatcaataaatttctctctctctctccatatacatatgtgtatgtgaattcatatgtgtatatatatttatatacgttcatactatacatatacatatgtattcacacacacacacacacatgctatgtaaaattggctcatcaatcatgggggctggcaagcccaaaatctgcagggtggcctggcaagttagagacagagggaagacccactgtttccttttaaatctgaaggccatctgctgcagaattccttcttgctcaagggggtcagtcttttttctattcaggccttcaatggattgcaagaggttcatccactttatagagaataatctgctttactcaaagtccatggatttaaatgtcaatcttatctgaaaacaacctcatgggaacatcagtatattgtttgaccacatatctgggcactgaggccaagcccagttgacacataaaagtaaccctcatacccaccttgagatctgagccaattgagagagagtctcaggtatcaaatagatggagattaacagtagtggtgtttgagtagaggccatggcttggaaacgtgatcaaatggacttcctgctactcaaccttccccatagtaatgaccaatatacagatcgtcacccaggaattttgttatgaggaagagagaaaagtgtgtgcagagggcaggaagaaagcccaagctctgtgcattacacttttctcagtctcattatcccatgtcactaccttcctttggagaagagtgcctgtggaggcacagaggaggctccaagttacttgttacattattctaaaagaagcagaaattccttttaaacaagaccaggcaggtttgtgtggggagagagaggatcactccctaaaatagcattcaaatacgatttttcagaacaattctggtttctaaacaatcatcgtgatccagaatctgactgcctgtgcattacagacttaaaaattatgtaaaggatagtatttggcagtaatttagaaaacatatttctcaaagttttctatttagaccagtactccttttctctaagaataatgtgagattttgatcatttgtacagctttcatatttttcttttatgtaatctcttaaaatgattcacagaaacttaaaaatcctactagcaaaatagcccatcatgatcaaatgtagctgcattaccctttttaaccagaaagccagtaaaacatcatttacatagtattaacatattcatgtgttattcaaagatatatcatctaaaagagtgcacaaatactcagaatatttttctctctagcatcacagatatcaagattctgtaaattttttgatgagtttgtttcttgttaatataagctatgttttcagttgtattaagaaaaaataatcttgctttctttacatcatcactaacttctaaatcacccaagtcatactctcaatatcataatgcactattgttttaaaacttagaaatacagcataaagtcttcccccatcctgctttttaaagcctttgctcttgccactataaacttcagttttctaaaaaaagaaattgtaacttttaaacaagaatccaagaaacacacaacatcctttttacttctttgatgattcctcatttaggaaccgaattattctttaatcatcccttaaatgataagtgtctctggctctaatctttaatcatttattaaaataattaattcttcccacaataatatattaaacattttcctataattggatatattaatttctagttgcctttaaaatatacctatcatcagaccacgtctcaccatcaacatcactcaagtcaccatcactcctcactagagcaattgcaatctccctgatcctatgtttttgaccttgcccctttgtatctattctccacagcgaagtcagtgggatgctgttaaagtcgaccggctgttctttgtcttcttatgaccctccatagtattgccattaaactaaaaataaggcgaaatccttaccatgacctagcagtccctgaaccatctcgattctcgtcctctgaattcacgtgcaatgacttctcgccacattcactgcagtcttttcaacttacttgcagttcttttaacctgaccacatgctcctgcatcaaggttttttctcccccagaaagcccacccttttgtttactgagctccctgtgcaagtaacatctgaccagagatgccttttctgaatattctgtctaaaaagcacctccttgcccacttcccatacaatgatccttcttttcgtccttatcaccatctgactttttttatatgtttaacttttcattggtatttttgtctcccctagtgaaatgtaagcttcatgaaaagaggttgcttgtctatttgtatactatgataacccctgaatgtgaaacagtgccggaggtgtgggagacactcacaaaaatgttttcagtgaatgaatggtaaacagaaaatgtcttagaggccccatcttactttggaataaaagtatataaataaataatgatgagatggtaaaacaaatatgtttatcgtgtatggaggatatatttatatatttatagtgtataattagatatattaatttccagttgtctttaaaatatatccagcatcagaccacatctcaccatcaccatcacccaagtcaccaccacccctcaccagagaaattgcaattcccctgattctgtgcttttgaccttgccccattatatctgttctccacagagaagttagtgggatcctgttagactccttgttctttgtcttcttatgaccctccatggtattcccattaaactaaaaatactactttattccaaagtaagatgcagccactaagactatataaatatatattcaagaagaaatgtattctgcttgggagagctgaaagaagctttgaaaagccaaaggagtttgagttaacagatacacaaaagatttttaagcaagaaatagcacaggttaaaacaaaacagtataggtcaatgtacagagagataaaagatatcttgcaccttcagaaaatctttaaatcttacagcatggttggaatatattcagatcagccttatttgtaagagtactccttggtcaagttgtctaaaattttcctccttctacattctttcctccacttatgatcaaaaaaataattatttccaaaactgatggttcttatggtttttcatatccagtttcaagaaacatgagcttcaaatttgtatggtgttatactaagctacatttatgtatatttacattatattttatgtattatatgtaagaatatatagcttatttacattcgttattttgatttgtaaataaatttgttgtaataaatacatagctctataaaggtcaaattaaaaatctcccctcatactatctttactcttaccctgccaaggtaactaaagttaatacatcagtgttgtttctgtccttctatatgtatatatacatgcatatatatttatacctattatcataaaaattatgtagttacagacatatttatatacatatttaaatacacatattctaccaatattggagtaaataattgtctctcatgttcgcatattttatttcatttttctttcatagtacacctgcaaattagctggagctaaccctatcttattggcaaggaaactagcagtgatgttgaagcagcttatccaggatcacacatgaagtggcagattcaggttttacaatgtcaagttccatgcccttttctgaggtcccagccccttctcatcctgccattttgcgatattttagaacaagtgcaacttagtgatgtacttgatacctggtcattgcatcaggaaagattagattaggctgagtgtgattgaaaacccaaatagtagcaagctagtaaaaatagaggcttatttctcttgcatataaaagaagtctagatcgaggatgtcttggtgccctatgttgaagagcttagttttctttgatctctctgctgtattgtgtgtggttttattctataggtgacgtggtccaaggtaactgctggaactccagaaagtccatccatatattaacccacaagaaagaggagattatcttcttttatagataattcctagaagatgtgcatgtaacatttacttatttctcattggccagaacttgtcacatggaaacagcttgttgcaaggggttgtggatgaggggccgtctattctgagcagtcataagtccatctaaaaaattatgggttttgttttcaaaaaagaaaataagcatgggtacattggaacaaagtagaattgtctgctaaagtcatgaaacagctttgggctatgcttattagacagaatattacttaacacaacaacatccatgctactacaatattcaagggtcaggaaactacatcccataagccaaatttgttctgtccccagtttttgtaaataaagttttattgaaatacaaccatgcccattttgtttacatattgtctatggttgccttagcactattgcagagtggaatggttgcattagtgactgtatggcccagagactctacaatatatgctatgcaaccatttacagaaacactttcctgatgccttcacttgatcagtaggctgaagttttaaaaatagactcaaattttaaaaactacctcccctcaaaagaatcccaatacatgtacagttgacctttgaacaacacaagtttgaactaggttggtccacttatatgcaaatattttttcaatatattggtaaatttttggagatttgtgagaatttggaaaagcttacagaagaattgcatagcctacaagtattttaacaattaagaaaaagttgtgtgtcatgagtacataaaatgtatgataaaatagatactagtctattttatcacttacaaccataaactatatacaaatctattataaaaagttaaaatttataaaaacttacacaaccacttacagaccatacatggcaccatttgcaatagcgagaaatgtaaacaaatataaagatgcagattataactcttgtacatactatactacggtaataattttgtagccacctccttcctattgcagggaacttaagtgttacgaatatctgcttaaaacatggtgtgacactaatatctccccatgaggattcctgtcttcagtaaattgtgaacctcagtaaaaagtgacctctcatggttctcatgtgtttttcatcctgtttagtgcaatactgtaaacctttaataacagcatgggacccatacagagtgccactggtgatgctggaagtgctccaaagaagcagaaaaatgtcacaacactacaagaaaaagttgaattgcttgatatgtgccatagactgaggcctgcaactgcagttgcagacaattcatcttataaacagacaatgtaaacttacagcacaggtacatatagtccaatattgtaaatgtatttttctcatggttttcttcacattttttggcttactttattgaaagaatacagtatctaatacatagaatatacaaaatctgtgttaatcaatcatttatattatgggcaaggcctttggtcaacagtaggctgttaggagttaagttttggggaaatgaacagttatacatggatttttttttttttttactgtgtgttgggagggttggtgctcctaacagttttgtgggtctcaactttataggatattgctcaggagtttcaagtgagtagatatgttggtatttacaaacactgtgggcttaggaattatggttattattctcccagtatccaaatcctggcacattgcttactagttgggtaaacttgggtaaggtttttgacctccctgtgcctcagtttgccgtctgtaaaattaggatacaaatcctgattgcctagtaataaatcaattaacgtatgtatgtcacttaaatcagtgcctagtgcataataaattttaataatcatacctattattattctccccttttcaaaaatgaggatggctttaatttaattagcactagagggagaactatagtcccatagagtctaaaattttcctacaagcaaataggataaagtagtgtaacagcaatgctcatcactctcttgcagtgattttcctgcagccctaattagccacacatctcacgcccatgatttctggtcatgtactcttttttcctccccattctgctacctatttttgccagcgtatctttacaattttcatcagaaagagaattctaaatataatttcccaggaaacttctcaggtttccattcattcttcattatcattgaaaagaatagtacatcaaatgctgctgataggtcaagaaagataaatactgagaaatgaccactggatttactaccacaggtgcccatggtgatcttgataaaaacagtaacagagaaatgatgagggtgaaaatctaattggtttggaagtgagagcaggaagaaaaaaatggaaacagtgagagtagacactttttcaaggattaactggataataaatgttgtgtcccatggggacccacatatgtgtgcaaatgattgattactacatagttaatgatcttctatctgtcacatggcaagcactctgtatggcagttgcagttgctgttaatttttttttttcaaaagctccaggaaaagacagctttctttggtcacatctttcaaagtctttatatatttaatgttaaaaaacagaacgcctagcctctgcttcagactcatcttagtctcagtgtgtaagctactatttgaacaaagatcagcaatccagtttgagggcttgatggggtgaaagtgcagtgggggtgggagaatgttgcaggcggtccctgtcatctgggtcagggtctcatacggaaacttgatcccttgaccttgcttgctctattctaaaatctgaattcttctcgtagcttttatttcaaatagtcttgactgctcctttcgaacctctgtcctcacaattgctgttagattttctctgggggaggaggaattatgatgaccttatagaagttagttttataccctccactggcatccatgctgacaacctatacattgttccagggttgaatgcaatttgattggaaataacctcaacagtgaacttgaaatatcacgctatcaaataaaaatagaaagaagaaaatctaaagtctctttctctctcacacacacacacacagacacacacgcacacaacatagaaaccatgctggtagccctagaatttgtcctttctgatttttaatttggctctgtttttgaagtaaacaagtgtctatcataaatactgtgaaatttatggtaggattttactcccttgtatcacaagccatgagtgcttctaagcagccagcctttatgcataaactgcagtgtgtgagagcttcaagcttatttgaaatggaagtggtgtttggtgagatgggaagaagggatgtattttaaactaataaataatcatcatccatgcctacttggaaaatagctttcttgtcgaatagtatttcaatatatagtatcttgaaataagactgccattaataatgtaagcatagcttgccatataaatcctgcaaatatgtacatacatgaggcctaaattactctctggggccacctttttctgcttaaattacctttaggaggaacccatttaggtgatattagggccagttaaggagagggataataaccatagtagacctagcttttctacttgctgacatccctgctatgccaggctagtgaacaaatgctcctggccatattccacattcataggtcagttttcttagtgactagtgaagacacagaattaagatgaggtcagattcatcctaactgtgacctacaccacagaagagactcctaaacaaacctactgtgtcactgtgggttctgtatctgaatttcaatcaggaggaacaaatctgtcagaatccttgtgtgtgccagtggtattacgctgacctttgaattacaaatagatactgagaaagaaatcccaggagcaggcaatatccattaaataacaattatgaaaagctgtttgccttttggaatagcttttcccataatgaggatatgagcaagctgggaggctggggagtggtgggactcaagtagggtttctaattctgaattattcatttctcaaatggagagaaatcgtcaaagctgggataggaagagaaagtcaaggaggcccagaagcctttcttaaggccaggatttatgtagaaagggccatggagacagggctaagaatctagaagagttagactaaaaatctggctcctttccttcgtgagaatgtacatcatttgggattgattcagtgtgatttttgatatgtctgagtcacctaagtaaattctgtttctcaaaaggtttgctcccagaaattttttttgtctgtcaacatttattatttactttggatttggccagacaatataatgtgcgttgttttacatggttgaaatatatggaatggctgggattcacccatatttcactttaaagtcaacatagggttttccctaaatttccatccttagaatgcagtacaccatgttgtctaagactccagactttggagttaaatggtcctgagttgaatacctaactgatccctaataagttatgtagcaaattattcaacaatttttactctgtcactcatctgccaaataggaataatcgtgcctaacccataggaatagggagaggacaaaatgagggagtatgtttaatgcgtagccaactaaatattgggttgggtatgcattaagcgtattttctcatattgggcacataacaggttctgtataaatgactctgtatttattattcaacttttgctgcagcaacaaacaacccttaaataccagcgatttgcaaaagcaaacattaatttattgatcccatttcatggtggctgcaggtctgctgtgattttgccaggtttggcttggtccagttggtttccacatgacccctatgaatgtgtaaccattctctagggtgcgctgctggcatagaggaagacagcagctcgagaaaggggcaataccaagatgactcaggtgtcttcttagaagcagtgtattgtcactacctgccattgatcaaaaagtcacatggccaagcccagcactattgaaacagtaaagtatgttctacctcttgcaaggcagtgaatggttaggaacaataatgcattatacatactaacaatttactattattaagtaatgatcatgaaatcacaaaattttaatttgttttcgcttttgatggtaatggggatttaaaagacgctgtactttaatcaatttcaatatctataatttttcactctataattattttttcttttatgagtagttttatgtactcatgaacttttattcatgcaacatcttataatacagttattactcttttgatgcacaaattgtaccaaatctgaccagatagagttgctttaagttggctcctgtgcccttccaatgtgtccccattcttctttgagcatttctttactctggcacaagctgtgtccagattatcatttttttattgatacgtaataagtgtgaatatttggtggggtacatctgatattttgatgcatgcatgcaatacgtaatgatcaaatcagcatatttagaatatctatcacatcaaactttattgtttctttgtgttggtaacatttcatattttctaactattttgaaatatacagtacattgttgttaactatagtcaccctactctgctatcaaacactagaacttactctttctattcaactgtatgtttgtacccattaatcaacctctcttcattccacacttcccttcccagtctctggtaactctcattctactctctttgtctatgggattgactttcttagctcccacatataagtgagaacatgcaatgtttgactttctgtgcttggcttattttacttaacataatgacctccagttctatccatgttgctgcaaatgacaggatttcattctttatttatggctgaatagtattacactgtgtatatataccacattttatttacccattaatctgttgttggacactgagggttgattccatatcttggttattgtgaatagtgctgcaataaactaggaagtgcaggtgacatgctgatttcctttcctttggataaatacctggtagtgagattgatggattgtgtggtatttttatttttaatttgttgagaaatcgctatactgttttctataatggttatgctaatttgcattcccaccaacagtgtataaaaattcccctttctcctcatcctcatcagtatttgctattttttgtctttttgatgatagccattctaattgcagtaagatgatatctcattgtggttttgattagtattttcctaataattaattatgttgattatatttttcatatacctgttggccgtttgtctgtcttcttttgagaaatatctattcgtatcctttgcccacattttaatgggattattttgggcttttttggtgttgagtcatcttccttgtgtattctggatacagtcctttgtcagatgaatagttggcaggtattttttcccatcaatagattgtctcttcactctgttgattatttcctttactgtgcagtttttttgtttaatatggtctcatttgtctacttttgtttttgttgtcattgcttttgcaatcttagccataatatttttgcctagaccagtgtcctggattgtttcctctatgttttcttctagtagttttatagtttcatgtcttatatttaagtcattaatctagtctgaatttatttttgcatatggtgtaattttcactctctattgaccggtgatagttgttgagtatttttaattgtgctcatagctataatcatcatcataattcagaattacttatgatagagtgataaagacattctttttataaatgcattctttttatatgagctcttttaataatagtattttagagtggagaaaggaaaaatttatatattatctttctttagtcagtgggaaatcttattctagaagaaaaatgatgctgcaggcagaatagcgaataatgttattagactaattcaccccactcccagtatcctgccacctccctagtcatagtttccttgaataatcaaaacagccgtcatcaactgagtacttacaaggtgacagacactgtgctaagcactttacagggggcttaccccttatttgagcaatactttatgagatatccactacaaatatctctaatacacacatgagaaagttgaaacttggagaagttaggtgacttccctaaagtcatgcagttaggaaaggactggataagactccagagcttccatgagtctcagacactgcactacctccagtggaaatacaaaataatcttatgtactctttttacaatagtatgtaaaagtggagaagcaaaaaagtgcattgactttattattacatagtacttaagttaagagtagataagccagaagagtggacagccaaaatgcattggccacttattgggaacaaggcattatttccatgcattaactcatttaatactcaaaacaagcttataaaatggatgtgatgattatcaccattttacaggtccagagaggtaaagtgaccaggtcaagattgcacaggtgggtaagtgatggaagctagctttgaaacaagactttctggtgtcagaatttcagaatttacactcttaggctctacacatccttgcctttataaaaaaatttgaaaacttaacctcaaaatgcccacactcactctacaccctaatgcatacctgtacatcctccaggtttaccactatttcaaacctgtctcacatccaaaggatttaaagatgaatttctgtgcaacttattttctctctttgcctcccaagttattcccatcctgtcaccataacaaccccaaacctgtaatacatagtcggaatcgttatcgagagaggcagaaggaagaagcatttgatgtatctcttcaggggtcctctctgacaactttatctcctcctagtgaactttgggcatcctgtgatctacgatgctgccaattaggctgtaaatggtgcagctgcctctgtgcactcctggctcgtgggaacagtaggatatctcttctccatatgcatgctcaccaagcacccagcatcgcaaatcagacgaagaggaacatctaagttacataagaaatgtattgagtaaacaggaagaaatgtggaatgcatctgcctatctctcctttgtcatgaagagaccaaaaactgctgcaagcaaaaggggaaatagaaagtttcttgggagctgggcacggtgactcacggctgtaatcccagcactttgggaggccgaggcaggtggatcatctgaggtcaggagtttgagaccagcctggccaacatggtgaaatgccatctcagcaaaaaaaaaaataataataattattattattattattttatatatatatattagccaggtgtggtggcacgcacctgtaatcccagctactcaggaggctgaggcaggagaatcacttgaacctgggaggcagaggttgcagtgagccaagatcatgccactgcactccagcctaggcaataagagtgaaattccatctcaaaaaaaaaaaaaaaaaagaatgtttcttggggtctaacccgtggcctcagtgtttagtacgtagtggatggacaagacacttcacttctgtggatctcagtttcttcagctggaactgagatgattatgaatctggtttgcattacagtattatgtaaggagatcaaatcaaacactcagaggaaaaacctggcatacaaatcatatgcatttgtgctccaggaaggaattgctaccttggtgtaagatatattaatatgtaaactatattgaatgtcccattctttagacacagtggcttcagacacattttatattttttaatgctacacactcatgtttatcttaatgtctgtaatactcagcaataccaaatttagaaatttaatgttctatattgatacaaaaaatgtgtgtgaaacctggtttcttaagaaaacacacaagtgcattgtcactctctgtgataatgattggattttcccagagatttctcaatctctgctttctcttgtgctcctaagaggactcatctaattaggtggtaatttaacttaggttttgatagtacaaaaatatgactgaaccaacacttagtttgggtaaagtgccaaatgctccctcttatggcaagccttaattcttgggggctttgctttcagggtttagtaacacctcagtccaaattattgttaagtcaatatttacaatgcttcaggtttgtgagatcagcaattccacaatgcctgttgtcaccaaatcttggcagcacctccttgaatattgcaaacatttacatgcgtgtgccaggcatgtgaaaagaggagtattgcatgctctgagagagctgcctagagaatcctatacccaaggttgttgcagatgtccacagtactgtactcactgaaccaatgctaatgcacagaaaaggctgcaacgtctcctgtacccagaatatcttatcttcctacgtacaattttttctcttagcattaaaaaaccctattcattatgtttgtatactcggttgcaaagaatgaaatgcttaaaggagatgtcaaatgcatcaaccgaaatattgccccaggtttcttgcgtttggaaaatttagcacactgatctaggcagaccttttaatgagacacaaggggactgactgacatcttttctgagctgacccagcctggccggcttgttttggaatcagagtagcatattcactcatctgtgtatttcctagtggcttcacaatgagctagtgctggatgcttgatgctagttgttatatctcctaagaatccaaaggtaattaaagtgttcacaaaggaatagaacacaagtttggaaccctgatctgggcacacttgcattctcaacatggggtctttgagacagatgttagaacatgtagctatcactattggaagtaactcattaccagtgaaattcaaaaaatacagtttgaggtcaaggtttttaaaaaaagaacaaatggcaaaggattcaaggatattcttctgctattactgccattcatttatgttcatatatgctttcttgaataagagagtgaagggcagagttagaggtatttggctggtaatctaatcagcataattagaacatccccaccacagcaccatgcctgtctttcttattcattcatgatttcccaaatgcatgaagaactctattatgtgcctggtgctactccagagattgaggttacagtagagagtaagacaggcaaatccctataaagtttattttatattgggaaaatttgaaaaagattaattgaaattatacacacgtacatatatattcacacacagacacacacataggtgtcaatttcacatgaaggtaactgacctgtagaaataaatcaggtgagaggtaaagaatgacttggggttgatgaaccattttaaaagggatcgttttggagagttctccagggagatgacatttcagcagagacctgatatagtaagaaaacaagtcatctgaaaatagaggaaaagaggtttccaggtaaggaggaatgcaaatagaaaagccgagaggctggaacacgcttgacaccccggagaagcaagaaggccagcatggcttcagcagaaggcaggagaaggcatctagactataatgaaggtggaagataagcaggcaggttaaagcttttgattttattctcactgaggataggaagtcacgggaggattttgagtgaggatgagcaagattcctgtgttccattatgaacagttcagcactggcatgacagcagggcatcacacaaatggactggactcctgcatgtgtgtcctaaagaaggagagaggtagagaaccactgctttaggaaactccactaaacatacttgaatcagaagggaggacagagtagacaaaaatagtttttttctttgggcccatttactatttgctaggctgtacttaaaatctacttatagttagagagaataaagcaattcactaaatagcactgtatttgtatgcccacaatataatgaaaatgtgatccctaaaaggaaacagacatggcataaatatcaatatgctcattaacgagttattacggacagagtgcacacatgagtgaaaatataatttaaactttggttttctgaccttgtctaatgccttgaaagcaagggataattcaaccaattgcacattactctcctcttgtccagcttcccctccatgaaactaaggcttgatttagtttccaaagaatctaatttcaccaagaatgcgatggaatgcctctaatgacgccctccacttacactttcactcggagccagcagcagcgagcaccaccagattattatgaagctgaatgaaatagaggcattcatcagagctaaataaaaataaacagttgaaattgcctgtcagtctcagggggaacatgaagggttgtttaaagatatcttcccttttaataagaaattttattactttgggggtgtgttatgttctcattctcagagtaatccagctgccacatcacctttgttgttatctgaacctgtagctctggtgctgtgagctgttgttatgcacaagcatgaaaatagatgcttgatgaacatttcaaggtggtggggctgaaaccaggcatcacggcagaattttgaatcagctattgctacttctctgtcttcattgctttctctctaggctctcctattacaccaatgctgtgttaaattcctgagattaccagctccctgggtttctctttcttggatttaataagtgaaaaaaagaaaatataaatttaaaagggtaaggtgattgtgtttccatagattgacacgcttggcaaaacaagatcagctgagtttaaagaaggaaaatgggaactatacaggcatacctcatcttattgagcttcactttactgtactttgcagatattgcatttcttacaaattgaaggttttgggcacgcctgcattgagcaagcctatcggcaccatttttccaacacaatgtgctcactttgtatctctgtatcacatttcggtaattcttgaaatatttcagtttgttacggtgatctgtgaatctgtgattactgattttttttttttttttaagacagagtctcactctgtcacccaggttggagtgcagtggcaagatctctgctcactgcaaactccacctcttgagttccagcgattctcctgcctcagcctcctgagtagctgggattccaggtgcccgctgccatgcccagctaattttgtatttttagtagagatggggtttcaccatgttggcaatactggtctggaactcctgacctcaagtgatccacccatctcagccttccaaagtgctgggattacaggcatgacccaccgtgcccagctgtgattagtaatctttgatgttactgttgtaattgttttgaggcaccaatatgagacagctaacttaattgataaatgttgtgtgtggtctgactgctccactgaccggctgttcctccatttctcttcatctcctcgggcctccctatttcttgagacacaatattgaaattagactaattagtaaccctacaatggcctctaggtgtttaagtgaaaggaagagttatacatctcttacttaaaatcaagagctagaaattattaagcttagtgaggaagacatggcaaaagccgagacaggcggaaagctaggcctcttgcaccaattagtcaagttgtgaatgcaagagaaaagttcgtgatggaagtgaaaagggctaccccagtgaacacacaaatgataagaaagcaaaacagccttattgctgatataaagaaagttttagtggtctggatagaagctcaaaccagccacaagagactcttaagccaaagcctaatccacagcaaggtcatcaataacgaggcaaaaccctccaccagcaaaaagattacaacttgctgaaggctcaggtgacagttagcatttttaagcaataaagcatttttaaatcaaggtatgtacttttcttttagaagtaatgctgttgcacacttagactacagtagagtgtaaacataattttcataggcactgactggaaaaccgaaaaatttgcatgacttgctttactgcaatattcactttattgcagtggtctgaaccgaccccacaatatttccaaggtatacatgtcttaagtaattatgtctgattacagtcttaacctggagcagcatcattgcttttaaatattagataaaattacaatgcttttcattataattgcttcttcccacttttcatgatgcttctgtaaagtgcattgaaagggaaatacttaaaggaaaaacaacacatatttgataaactaggataattaagaaaagtttgacttgagggaaaaaattgtcaaggatggagagaaaagccaattattaaatagaaacacaactgagaatgcaatccttagccaatcatctgagattcaaaaagtgtatcagcctccttgagcctggaaaagccttgattttctttgtgtgtttcaagtatatttctttgccatatttttgttccctcacaaacatggggggctaaggaaaattataaactacattttgaactgcagggggcattggaagggctggccaactctctgaaagctgagaatcagaaagacagattttcaaaaggaattatgcataagtggtatgtattacaagcacacaattccctttagtgcttctggaaagagccaaagcatgaaggaggaacactggcattgaatgctgctagaacttcaaaaagaaattggccttgctttatgtaattcttattcatctgtaatataaaaacaacccatcttctgttaacaggtcctttctttgaatgtcctggtaattactctaatatatatagcatatcagattggcaatggaataatctcccacaaagcctggttcatggtgacaagttacagtcttgatgatgccagttggtatgtattcagaaactgtgtattgtattaggcttgtgagccagaggcaagcccactcactacagctcttgccaactgttgatttatttccagctattcggtgttggagcagatcactggaactcaccaatgagtcctgctcttgtgcctgagagccaaaactgcaagggttggagagtgcaattaatccatctgtggctttcctcagggcctcaccaattcttgtcagtcacttcagacccgacttgaaaacaaaacttccctcccttattctggaaatttctatgaaaatggtaatctgggctcttctgccttccctttttcatccatcattctcagtaggaaatcttcaaatccagtggagaataggccaatcctgagtgttcagtgatctgttattttcctcattcaaggaatttaacatgtcctctttgtaaagttaccctgcacttcaccaagcccctcaatgagaagacctcaggtataccagtgcatatcaccatggaaactgagcctccagatggaggaaagctgacttccacagacaaggctatcaggaatccacaactcaaccttgacacccgctgcttgtactgatgctctgaactcatcttggaaaattaataaaaattacaaactcatgagagaaaaatagtggctgggtctggttctatgaagcatctgaagagctgaggtaataaacaactaattgctttgttgtatataaatatgtatcaacaaatttgttcttgaattttctgctttgttgctatgtttttttataattatagattttaaaaattattctttaaagaatgtcaccatagagcagatcctctatcttagaataagaacctttctgagatcaactatgcaggccacttgactggctatatgaaggaaggattacatgagcaagacagagatacaagcaacctgaccctatggaaacatctgtaagaggaagaatgtagcatgtaagcctcctccagaatgaccgtcctcacttgccttcctggttccatcacaacccaagttacagttgcttagaaggacacaagaatcagaccaaagttgtactgccaccaagaatgtgtacctgcagttacatgtctctttctcacaccccacagccgccacagggaaggggcagtttgttggcatgccatcaggatccttcatacatcattggctctccataaatacagttaattaccaggtcatgaacaatagcttttaaaagaagctttaactcatcccttgaagaattgttgagacagacttaagacatcatgctgattgtgaacacactgttctgctgtgttcaaaccctgctgaaatgccctcaagagccggaaggctgggaggattgagacctgtatctgaatcaagtcgtatggaaaagggattgaagatggggcttaatgagaaaagacaagggctacctatataaagttcagtatattaaaacacatttgctttcattggtcatgtccaacaataatagcagatattttttgtaaaacttctaaaaacctttatggatagacataactaagaatagacaaaactatggatagacataattatgaatgtcgtcattgttcttaacttttatttcactgaagaattattataataagccctatataaacaaagatcctgtgtggtttgtttattgttacatatcttcagtgcccagcgcaaggtaagtactcagtatatgaattaattaatgctagactctacaataacttaatagagggctatgggatggttgcctaaacaaatgtcttaaaaggcccctacctagtgattgatcaatatggatgatactcccttagtattgatatttaaataatatggaattacctacatttagagttgataaggcaagagagggtcaaatgacattacgttttaaaatcattttcagtgggaaaataatgccaaaatgattatcataaacctgctaatctaagtatttccgtaatcgcagaggaatgattctgaatctgtcaacttattgtagggttttgtattgagagaaaaaaaaaagctttgtaacttaattggataattggtttgttattggctgactgattcgctggtttttgaatgacctggatggatcacccaattacaccaagaaagtcaatctaaattaaaatatcaatgtcaatgaaaagttcaattaatatgatagcagattatagattcattttgtgtaaaattttgatgcaacagaattataattttataagcataaatactattcataatatagtgggataccttataaaataaatgcatacagtaaatgtaagactgtttattggtgtcacagcacaattttattatttactctagattattataaaattttatagtcgacttgtgttttcatgtcatgttttttattactctgtgatttatagcatgtttggtttcttatatggcaacacaactcctagttattaatagtgtccctgtggagaaatgctgatttatgatgcagagatttcaccaaatttccaggtatatattttagcaacaatcagtgactacctatatcagtgatcacaggtttcccttgccaactctggtctcttgactgtggttacctcaaacactgatgagaaggaaagctggctcagtaggagcaccataatggctgactagcaatgtctgctataggtgtcaggtggggagaattggcaccctgtgcattagtactctcctatatacactaaccaacacacaataagcaaatatgtgtgttggtgattgctttattgactggaattaatttagctttataaagtacctaattctcaccccactcactctagtggagttgtttatccactagaagaaaacaatttcttcttagtcttcaaaatttaaaaggcaggtaaattacactgcatttgatttgaaaattagcttaacccctaaaggagatttattggctaataacactggaagttcatggtgaatcagatttcagggccagtttgatcagtggcccaatgatgtcataaaggacctagtggcttcggttactcttccctgccttctgcactatcagcttcctgctgaacctgttacccatagtgataaagtggctgcagcagttccaggctttataaccacatatcacatgatttgtgaatgagtgagcaaagcctgctctagcattctaacaactaggctgagatttgccctttttggctctcttaggtctaataactgtggctgcagggggtggaggggtggtttgtgcccattcatactcagagtgggcttagcttcccatgaagttcataagctgcatatccccacaaaatctagaaactcatgagaaaggaaaaggaaaaacaaatagaggctggttaggcaaacaaagttgtccactccatcacatcagcttgcctttaagaggtgaagttagtctcagaacttcagccttctaatatgtaaaatggggataataatagttgataagactattatgagggcaaaatgaagtcatatgaaagtttaggatagtgcctggtctatggtaaatactatacaagtttgctattagtatttttaatgacacttatgtataactaacttcccacagatacctttctttttacacacacaaactggcatttgcatgcaagaataatagcaggggaaagttccccaaacattagccgttcatatttttataacttattaaaagtagcaaatgataacatagaatgtgtcatttctctctttaaagaaagctttacaattaaactgaaaataatttgccctactatcatacagtgcaaaaaacattagcctcaacatcctgatattaccatttgctgactttataattagattcagcttcttctatattcattgtattcaaataagattgcacttagtgaggcaagtttagcgttttgtcttcatttttttttttaattggagttgaaaatggaccatgctctattgtctaattaaagaaatctctttcaagcacacaaatctttcttaggaagcactttggtgcaagcattttcaagccaggtatggaaactagacatgctgatggggaaggagagtggcaaatctttagaatctctttttctctgatgaaaatttggcttaaaaaatttctcccttgccttggttgatgttttagacacttttctttgattacgtatgagcgagatgtaggttaggggaaaaatggatatatgggggagttattatcaagataaagaggtagatctcacattcaaagaaaaagctgagctggttttggaataactgaaacgatggggtcaagacatctaatgccattatgagcttctgtccatcctccaaccctttgccttagtgtatcaggtttattctcccagaccaggtttatctacttgatgctggacacatagctacagtcagctcttttccttctccttacattccatgatagaagagaaaaggatctcttccttacagaccccaactagaaataattccaagaaatgagtcaatgggatcatcctcgatcatgtgtacagacttacaggtaggaatggggtctattgcttggataaagcaatggaggaaggatgctgagcttaggaaaataatagccatcttagctgggaaaaaaaaacatattttttttcctcacttaccaattttgtgagtcagtaagccaattgtggatttgcacagagctgaaccatgtattcacagagttaggaagttagctagcccatcctccacaactcttcagagtgcacatggggccatttacttagtgaaagccctgctataaagaagagccaccagggtttctctcaccagcttatacccaaaattgtctttgaagttcagagccccagcccagaaaattctctcaacacaacacatggcattctcctgcattctattgacacttttctgaatcctgttccaggataagaggcaggaaatgtaaagaatgtaatggtgacatgttcatttgcttatgtggtgcatataattgctgattactttggcacttagatgtatgcgttaacatttagcttgtgaaagatgaataaattaaccctgcagcaaccataactatggcatttgcttacttattaaaatgctctttttgcattttacaaaattatttttaaaaataaataaagttggaatttaggaacaaatctcacatagaagaacatggaacagccgggaggatggagttatggttactttacatctgaccaccagattgtctattaagggatagttatccactcatcaaattcagatcgtaaatatccacatctcatcaagcattagagtgtgaaaaaaaactacagcattatgtaataaaatttcactgtctgcttgaggtctttgataataatcaattaataagaaaccttcatatctataggactgtgctggacactatgactgtcagcacatttcagccatgcatccagcgttatatagtgcctccctcaaggaacatgcaacgtattgtgagtcatatagcatactagtggaagatccgggatcaaattctaagttgtaattttggaaacaagtcagtatatactttatgtgagctagattggtcaagacacatttcttggcagacagagggttcaaaatggatcgcagatgatggatagtcaaggagagattctttcgggtttctgtttttatgattggtatagacatggaggcttgaaattgcatttcagtcagtgtgaatagcctgaaccaaactacagagatcatcttagaagctgtatgggatgcagagagcgtgatgcacagtgaatcaatttggaggacagaatggaggatgatgagatccagacaaaaagattttcatttggtgcaacagtttgctgggcaggaaagtaacaagagcaatattttttttgaaaataagttattctactgtgtgttggaggtgggaagaggcagagagagagacagagaaagagagagagactgaaagagggagagggtgaaagtcaatttgattgtcaagagtcaaaagtaacaaacctgaggcttaccgaaggcattttgtaataaagccttaagttaaggtagtcagagacataaagagtaaggaaggtcataaatatattttctaaaaagattaatagcagggcttgacatttagatgtaagaaaaactgagagctctgactccacaatttttgaattcagagacaattgagaattcagatctttctagtcatgttggggcaccttctagtgccttccatgtgtctggcagttgaggggagctttttcctctcagtttcagcataactggaaaactcagcttctgaaatggttccatccatttttgcctcagggagaaataaatgccaagatatgaatgagaaatttcttgcacctctgaatttccatctcccagcttcttttttgctgtttgctttgtttcacaaagtctgataaagtgagacataatggatgcttatctctacaaaagaaaaaaagaaaagaaaaaaaagagagtgggtagagtcgtcaaagaattgccttatgaaataaagtccagtagaatcctaggttataattatcactgggctataattgtagaagaacagtatttctttaaccaataatttttgaattgagaattgttttataaagagtttatgttcttatatacatatagttttcaatatctgcgtatgtgaaaattaattgaaaatatgtccacagagttgcagaacttcacagccctatatcttcatgctgtcttcttgtaaaacatgctgaatctttttttactaatttccgtaaaataattttactgaaaatagttccagttagtacacactggtagtcagtcaaaatgatgatccaggtttcacaaaccttgaagtttggggcttttttccacatttcaagcttcagcaaattagtgaagtctgaattcagtttgggtatttgatttaagcccctgatcaatagcctgactaaaaataattaactgtgacttttccactttttggaccgtgtcagctaaatttaaaaagaggtaagtactatttattaagttggtgcaaaagtaattgcggtttttaccattaaaagtaatggtaaaaaccgcaattacttttgtacccacctaatagaagagtaagtcaaaaaatagcctgcgtgtatgggaggccagtgtagaagaaatggtcaacttaaaagcattccaaagagtcactactcctggctctaagctcatttctgtccctagtcaaccatgtggtcttcaacaaggtactcaacaccagtctgtcttgatttcttcacttgtaaaatgagagcattaaaagttaaatgatccaccatcggatctcttgtaatattattttcagtgagatcatggcccttgttttgtaaaccagttgctggctttggagttgtgatgaggcaaaatcaaagcaattaccgccctttgccctctcccatcagctgcctcaccctgtcctcaggcactcaggtatagaccatggatcctctttctccctcctccgacttgtctacatacagggtcttaccattttttgttcatacttgtgtgacagtgttcatcttccaatatacaaagtatctttgtggtatagaccatgtcttatactttcttgtgttttctacacaatctactatagtgttaggtgcacagaaggtattcatcaaaagcctaatgcgtgaacgggttggtttgtttcattaactttattttcatttgaagagtttttggtttattgagccaacagaaattccaacaagaattcatcaagtacaataaagaaacaattgaccattaggaaatgttaagaacacattccctttttaaagttgcaagacctgggtacatactctcgctatagtccattctgtcatatatgtgtgaatacaataatgctgacttgtaatgcttgcttaataaaggtgtcttctttttaaaagcttttagagtgggggaaatgggccagtatgggtttgtaagaatgcatacacatggtggagaaaagttgttttcctttcgatttgtaaaatcactttctactgttctcagagataagccctgacacataagaaaggaaatgcctggtagcattgaattgttgcatgcctagagggagcagctaaagggccagtgctttgggctatgtaggctttaagaaagccagatcgtgtatttcatttttgtgatccagataacttataagggatttgctgtcatgtacccacagaaaaaggaactgtctaaattctcatgccatggcataagagaacgatgtactttgcaagctgttatgaccctaggagactcctcagtacaacaatctcatttgcagaagaagttcggagaagcctcttatgattaaataaattttattattttccacttaacaaaattcattcacactttactgtagagccaataatggtttaaccttaaaatgacctctttagtaataccataagtggaatttctacttgaatataaatgttgtctgtttaaaaaaactggctgggcactgtgggtcatgcctataatcccagcactttgggagggaggctaaggcaggtggatcacttggggtcaggagttcaagaccagcctagccgacatagtgaaatcctgtctctactaaaaatacaaaaattagtcgggcatggtggtgcatgcctgtagtcccagctacctgggaggttaacgcaagagaatcgctggaacccaggaggcagaggttgcactgaggcaagattgtgccactgcactccagcctgggcgacagagtgagactccatctcaaaaaacaaacaaacaaacaaaaaacaaatgaaaacaaacaaacaaacaaaaacacctgggctctggggctctggagtgagatacagctgggtttaaatctgaggttggcctttactggctgtgtgtccctggacaggtcacctaatgtctttaaacatttgtttacatgttaagtggaagatattctactctctaccttaagtgagacattccgtgaatagcataacagcgccatgtggttttacatatggtaagtgtccatgtcagtctaaatgtcttaaaacggttgcaattcttttccagttcttctaattataaaattaagcaagacagatttttaaatataatgctttgatggcacattaaaggttgaaatgtccaagacggaagatgtgattgtttccatgtaactgatatgaggaaaagggttgataacctttattttggatgatgaggtttagcctgggattgctggcattcttggaatgtgacaattccaggcaatgtttacagttctcaggtgttctctgagatagtattatctggaggtaatcttttgttgattgtcagtagggacaaatggaattaatttagcatcgatctctctcagcctctctccaatcttcactcctacctccaccaaacacagcatctaaccaaaccaaccaccaagtaaagcaagccagccaggtgatgtcttcggactatatagtgtcatttttaacccaccaatgtttaaggagaattaatatacagagtccctagaatttgtcagcacgttaatactgctttgagcaacccaaagaggctttggacatgccgaggagtatttggagacaggaattgagaggaaagtggactttgaaaagtgtttcttttaatgttctttgaaatcactctaaaattctttgagaaatgcaggtaatgaatgaaggatttttaaaaggcactgtggtagttgtcttgcttttctttcttcaatttaatgtgatacaatgttaagactggaattcacttggagttctcatatttattcaaattgcagaattttagggaaaaatttgaacaactaaatcatcttagggctctaagctatatagttgtaagaaaaagaacttgtgtgtttaaagttatgctaaactacttagcactacttacattaaagtaatgaacgataatcctggagtacgtagtagagttaaattttatccatcctattgttagctttttcagtgaggtcaccaataaaacctaaattgagaatctggtaagtcattacttcccattcgcctaagaatttttagcagcagtatccttggatgttcagaggatagacctaataaagcttattatcaggttggatcaatgcaagacagacagccaagtatattataaaagacagtagatagaaaggatctttaataaataaagtcaatttcttccagtcggtattcaggactcatcatgttgagtagatgccacctattctctataatttgttttagaagtactctggggacttacatatgagtacaaaacaaaagaagaaaacatactcattgggactaaaaaccaacaaactgaaaaacagactttatttgtttttcatcactgaagaaagagctgaatttcatgaagagtgtaggatgcagtatctactcagaggaggcaataataaagggatgattgggcattgcaagaggaaacctcatctagtgggagaaaacgttgtacttttttgataaaagaaatctaggcgggacattgttaaagaaaaatgacaagctcaggcattgtgttgctcttcatgtagaactctacaacttttaaatggaactgttcttttcaaggtgatcaaaaattagtgaagaattttgcctactatccttgcaaattcaacatttttattatattgacaaatgcaactaattacatatatgtcatagattaactataaataaattacgaggctgtgtgatggaattattttgtccaggcaggaatttgtgaatgggtgaaaactgagagggtgcatatataatacacagcttccccgtatacattggcttcaatgtctctacatctctccactccaggaatagatttgtagtataatcaactagaaacagaagccaaatatcactgttcatggcagcctgtcacatcaggaattcatttgtacacatgacaactcctccatctcagaaccgtgggtgagaaaggcctgattggcagcaattattctctggccactgatgctttctgcgtggcttcctcagaccttcctcccatgcacaaagacataaagtataccagaaacatttttcacacaggcttaagaaaatgattgcagcctttccccacatagtacaaaaggtcagtgtatctctgagcttcattcctcttttttttgcaggtaaggacactgtcttgctggcagcttgatagccgctacctgatttcctgataataggaaagtttcaccttctgctatggctatttaaaatgtttacttttgtactaacgcattagaaaccaactaaattctgtgggtttttctttttttttttctgttgtttgtttgtttgtttgcttttgagacagagtctccctctgtcacccaggctggagggcagtggtgtgatctcagctcactgaaacctcttcctccccagttcaagtgattctcctacttcagcttctcgagtagctgggataacagacatgcaccaccacacccaactagtttttgtatttttagtagagatggggtttcaccatgttggccaggctggtctcgaacttttggcctcaagtgatctgctcacctcggcctcccaaagtgctgggattacaggtgtgagctacctcacccatcccaaattctgttttaatgttggtttagatgtagctttgttaactatgtataataatggaaaccaagaaaaaaacagatacgctgcacttcttataatagagatcagatcaattgctgagtgcctaaagttacaaaatagcttacataatattttatatgatacgcaatagaatatataatgtataatatattatacagatataatttctgtaattaaaattatataatctcaatggtgaaaattaacaattaaaatataacaataaacttgacctgtatcagttatcattaaattgattggggcagtttaggtctttctccaaattttactttggtctccattcattaaatggacattaactagggacttcaaagacccaagaaccacactcagccttggggatagaatgaagactaagagatgatgactgctgtcagcattaatttcttccacattatttagcccactaagaatgagatataattcaaatttctgaaacttgtagatgtgtggacacattttcataaactttcttaataaataggcctgcaatgacaaaatgcacacaaaattttgaatatgtaataactgagtcctatcctttatttcaagagacaaagctaagaattagaaacataaacaaattgtgtccatcttaagggtgataatgtacaaatgtggccatttccagtagtcatggagtaggcaaatgaattgaagaagtatgattttgaaaaccctggacagcattagaagcttattgtccaaatatgagacaagttagacagacttacaagcagaaaaaaagaaaaagttgatagcctcactatcaaaagaaaagattcatgatatgcaactctcttgctagcaagtaaaaaagaggaaatacattaaattattagaaaatgttaaaagtaatgagcctttatctgttcacagagtcatcaaaagttatttctgtgtaggaagtgtcaagtagcatggataaagagtattcgggaaattctttagttgtggtcttgaagactgttgaaattattagcatctgagaaactattataaaaaaagtttacattaattcaggtggagcaatatggggcaataggataagaaaggagtaataatattggtctaatgtgtggagaaaatgagaatacttgatgaagatatcacaggttacccagagaggcttgaagaccagctgctgggagatcaggaacctgagcagcaaggatagctcaaagggaagtcattttacatggtgtgaactggtgtaaaagatcagggaaaaatagaaatcatagataattaaccaatcttaaaatagagcagactgggcacggtggctcatgcctgtaatcctagcattttcagaggccaaggcaggcggaacacctgaggtcaagaattcaagaccagcctggccaacatggtgaaaccccatctctactaaaaatacaaaaattagccgggcgtggtggcaggtgcctgtaatcccagctactgaggaggctgaggcaggacaatcacttgaacctgggaggcagaggttgcagtgagccaagattgcaccactgcactccagcctgggtgacagagggagactccatctcaaaaaaaaaaaaaaaaaaaaaaaaaaattagagcaaagcatcaggaagcttgggagcttcctgagtgacagccagggtgaccttacattctgtttgcccaggacatctctgatttacatctgttttaccagcactcaaaaatgctgtcatttgggatgataaattatatgatcatacttccaggagagtaaatggagtgaatgaagaggaagcctctttcactagttgtctctggacaaaatcccagttggaattattaccaataatgagttagttactcagagacatatttctatttccccaactttctctttaccatgaaaaacaaactgtacaataacacaaaagcccaagaaacccaactacattattctgtacctggaaaaatcagtacataaaaagaaaacagtttctaacacataatatatgcaactgcctaggtactattcagaaagcaggtcccatgtactggttaactcacagatccacaaggaacgaggtacattttgcttccatttacttttaaccatgatgatgatgtttcatagcttgacaattatagaactataatagctgactgtaaacccaaagtaacttcctcaagtagtattttaaggttgtgaaaatatttgctgggcttttaaaagtgagataatgtttctctaacacagtgacatgtacagatctggattttagtgagatgtgctactgagtcagttatttaaaatcgatatttaaaaatatacgtttttctccattaatttaataattgatgatttctatgcactaaattgttagggaattacaggctgtttttaaagaaattgctttcatatgtggtcatttcatttgatcattatgaaatgtctggaatattaggggaaaaacaagttataattatcttatcaaacaaaatcctatttttggtaaaattaaatgactaatcggggtcactttttgaagtaaaatcaggtttttgttgttggactatgaaaacacagtccttttattctcatgaggtctttttaaaacattttgtacataaatttgcatttcaagctttatgtcattattataaaaaataattgtcataatttggacagagccatgctgaaatggacctttgtgtcttccacgagggcaaagtttgtgaagaaggttaacaaagtgcgtggaatgcttcctaaaaacacacccacttggcagacaaacaattacatgtgaattataaatacatttttaaagcaaatctgtggagcaccgctataagcaaaattttctgagcctttatttaatgtatttatttgaaatcaatgattttcaaacttattctataattcagctaatttgctggtcttctagtagccctttctagttaacctgaattatttagctagccggtgatggtcacattattaggatatttctcttctagtaggggaaggcagctttcctttctgtctttctctgccatgctctttaaccaacagagagaggaataaacaggaagggggagaaggaggaggagaaggaaaaggcagagaggggaaaaggaaaaggggaaggggcagggtagggggtgggagagagagacaaagagagagagagagcatgcactccactgaatatactcaagagccataacttgtagcagggctgttacatatggaagcagctaggcactatgggacttgggggagcaacattcctgtggactatactgtgagagattaatgcacggggttgtccaaggctatggccctaaacattacacacacaaaaaaatgttcctatcaagaatatccacaagcaatagcctcatgttcatgttatctggcttagtctcgtagacaccctatattgccttgcatgctaggtcccagtcaacaatgtagtgtgtgtgcatattagagaagaattttcctccatcctcctcctgaatatgtttttttctgggccatttacatgaaccagctttcattcacagcctgcgtatgagggagaggatcagatttgctcacgtgcaatgaaggtgcattaattgacacagggtagtagaaaatagtgacattaaatagttttgattgcactaagtgctactgagacaaaagtggaaattattcttcccgtattctgaggaagctaattaaaaataaaaaagcagatattctttctttccccagtaaaacaattactcttcgtgctatacatttacatttggtaagagctgctaatgaggttgtttacgtttgtactgtcactttcatactaagtcgcatcatgaataggaataggtgtaccttgcaacttgcaccatcacctagcagtgagtccacaccatgccttcggaactccatgcatcatgttgcactgagcaaagcaaaggaaatatttcagagcaggcatatttaattaaccatagtggacattttggttgtagttaaatcataattatcaccaccagctgctcaaattttgtccattcagcatacatttatggagtgcctactgcgtacttgggatgaaacttgcttttgacaatgctctaggatttctcatgttgagaagtctgtgcctttcaggaaattacctcataacgatgggaatggcaaaccagtgccctgagagagtaaatgcaccttcaggaagtaattttctcacctcacccacaagacatttcaaataatggtaatcatgagcactttcctaacactgaattcataattccatctgtgtcatataatcatggcaaccatggggatccttttcttcttttacagatggaacaaagggaaagcacctcttattccagtaaattcaaaagctgaacttatctaagctatatacatatgtgtgtatatatatccacacatatacatatacacatacatatacacatatacacaatacatagacatatatactatttattaatatatactatatacacacacacataacagtcagtttccaatttacaaatgggttaaactccaaaattgatatggtaagtatttcattaaactctaaaacccacttttttatcaaaaattctaacgtacaaaaattatgttgttaaatcagcatataaagcaaacattcttatttgcacctgcagtcctctccatcaatacatgtgtaaatatttgttatatttatagtatcatgaatacataggcccacagaaagctcatattcagaaattagtttatttaagagttttctgcttaaaatatttcaacaaatatatgcaaatttcatcttggttcttcctctctacagtaatctccatcctctcctttatcaggccctccaactccttagtagtcagcatttctctagggctttcaactgcttttactagactattagaaagccatcattgaccaattgcctgcccaccttaagaataaattttccttctttgccaaggctgagaatccagtaaaagtcttgaggcttgcttttcatacagttcaacatcatgcgtggactatttcaggcccattgaactacctaaactatactatttaaattccccccccacttcccttctccttcttcttctttgtctctccctgcttcatgtatgtggatagctgaatccaaagggtccttgctggaactcaacagcaatcatagtactaaaccacaggaacgactccactcttataaagcactgttctttctccaggcttcagtgcccccaaacccttttccctcctttttttttcctcctcttctcctgggaatgcaggaaaagacaattctaatcgggagatatctccagcatcagtatatcacagatttgtctggctttccatcacactgaggataaatttctcgtcccttaccacatcttgcgaagtcccatgggctctggtccagcatttctctttgaccagagctcacaccatactccagatccagcttcagatccagccacagtgatctgctttctgttcctggatgatgcccaactcttggtctctgaggacttttgcactaactgttccaaccacttctcagcatcagtgtcacctactcagaccacccaatttaaagttggccccctctccttcccaagcatctttctattaccctgtttacttttttcccaccaccatcagtgcctcttttaaactgatttgttatttagaatccatcaccccacctggaatgtaaattccgtgaagcaatgagccttcattcactgtggtatcctagaatctggaataggatttagaaaaggggcaccaaccaaacattcattgtaaataggtgaataaggtgaatctactaggcagggcatggtgcctcatccctgtaatcccagcactctgggaggccaaggtgggtggatcacttgagcccaggagttcaggacaagcctgactgacatagtgagacctcatctctacaaaaaatacaaaaatacaggcatggtggtgcacgcctgtagccccactcactttggaggctgaggtgggagagtcacctgagcctggaagttcgaggctgcagtgagctgtgattgcactgctgcatttcagactgggtgacagcaagaccctgtctcaaaaaaaaaaaagaaagaaagaaagaaactacgaaactgggcattcattatgattaacatcttaacctgtatcatttattgggccttcttactggtaatatgtatctcaaatataataaaaggggacttggccaggcgaggtggctcacacttgtaatcccagcactttgggaggccgaggtgggcagatcatgaggtgaagatattgagaccatcctggccaacatggtgaaaccccgtctctaccaaaaatacaaaaattgctgggagtggtggcgcatgcctgtagtcccagctattttgaaggctgaggcaggagaatcgcttgaacctgggaggtggagttcgaagtgagccgagatcatgccactgccctccagtctggtgatacagcgagactccaccacaaataaataaataaatagataaataaataaatattaaaggagacttacgtgaacatgtcactcagtttaactttccctctagcaaccttcatttattcatgagcttcacaaagatttgatttgtgagcattgaatacagcttatgggcatgatcaattcttactaaaactttataggcattttacaaatacccttttaaagttcacaacacggaaataaacactggtttccccattacctttcttgtttctctacaggtttctactgcttttctccatgcagcaatcaacccaaagcctttattcataaactccattatccatatctctcctacattcaaaacctgtagcaaataaaaaacaaatctggacttaagaaaatagagactttatttgaaaggacttttgcaataacagggttactgcgataagggaaggggtactattgcaatagggaaaatgcttactccgtgaggtatgaaagcaattcaaaggtcaggcagaaaagagcttttcttttacagaaaggagtaagccaacctggaaggagccaggtatgggggagtggggagagcagatggcttgatcggacagttaaacaggagacatctttctttgtagatgattttcaggagggattattatgactccaatacttgcttaacctaagaagtgagtcaatttcagggtcctgtggtgaagagtgaaacttaattgaagtttggttaagtcaaattaacaagcattttgttctgattggtcagtggggaccaatagttcagctaatcgtgtatgagacaaagaatgggaatttggaaggtctgcatctggccttgccctaggtaaacaaggaagtcattcccaaaccttatctaagtcatatggggaagggtggttcttgcagtaagccatttctaataagacaaagagtacagggatttctttcatcattgctgatattaaggagcacaggtctcaggtaaggtttaacatagccacttccaatggctttccagttcatttgaagtaaacccattattttcagtggtctgtaacagaggtccccaaccaatgggccatgtggcctgttaggaactgggccacacaccagcaggggagccgtgagtgagtgagtgaaacttcatctgtattacagccactccccattctcacattaccacctgagctctgcctcctgttagatcagcagcgggattagattctcataagagtgtgaaccctattatgaattgtgcatgtgagggatctaggctacaggctcctgtaagaatctactgcctgatgatctgtcactgtctcccatcacccccagatgagactgtctagttgcaggaaaacaagctcaaggctttcactgatttctgcattatggtaagctgcgtaattatttcatgatatattacaacgtaataataatagaaataaagtgcacaataaatgtaatgcacttgaatcatcctgaaaccattccccactctccttggtccatgcaaaaattatcttccacaaaactagtccctggtgccaaaagggctggggaccattggtctataagacaccatgtgatctgacttccacccactctctgagtcatttccatcccatctcaactgtgctcactggcctccttaggttccattctaggattctatgttcctgctcaaagacttctgggcttgctcatcctctgcctgaatgctttctcccagataccacatggcgttgggtatctgcaaatgtcttttcgcaatgcccgtcttgaccaccttgtataataacacaatcactctcataacaattcgcccttccaagctcctcatcctgcttcatttcactctgtgggacttatcacaatctgacatgttgtatagatttggaattgttttgtcatctttcaccgttcattgaaatgtgagctctagaaagatatagactgtctctttgatttactgctatacttttatctttatcacctataactgtttgttagattatcgaagaagcaaacaaatgattacataaatgaacaaatgaatgaatagaagtaattatattgtctcaaattgagaaacttcgtacaaagattcttcgaccgtgcctaagaagttatttctcttgggagatcaggataaacgaggaacaaaatgagggacactaaaataggaagccataaaaccctgttgtcaatttccagcactagaaattaccaaagaaatgcataacttattaaaatttaaatgaagtcactagcaagattgataaatgttcctggcgttctaccaaaaaatgtctgttgcatcacactggaatggacctaacctatgaagaatcgtggtgcgtctataggctaaagatgaaaatgtcaaggatatctctaaatactgttcgttggaaaatccaaaaggaggaaatagtaattaattatattaggataaatatatgatttgtcttcgaaatctaaatagactggattaatcaaatgtcacagtggcatttctaataatgattgtgctgtgcaaagtccattagtgagctatacttgccaagagaaaagttacagagaatcaattaaataaacaaaattatcttcccctctccctctcctccagatagtctatgaatcttaccattttgggtggtgcctggatcctttgaaaattaggaaaacatttatataagatgctctcccttgagcccccaaatcactccatgatgtttaacactgtagagttatctaatatctttgaaaaggagagactttaaatgataagagcaaattaaaaatggcttagtatgtcagaaaggacatggcattctaacactaagtcctctgtattaataaatgcacctgtcatgttcccaggattaatgagaaatatgttggcaggattcatttgaacagcgaatttgcctggttatacttacagatcatcttaaaatcgcctgcttgagcacagacaatgacatcgtaaatatgtatttgaaactaaatttaaatttgagagaagcaatatccattcattaaagaggaagaaacaaatgcattacaatgaatctcagataaatgaaaaagcctgactctagagctatgaaagggtttagtgacccttagtgtgagtgtgaagatattcttattcaaagcaaggctatccatcaatgaattctttcagagacactcttatctgaaggcttactggggataggtttaattcctatatactgagtctcttagaactgagaaatctcaagttaaaatggatcaaatgcaggattttgttgtagggtgccctaaatgggaaggctgggctggcgagtgctttgaggaagcttcctgattttatcctccatgtgctacagtcatcaatgtcttgcccaagactttctggtttcacaggaaatttattaactgtggcaataccagagagacttttctgtgtacatttctttaacaaaaagcaaactggtgaaagaagctggacagacaccaagaaggatatagggatgatttcatttacatgaagttcagggataggcaaaatataactacagtaatagaatttagaataggggtgtagagggtcgaaggtggccctcaaaaagataggtccatatcctaatcccccagaaactgagaatgtgaccttatttggaaaaagggcttctgcagatataattaagctaaaaatcttgagatgacattaatcttgcattttccaaataagctgtaaatccaatgactagtgtccatgtaagatacactgaggctgggcgctgtggctcacgcgggtattcccaacactttgggaggctgaggcgggcggatcacagggtcaggagatcgagaccatcctggccaacatggggaaaccccatctctactaaaaatacaaaaagtagctgggcatggtggtgtgtgcctgtaatcccagctactccggaggctgagacaagagaatcgcttgaacccagagagtcagaggttgcagtgagcggagatcgccactgcactccagcctggtgacagagcgagactccgtctcaaaacaacaacaccaaaacacacagaggagagacacagagggaaggagaagacaaaggcagagattggggtaatgctgccacagtccagcaatgcctggagctaccagaaactgacagaggcaatataggcttgtcccctagcccattctttcactgtggcagcatctctccaatctctcagagggataaagccttgggaatggatgctttaattttggacttctggccttcagaactgtgagagaatacgtttctgttatattaagccaccaagtttctgttcattcgctacagcagccacgggaatctatgcccagggaacaaaaagctgtcacataaggaacacgcactttctgcgctttgccatgtgtatgataccaaaaagtatatgaacaaaaatgaagtaatgggtttttcgggggctttttttttttttttttttttttgagacagtctcactctgtcgcccaggctggagtgcagtgatgcaatcttggcccactgcaacctctgcctcccaggttcaagggattctcctgcctcaacctcccgagtagctgggattacaggctcacaccaccatgatcaggtaattttttgtattttttgtagagatggggtttcaccactttggccaggctagctcaaaaatcctgacctcaggtgaaccacccgcctcagcctcccaaaattctgggattacggcatgagccaccacactcagcctgaagtagcgtttttaaaagtcaaaataaatcctcaaagttcaacttaagcatggcattaggctgatatcttcttgtagcagtgagtatttataaaacgatttttataaaatggtgatgcttctgattttttgtgaggaaagctttttaaaaatataatcacacattttaaaatgcaccagaaaaactaggtattggagggaaccatttctgaattgtttgtgaattgactaatcaccctgggtttgttttgttttgctgcaacttcaataataattattaaaacctaagtcaaattatgatttttcctgagtaggatttattttatgacttgatgtttctgtttgcctacatggagcttttcagctgcaaaataccccttgagataacatcagacagcttgggcaactccctgatttataagtgtatttatttattaattcattcattcatttctattacaccttaatttactaaactaaaatgtatcttaacttgtgtgaactcagagttgaaactcacgaattttcaaacatttaaggcattattagaaataatccatttgatgtatgggatagtattaattaaacaatggtaagtctatagttaattttatttttatttctgtaaacacatcttttattaaaaacaaagagattttctgtgtatgtcatacatactttaaatagaagtgtctcagagcttataaatctccaaatttaaccaaagaagaaaaagaagttgttatataatgtgatatttttttaaaaaaaaacctagacaaagattaaatactaccccaaacaacacccactgtatgtatatgggggatggagggttgtcattctgatcccttgttggtagaaatgaaaattagcacaacctttataaagagtgatttgtcaatattattatctgtcagaaaaccaaacgcatttaccctttgacccagtaatcacacttctaggaaatattcttcacatgtactcaaggtacaaaataagcttgtacaaggttattgattctagtattttttaacagcaaaagtttaggaaaacttaaacatccatcaacgtgagactattcaaatatggaacaactgaaaaagcttcttttatattgacatagtgtgatttactgttaagcttcacaaaaggtaagatacgtaacaatccctataatatactatttttaaaaaacaacagtcctgtagtcccagctactcaggaggctgaggcaggagaatggcgtgaacccgggaggcacagcttgcagtgagccaaggtcacgccactgagcactccagcctgggcgacagagcgagactccgtctaaaaaaaacaaagagcaaaaaaacaacagtcggggctcagtttgttcatagggctgattgatatggtaatagtaaaagaaacgtttttctgtgtatcctttggactctttagaattttgagtcatgtgattgttttatgttttcaaagtcaataaagttaaaattataagaaagatagcctaagtaataaatgtgtggaaatgaatagagaattttttaatggacctaagtatacataaaatatagtataagataaatgcagcattatgtgtaaaacaacaaaccagtcaataaaaggggctggaaaaatataagccagaaccctatgttactgatctcactgagttcatttgatatggattgaaaaattttaatgctaaaaaataaaaccatataaggactataataaaatagttaccaaatatgcttataatatgtggagtaaataaaactaaaaatacaggaaaactgaaacataagggaaaagactaacctgtcgattacatcaaaatatgtatatgcacagtgaaataaaattttaaagcaaacaaaaaaacctgcaaaatatatgacagacaaaatattaatgtttattcagcaaacatttattgagcagctactaagtactagaaaatgggaaatagagatccacatcaatggtactatttttgccctgatggaggtcttacaaataacaataatacaaatattgtaatagaaaaatatttgcaaaagacaaaaacaggaaatttacaggaagaaggtcaataaatactgtatattttaaatatttaactttaataaaatcaaagaataaaaataaaaaatctaatatcagattattggagatggataaattaagcattgttcaagaatgggaagaaatggatactttaatgtgttgtgttgggggctatataatggtacagtctttttgtagggaaatgacactgcacatcaagaattaaaatgtgcatgaattttgctggaacaatttcacacctacgattttacaccaagatgaaaaatgatcaagtgaatacaaatgttcatgagtagggatgttcattgcagcattgtttacatagtgaaaaaccaaaaccaagcctccgtgtgtaatactgaagggttgataaaatgaagcaaagtaaaaggaaattccctgaagttattaaaagggagatgaattagatatattcattaactgagaaagacatccatgtcatcgttaggaaaaactagtttcaaatctgagtagtatccatggggaaatctttgcccgttttatgtgaaataagtaattcaaatctacaagacaaacaggttcaatgggtaatccaggcccctgtctctctgcctgtaacaggcaggcacagaatcaatcagagtaagcctgtggaccaaagagaatcctagacctcatgatactccatcttgggggtgctgaccaccccttgcccttctgaaaaatcaagaatctgtgaagtgtttggcgcacttagttaaatataaactttctccatgactcagcaattccattcctgacatatgtcccaaagaaagggaacattaccgaaaaaagtggcctgtaatcccaacactttgggaggccaaggagggcagatcacaaggtcaggagatcgagaccatcctggctaacatggtgaaaccctgtctctactaaaaatacaaaaaattagccaggcttggtggcgggcgcctgcagtcccagctgctcgggaggctgaggcaggagaatggcgtgaacccgggaggcagagcttgcagtgagccgagatcgcgccactgcactccagcctgggcgacacagcgagactccgtctcagaaaaaaaaaaaaaaaaggtgttgcagtgttgtatacgggacagtgagttggcagtacccaaatgcccatcactaaggaatgagtagaggatggaaccagggcacaataggcagcttttagaaacagtaggttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagaaacagtaggttaggtgcacatgtaagaacagggatagtgctgagaaaaaaaaaaatcagaaagatatctgtaaaacaacaaaatttatgtaagtttaaaagtgcatacaacaactatagacatttaaagatatacattaaatccattgaatgttcaccagcttggggtggggaagagagtaatgagagtgggaaatacaatggcatacacataggtacgtatttataaagagggatattgcatgggctaatgatgatagtaggccatgaaagttatataattaactccttgttcctggaaaataaaaaatggaaggaaggaattaaggtgggatggaagaaaggaagaaatgcagtgtgggagggaaggaggttttaggaaaggagaaagaaaggaaaaaaggaaggagcatgttgcaaagaagtataaagttgcaaagaagcacagataggtatgattccatttatataaaattttgtgtatatatctgtgaaaagggtttgtgtatacgtgtgtgcatgtgtgtacataaaagagatgtcttaaagaatactcattaaaatgagcattttaatgctcacctatgtcacccctgggagtgagattttagatgggttttacttttcttaatacttcttttgtattgcttggctattccagatgggaatgtgttatatctataatctgaggttgaggggttggtataattttgggttgtgggtggaaataaatcatccaggaatagcagatcctctctcttgctctcctgacatgtctttcatataaacattgtctctaatcatttttactcacccttcaatgtgtcaaatgtaaagcaggtgtggcagaagcaatagtgatttagttacaaaatattgaaatatactataaagatggacaggaaatccataaggtgcttcttctgcaattaagaacaatatctaatcatcagaaacaagtttgctggcttgaaatcaagtgataaaatgatgctgagccacaagagattcttgccctaattcccctaaagctgctcgttctcctgtttgctttgattgaacggcttctgtttctattgtcgcaggcagggatacctagcaaattctccgctacttcaggcaggtttaccctagctaagtgaaatgaaatcttaagcaacctctggggtacttgttggctttaataattcaagtgatagcacccactttcttttcagaatatatatgccttcctaaactgtctcatgcactgaatttttctattttaccatctttgtaaatattccaataatgttattacaaaataatggataactatgtccaagatgggtaaatttagcttaaatccaaaatatataaatcttagtggttccttgtaatctcatggacatggctgaaaaggggaacgtggttcaaaataatagtccccataagtacctttcaggaaattccaactaacacttactaatttcagagtaagtagatactagctggcatccaattagctacagtatttacatattctatctcactgaatccacctaattaagaggtagtatctatttatgagataggtataattagccccgttctacagatgagtaaatttaaggtcatagaagttagataacttgaccaagaccacaaagctaataaagaagtgcccaacctgcagttcagatttaattatttcatagtatttagtgttccaagaagaaaatccaggcatgagggttttttttctttgcacttgtattttgcaggtcacagtcatataagtaattagccttcaccaatctcactatctacattttgtcagctagatacctccagcaaaagttgttccatgagaatgtaactttttataagaccacatctttaaaacgatattatcacatagtaaattagtggaatttttggagcctagctaatgttgctcagccattgattccctaagttgtttgggagagaagacattgagtagagaatactcctttgggctcatactatatattcatggccataaagcctccccttatatagtttattacttacctcttcaattgacctaaagtccactttttgtgggtggtaaagataattatgtcagaaatgacacattaactttagttgggatcacacacacacacacacacacacaccataaaagggcaaaacaaagctattgttctattatattgtcttaattataatagaaataaacttgaatgtcactgaaaatcataagctcccttacacacataagcctccaaacacatgcacacacacacgtgcacacacacacacacacacacacactcactcactgacctccaaaatattttattcatggcaaagaagaaatggtttttctgtctgacttatcacaggcatttcatgcagagtcaaagaaatgtgacatatttttctgaggataaagtacaaaaatggttgtcgctttggggattaaaagcaaatatgtcacctttgtaaaagtaattctcaatgaattagaaaaacagaacatttctgtttcttttcagatactcatccttaagctgagcttgccctgtgctcagctgggtagcctatctgtgagatcaccatgtactcagaccaaataggaagacttattttcttgggggcattatctcacaattcgaaatagaagatttcaaggaagaggaccttaaaatattttcccaaatcattttgaattagtataattccctttttttcgaaaagccctctggttaagagtaagagtgttagaggaataactcaggaaggaccagaagccaatgatctcttagaagtggtcaagccagcaagtgcttcattgaagttgggactctgggtcaaggatttccatctgtgaggtcatatctgtttcagaataacttattcacccaccagtaactgacccgaaaaactagagattaatttttgtcacatttttattggtgtggggagcacagagcaatggccaacagattgcattcttgatagggcatgtgtagagtaaaaccctattaaaacatggttggttgttggatggatttgttccatcctaagtcaaataatttcctttgaagcttaagtacacagagaaaagttctgataagagacagcatatgaagcagacattagtcctgtccatcaaacatctttcatgaaggagtcccagcatacacacgaaacaataaactgctcttaggaagcactgagtcgccgcaaggaactgcgctagaatcttgctttaaatatttcccagaaaccacttatattaaatcttaattttattttgcaaaaattggaaaaatgagaaaacaacaaatcggctttatcctgtgctttggttctagcatggtggcagtatagcatcaccttggttttctctctcatcttacagacattaagagcatataacacaaaatacataacacaaagttgtgtgcttagagatctgtgcttttcttcagctgggacaaaacatgtatactaaattgagaagacaggaggtaggagaactgcacgctaggttctatattaagttttttacccacaaccacatttaaccctcacagtgtccctatgattcagatacgtttttattcttattgatgaagaagctgaagttcaaggacattagatagtctgctgcagttcccacagcctgcatatcactgacccaaattctttgtgttgcgtcatggtgaagggctccatcctctagctctctaaacctaaattagaggtatcatccttgactcttccctcacttgacccattgccactcaattagtcgtcaagttctgtggattcgtttttctttcttttttttctttctgttcgttctgtcaccaggactgctgaaacagcctctagtccgacagtcacctgcattaacgttccaaaatgaggatcagatcgtgttatccctgtacttaacgtccttcagcgtgctgccattggccttagaatgaggtacaaacttcttgatatggttttcagtatcaccagatattcgttccctgcttgccacctcacctatgtccttaacactctatgctccaaacacaattagacctttttcaatttttcaaatgctttcttgacttgggccttttcaatgctgttatccataccccaaaccctctccaattaccttttctctctgtccacacatccttctagtcctgggaaaattttcacatccttggaaagccttcatggttttcacatagcagtagttctgaaattgcagtcccttgactaatagcctaagcaacgactgggaccttgttaatgattaatataaattctagagccctatccctaacccattgaaccaggatctctagggtggtaactaaagtgtatgttttagcaagtacttcaggtgattctggttctggttgaagtttgacccacttccctctaggtgaaccccaatcctcacgagagtcacccagtactgacacctcaagctcatctccagaatttatattaatctccagagattttgagttacttggtctagggtggggcctgagaattggattcttgttacttatgtttttaagtttcccaatatgactctaatgtacagtcagggatgagatcttcttccttaggctaatttaggaccagtcttgtacttccctttcttgatacttgatccctttattttcttctggtattgtctgacatcctcggtagacagagtttatgagggtaaaaactgtatctgaacagttcaagcacagtcccagaacaataattcagatgtagtagtcactcaattaaaatgtattgaaaaaaatacatgttgaatggatatctacctaagatccctggcaaaagattactggctaacatgacctcaaccacccctgcaaagaggttttcattgaaaagtccacatttgcttgtttaggtcatcactaaatcactaacaaccccttctaaactttagactctttcacttttatcaacagggagttaaaatattaaaaatatcatcctccttgtcaccgttaataaataccatccacttgttccacactggaaactacatgtagttcctatctctccatttttcttctctcattttaattggggtgctacagagatgtgtagacttaaatttcaactccataaataaaaattgagcaatatgccttcatggagactattttctacaaatcttttcattgtatatcttaactttatagctattcaaattatatgctgattacacgagaagtgttttgttgatacaaactcaatattcaccttattcaatccaagtatttgaccaagtatgttaaggtttcagctacagtttcttatgagggtatgtaataaagtaaagaataaaaaggtaaatcattgatatggtttggcagtgtccccactcaaaatctcatcttgaattgcaatccccataatcctcataatcccatgtgtggagggagggacctcgtgggaggtaattgaatcattgaggcaatttcccctatgctatattcatgacagtgagagagttctcacaatatctggtggttttaaaagtgtttggtagttccttctgcattcattctccttcctgccaccttgtaaagaaggtgcgttgcttcccttcaccttccgccatgattgtaggtttcctgaggcctctccagccatgctgaaccttgagtcaattaaacatctttcctttataaattacccagtctcgggcagttctttatagcagtatgaaaactgactaatacaaagtaagtataaaactactaaagggaggtttagcgcctttaaatctaaaaaggaagtctgttcatacagtagtagaagtgaagaaggaatgctaagaagaacaggttttggggagaagttctaaaatgcaaatttccactgaagaaagagaaaggtaaaaaaatgacttagtagagagcaactgatcaccatggtaacagcaaaatagcacacagttggaaagggctcaccatggagcagagtcaggagacctggcctttcctgttgccctttttttcctttctggtttggaagaagggaagttcaagttgtgagggctggcagggaaataccaccagcaaggtgagcctccctggactgtaccaggagtgcagaagcctgtccaggctggttgctgctcttacctcctcagctgagcaactgagctccttggtagctggagagaggaagcagagaaaggtgcttctctgtactctagtactacaagtctataagtccaacaataccaggattccaaactccttgattcttcaatggtttaaggccatctattgacaaagcaactattggtggactttttttttttttttttttttttgagacagaggctcactctgtcgcccaggctggagtgcagtggcgcaatctctgctcactgcaacctcagcctcctgagtagctgggattacaggtgcatgccggctaatttttgtattttcagtagagacggggtttcgccaggttggtcaggctggtctcaaactcctgacctcgtgatctgccagccttggcctcccagagtgctgggattacaggcgtgagctaccatgcctggctgagttttggtggatgtttttagcagtaaaagcaaagaatcaactaaccccaggatagtatatgaggagcaggaccagctacttaattcagaggcccagtgcaaagtgaaaatgtggatccccttgtttcaaaaattattaagaagttcaagacagcaacagcagggcatgaaaccaagctcagcgtcctccgatgtgcaagccccatgcaactgcacaggtctcacatccataaagccagccagatcagaaacctcaacttagaaaaagagggagataaagaaacagcacttgatgcagtggctcacgcctgtaatcccaacactttgtgaggccgaggcaggtggatcacaaggtcaggagattgagaccagcctggccaatatggtaaaaccctgtctccactaaaaatacaaaaattagccagtcatggtagcaggtgcctgtagtcccagctatccagaaggttgaggcaggagaatagcttgaacctgggaggtggaggttgcagtgagccgagatcgtgccactgcactccagcctgagtgacagagtgagactccgtctcagaaaaaaaaaaaaaaaaaaaaagagcaaaataaagaaacagcacttgattctctacactgatcttcaacagatgtctggtttcctttacctctgttccaactgtgatatactctcataataaatctgcatcttgaatttaaagttctactttcctaacagtctgaatttgcttaagttgctgaataatatgttgaagttgtattcatatggttagtgaaagaaaagtaggttgctggtttgtaagccaaggggacaaaagtgctttctgttgatgaaccgagaaaccaatggatataaggatattataattctctgcaaggatattataattctctgcagaataagaaattgaagggtacagtagggaaggaagatgaatgccttgccagtagagcttatattcaggatataaatccaccgagtagcagaaaatattagttccttatctttgtatgctaaatccagcatagagatatggtctggctacatatagcctaaaaataaaagttggattgagtgaatgagtaaacacttttttcagacgggaaagggatggacaagacttgagaaggtgtgttgttttgctattattttaagttgaatgaatgtagtttaaattgccttagtttatgacagatttttccacaaaatgcatgcaagcccctgtgaatatgttacaaatgtgctgagatgttgatgtcaaccccctcatccctttgccctgtacacatttttatcattttctagataagctatgctatctgatgagctatgctgtacacatttttatcgttttctagatgagctatggtgtacgagaggttgttatgcaccgactctgacttgtagagatatataggaatccaagcgggatgatctagttactgcctatgtttgatgaagtaggctgtgctcctttgtagagtgtgataaagaaggcagaaggaaacatttcacgactctgccttggagaaagacaggtagacatatgtcaagaagaattgcccacatggctccagtagacaagcagaaaacttggaaataccaaaggtggatgccgattacctaacataggtgaagaagggaagccaaccctgtcactgaacatttgtcagtgcttattttgaaatactattttcagaatatactgccatgggccaaaatgagttgaagcctagagaaaatacagccctctgtgtcctgtgcatttatcttctcccagtcctctcgcttgcagaatgttcagaagaaggacttacactgatacaaagcagacgagagccctgttccttactgctttgtttttatataactaatacaaaaagatattatcataaaagtttataaagcatctgttctccagaatttctgttgaggaatttaaattcttgcacccatctataagttacatggactccttatcagcctcctctccctcaacatcaccaccatcatcatcattaacagcatttgttcattgcccctgtattactaaatggagcaatacaggttaaaaaattttccaatcattagaaattttaattgaggacattaacattgacacagaagaatataggaaatacatagtaacaaagttcaatgaaaacttaaaatttttctgaaacatgatatttatcatatgcgtaattaacccaacataaccattaagtggtgaagaaaatgggcccatctactttgcaaactgcttctgcctaatttgttgatggctctttgcacaattttagtatttgaaccttttaaggatctcttttttgggtttcacatacgcaaatttacaaactggttttaaacagtgctctattttaatgaggaaaattttagaactgcaattagtttttgttcaaaaaagggtgggggggatgacaaatagttaattgtgttcctctccaaaaggatatgaaagataaaactttgtccttgattacatagaagactatgtctttgtagtttaaaacattttgctattgatttttggttctgttgaaatagtatgtaagaaatggtttacactagtgtattggaaagttagaaattagcttcaagagggcaggaaacggttgtccctgagtgttgatgctgttgtagacaaataacacactttcaaaaactatttttatctaaagtcattttttcatagtataactcaaaaagggcagcaaacacttcttaaatatgagttacagccttcttcaataatgaacaaaaattgtattcagttgattttcttacctatggaccaagacgtatttcaataaaaaacagccaagagtgtttaaacatttccatttcgaaagattcaatgaagtgaaaaaaaatgtgcctgtaaaaagaaccagatcttccaaaaggaattaatttgtttttgaataatgcactgatcttttgaaaatggcaagttccaacgaataaactatgagattggtatcataactccaggaatggtattcaaacaactgggggacttggcatcaactaaaaagaatggatctggctgtcccagagctgcttgctgagtgttcatcttttatttggtagaactagaggaatacagtgaccttacaggagggactagggggcgggcatagtgataggagtgggaggagctcccagagtcttaagacagcagctatttgccagctggcaatacagcagtattttcaatattttcactactggtatagccaaaaggtgcttactgggtgatgtcaacttctgattctcaacaagggaatgtcacttactcatcagtgatatccagcccacactggcttgggtttgtgcagccaatcagatcaacattttcccatcagcgtgacatcaagcgtatgaacacctttcccatgagccaggtaccaaccattactagtatttgttatagaaggaaaaactgaagtccaagaataacatttcactggccagcatgccctctgcttctaccaagacttcagctagtcctaaatgcaagagcatggagatcacatactctactgatcttgaaacaaaaatcaattatcatcaaatgaaaataaaagtaaacgtaattagtaccttgttttcccccacaaagcttatattttatttctcttactccattagacatcggggccttcttatttattaacagtagtgaatccctgctctaccaaatatatgtataaagttctctgggagaaaacggaatgagtagctgtttttagggcagccatagtatgagttttggaactacataattcagataaaataaaatgttgacatggtttttcatttaaacactgcaactatcagagtcactatgggtactggatttattaaaacctcaaatgtttaaaaactgttggcatgattgtatgcatattttgatagagttacatgtagaagcatgttaataaaatatcagaaccaattataatagaaaccacatttaattaaaatttcctaatacaaccatattcactacattatttttacctttggtgtcattaattccctcctgactcatcccacttactaatttagaagacttaataataagaacatcactgttttctgtttcatactgaaataaggtgacactaattgctaaaatttttatcaaccactactgaggacctaggcaagtgaatattttgcctctatgaatttctcatgaaagcattttgagaccagcgttttaaagactattatttcaaaaacaatgtctgcacaagccatgaacaaatgctgaaataagatatttttattagatgttcttgttgaagcaagttggaacaagaagtggtaggaagatatttatctgtttgcacaaaaacagtaaactagatttatttgagtaatacatttatcaaaatcctgttgggagtatatgggtttgggtattcaaaaaatggatgtgagtctctctgctttccagcctgcctggtcaccttcctgcctggagacagtggtggctacatgtgcatgttttatatatctgaatattagcagtcatttgtcccaatcccacaagtgctgacaagggtcattgttggagtcatcggcacccctgcaccctctcactttgttacgctgatgttagaaatgtcacatatggaaggaagcagagcatcagacccagacgtgggcactactggagaagcagattggggcatttactaacatatagggccttcaggcatttaactcgatgaagctgagcacgatgggtgacacaatgtgtttccaattccggatgaagtattcatatatacttggaccataaatttaaaacgcgagttgtctagccattccagaaaagtcacaaagcagtgtttgtatcagttgaaagaagaactatgcagttactgatagagaagatctccccgcatccagaagatcagggaaggactatagaatagcactcgtgggaatttatctggacgttgaaagatatgtagggtgaactactataaaaaacaacatcatactcacatctttgtcactcatctatttattccaaaaactcaaaaattcagtgaacactgtattagcttcctaagactgccataacaaagtaccataacctgggtggcttagaaaaccagaaatttattatcctgcagttttgaaggctagaaggctgaaatcaagatgttagcagggttggttgctcctgagggccgtgagggagaatctgtccccggtctccctcctagcttctagaagcctcaggtattccttggcttgtgtatcagggatccccagtcccacaggggcatagaccggtaccggtccatggcctgttaggaaccgctcacaacaggagatgagtggccagcgggtaagtgagcattaccacctgagctccgcctcttgtcagatcagcggggacattagattctcttaggagcgcaaaccctattgtgaactgcgcatgggagggatgtaggttgcacactccttatgagaatctaatacctgatgatctaaggtggaaccgtttcatcccaaaaccagctcccaccacccctcacctccagtccttggaaaaattatcttccaggaaaccggtttctcatgccaaaaaggttggggactgcagttgtagatgaattctccctgtgtcttcacatcatcttctctctgtacgcgtctgtctctgtgtcaaaatgtcccctttttataaagactcctgttgtatggcattagggcccatcctagtgacctcgttttaatttgattccctctataaataccttgtctcctaataaagtcatgttctcaggttctgattacaaggtgtctttttttgcttgtcacaattctacctataacaaacacctactagtagccaggcactatatgagccactcacaaatggcacagtttctgccctcatggtgcttagtaatctagcaaatataataatcattaagaaaaaaaatttaaagaacaacaataattgattgattgttacctctatgcttaagactacgctaaatgctttaaaagcattttctcatttaatcctcaaagcaacattttgaagtaaacacggtattcactatcattagaaacagcttggtggaaagttatatttgacttgagtgtgaagaatagacttgcaattcttcagtcaaagaagaagacacatcaggaaaactgcgtaagttgaggacagaaaatgtgtgtatggtgaacagaacgagctcaaatctggttttaggagactgaaatagacaactcttcagcatggtctgtctggctgcctctctcttcctccccgggctcctccgatctgcagcatggggttcaggtggcatcccccctgcacatatgcccatgcaacccagaggcggaggacattaacacccatggtgccattcttaaccgatgggagtgaaaacggatacatcatgcttcctctttttgtgccctgggtggacagttctgagacaccattcagaaggctctcagaaggtccctgcagaatcaagcaccaggtatttatagtggtggacagctcagtaatgcatcgttgtatcgtctttctctccttttctattttactctcctgtcctgtatttctccccagaattcccatctcaaaagactcgcacaaaagccttggcctcaggttccacttttaagggactaagatcattggcatcagattttattatcccagatcagagatgaaaacaactgactcatcagtgtctttttcaaagccaagaagctgtaggcatacccagaattagcacccaagtctcttagcactcaagtctcttggcttcctgaagaacatcttccccataaaggaggtcatccagcctaaaaactctcgataatcattttcccgtataaacaccttcaagcaccttgcatgagggaaagcactttttgctcctttctacaccgtcacctccagcacggaagattggtagctgggaccccattgccagcgcttaaaaatagttttatctggagtgaagccaaaaaggcaagtcatggaagtaaaatacaaatgttctgtctcttattgtctttccattacatggaatacatacacacacacacacacacacacacacatgaatttcagctgaggagaacacacacacacaaacacacacacacacacacatacatacaaatttcagctgaggagaaattaacttgaaccaaaatgaaagagaagaggagtagggacttctgactcaaaggcaagtctacttcaattgcctgtcactaccagattaaaagttgaagcacaagagccttttgagacctctaaaattgttctctgattgctggagactttcctactgtagagaaataaatatattaatggggtacttcttcctcccacaatgtccaaagtcctgtgttttaaaaaatttatgttatagaatatttttatattgcagttctttttttttttccatctttctcctgagcaaacctttttttatatgaaggtcacaacaacttccataatgcagacaggttgtattctcttaattgttctaaaagccacatacatatgagcaaattgctgtctagattaattatagaaaatgttcaaaagaattccattattattgcagatcccattaagaggctgtaatgtatagataataattctgtttactacaatcgacatccatacacatcctggaaatatccagaaaaagacatacaggatattttaaaacacacacattgtcccattcctttatttgaccatttcccctgattttatgatgcattaatattcagtggttttgtgatttttctcattttctttctcccttttccatgggcaccattctacccctccttcggatgaagtatgtgccagtcacacagccccacagagaaagttgctgtctagctagcttgggaatttctacacttaggcagactcaggaaagtgctaggagaaggtgggtcctacaaagtgcactcctattttactactaaatgagttaagaccccagaatcttcagtctttgggaaacaatcccataacagagcctttcatgcaattgaagagcttctttcataaagagagacagacggaagaaacatcaaagaaaatactctgcattataacctcaagaagatttagaagagggaagccatttcaaagagactgttttcaaagtacatgcggccctgggggagaagagcaacttcacttattcttctcccttatacaaacaagttttcagagaagtccctctgatgaagtatatcgtactatgctcacgaacagctgtctctatgtgtgagaaagaatatttagaaacaggtagctatttactctagcaatgctactgtgtgctagtgagtcatggatgcaacaatgctggttttgattttgtctgtggaataaaatccaaaacttggtgttatcaaaagctttgcaggcctctcaaccaggtcttatgtattttctggcttgaagagatgggagtcagacctctatctcaggattcctcaacctcaacagaaggatcagattattcttcattgtggggggctgccctgtgcattgcagaatgtttagcaacaccctggcctctacccactggaagccagtagcacctactcaatcgtaacaatcaaaaatgtcttcagataatgccaaaatgtagctaggggtggagacaataaaatcgtctgtgattcagaactactgttttatattaagaacatcatgcttggaaggattttgttttaaggcctgtggctgagtgtaggatatgccaagaacatactgagttgtctaaagaagaactttctggccaggcacggtggctcatgcctgtaatcccagcacttttggaggccaaggcggccggatcacgaagtcaggagatcgagaccaacctggccaacacggtaaaaccgtctctactaaaaatacaaaaaattagccgggcgtggtggcgggcgcctgtagtcccagctactcgggaggctgaggcaggagaatggcgtgaacccgggaggtggaacttgcaatgagccgagatcgcgccactgcactccagcctgggtgacagagcgagattctgtctcaaaaaaaaaaaagaagaattttcttagataaaatttaagctgacaagaacagtagtaaagaaatattgaagggaagtgcagaagcattgctcctggctctcacaggtggacaacatgcaggtggacaatataacccagtttgctgtatttgtcagagggagggattcttattctgctctacttcctccctcttagtccccattcgaagcaggattaactgtcccctggcatatggtggttcagggtcagccaaagagcattctttccctaaaggccctctcagtaactattgggaaaagccatcttatatagccaatttagggctagaaagaaaagaattttacagagtttgcagttgaatgacagaagacagaaggaatgcaataacttaaataaatctgtagccatgtctgtggagcacggaggaatccattagggtataaggtagcaaggagacctctcaaggtggaaaaataaaaataaaaaagattagaaggaaattgcaaagtgaagaaatgagcctttctcattacttgaaagcataatctctactcataaaagcaagcagaaaaaagagacatattagattttcttataaaataaaagtaggagggacaaaaatgctgcacactcaagtgtggtgtgtgcacagtgctcaagtaacttagaaagaaataaaggtctttgacttcttggcactatattagactattcctctgttcttctaagagcatgtggctctgccagaggcaggagctataagaagggagacagaaatgcaaagaggtcatgatcttttaaaggaaatatatctcactattttttctccatttgaaaatcatgttttatttcaacctattcgatttatattttcaagtcaataataatgtataaaacatctaaaagggcttggaatgcattttataaatagtctgggaattgaagactgaaagccctaagttttctgaattcactattttaatatctctaagttccagtatctagcttgttaaggataaggtgaagtttattcacgtttataatatatttaatttttgcatccaaactatcaaaaggaagttcacaatgcttttaattctgatgcttttgtgaggagcaggtacctttctgatttctgctactgtgtaggtatctagaaatcagttatcttatgatcttatgatgtgtttatttgtttatgaagatatagccatcagcattgattgtgtggcttcactactgaccttgcctaggggaatttggacatcaaactttggatttaaaaattatttctgtggaggttaattagctttttgttagtggtgtttcctttgaatgacattcaggggaaataggagagtctgagctgacacaaaattttagatgactttgcaatagggaaattacttttttatggatgtgggtacactaatgctgttaactaacactaattaactctgcctagagacagtcccagcatctgtatgaaattagtatggttctgtcctacaaaatccacactgctaagggaggaaataaataaaggtttctgaacatccgtggaaaaataaagtgttttctgtggcactagtaaactgaaagtagtatttaatcctagataatgttttcacctcccatgcttctgtccccatcctaccaacttgtgaaaaaataggagtccaagtgtcttgttcttccagtttccaggcacccaatgtggtcctctcaataagtctctgcatcatcttcagtctctgactgagctcccagcagttccatgttttcccccattctatcctccctccaattatgtttccgaatgtgtacacatctgcttaagaaagcaaaagaatctaaaagtaattggtgtctttcttggaaaattaactcatttatttaaccagcattttattcagtacttggatgtgtccaggaaatacatgagctttggaacatctctttctgaatcagcagcttccacactgagagagtatgccagagtgaaacctagcaactgccaggaactaaatttaaatcaaattgtgtataacttaatcacaagattacgtgttatatttcctcaattgtattaacaacagtcattctaaggcaatgtttcactgtcacgggaggctggagcccagcatgccctcctgttccagtttccttattcttgccttggtttgggagctcggaatctcgatcacctgaagaccactctactggagcatcaggagcatatttggctcttgttctatcatcagagtcagccaccctcctggctctgataccctaagggcaggagaaagggaaggacaaaagtcaaaagacaggaccatgatgtaaactctaatactaaccccagcccacccactcctcaaataatttgaccaccattggacagagctgcaatacactgaaggctttatgccttcttgtgacgcttagtccctgtattagtccattttcatgtaaagaatgcctgagatggggtaatttatgaagaaaagaggtttaatgaactcacaatttcatatggctggggaagcctcaggaaacttacaatcatggcagaaggcaaaggggaagcaggcatcttcttcacaggggagcaggaaggagaatgaaagctggaggaactaccaaacacttataaaaccatcagatcttgtgaaaactcctgcattatcatgagaacagcatgggggaaccacccccatgatccagtcacttcccaccagatccctccctcaacacatggagattacaattcaagatgagatttaggtggggacacagagtcaaaccatatcagtccccttagcagacagaaacctggcactactttggaggagaaaagctggcttactttcagaaggcaaatttcaagctagaaacctggaggaatgggagaagaatctggctttacatcgttttctcattaatcagaatcttaggacttcagaagataatctcagctgtctgtgtgacatatccagtatttcatttcaagtactacattgaacacgttgacaggaatttattcattttgaaatgtaaacaaatgacacctaaagaaaattagggctggctggtttgatgagaaaagcatgactctgcagtctaaaggtgactttgtagaggctcccaatttgaatacagggtggtcctgtcctcctggtgctacagctctagaattcttaatgcacagacagaagttgccaaaagtgagtgaagagaaactcacatattgtcttcttttctcttgtataatcaaagaaatgcaagcatgagcccctgaaaagttatttacctcttttcctattatagttggaattctagtgaaattagaatagcaattatcacttaaatagctgtaataattgaagactaggatgaataagttgtaagtggcctgcttaccttcaaatgtaattcctcacaatttgcagaatgagacagtgaacctagtgtttcctttatgataaattaatcattttaaaaatgagagaaaatgctatgattttaaaacttagcatgtcttatttttaagttagtgtttcaggtgatctcagaatgttattcataatggcaccttacgatgatgatgccttcctggaaagacatgcagactgacatttagatcagtcatttccaaagacagaatatctgttaactagagaaatcctgtcccctgaactaggatagagcattgcatgaaggaaactgtgaacattgaaaatctccaagtttcaaaaattgccatgtggaaaaaatactgtactgcacagctttactttattttgtgcgatagaaacgtttcttgccaggtgcagtggctcatgcctgtaatcccagcacttgggaggccaaggcaggtggatcacctgaggtagggagttcaagaccagcctggccaacagggtgaaaccctgtctctactaaaaatacaaaaaattagccaggcatggtagtgggcacctgtaatcccagctactcaggaggctgaggcagagaattgcttgaacctgggaggtggaggttgcagtgagctgagatcacgccatttcactccagcctgggcaacaagagctaaactgtgagaaaaaaaaaaaaagaacgaaagaaagagaaagaaggaaggaaggaaagaaagagagaaagaaaagaagagaagaaagaaagaaacatttttaaaattctaactgtaattgtaaaggcataaatagaatctgatttaaaagacttaattgaatttcacacacagtgaatccttgtgaaatataagaactttttctaaaaaatatttatcttaatatatagcatgatttgcttttttttcatttcagaattggttttcttgttgaaagttatacagtaatattcgatcttttcttcaacatattaattagatttctacttaagctaaatggcaggactgttttcagtacctcaaagagagcaagggtattttgctgcattcactttctggaactctgctgcacttggcctgtggtctttctgtcaagctggttgtgatagcaagggatgctgaatgcgttcatgagttcgagaacctgggttctgagctggaagtccacatcagagcgtgcgctaagtgcaagtgcaatgagtcagaagctaatgaaaagggtccaaagtgtgcaggcaacaggggcactgtggctcctaggggcatttgccagcttggcaaagtgcttatcggagaaatgaggagtttctgacaacttgggctagtcacaggcttcatggtgaaacttattatcatcaacagcaagcccacaatagattaccgaggacagggtattgcccttgtgatcagcaagtatcacacaggaaaggtaaatgttgttgtaaaactaaaaaagtaagcccacaaaattttggaaattcttcctttgcagtccccaaacataatcctttggaatctgtctggaaagtcttttccatctgaattactaaaagcccttctaagagaaatttgaatcttggcgttgtatgagctgtgaatcactgacagacatctacagatctacagaggtacagttttctgtctgtgcttatatctacagctttaactgtataaagtgactcaatctaagccactagctcttgagacacctctgcaagatcgtgtataaacaagacctactagaattactctcaatgactttcaaattcggtactgttttattgtagaaagctgttacagagaattaaaatctccgaggcatcttcgcataccacggtgccacccatggagtgatgattgctcttaaaggctaatttgattatgtgccaccattaatggtgaaatgggaacgtttgaaaacactgttagattccagtacaacaatttccctccctacccgccaagcttacttgtatttaagttgcagaaaacatccagtgtttcttatttaaaggcctggcactctcttggcttatatgttgaggcacatgcctgagtcacactttgtgtctgatgtgcaatgaggtccccttggaaattgccacctttactctcttgccactttgtctccaccaatgagggtttcccagcccagcgcatatactctgacgaccaggccacaaacaagagcatgttggaggtgaaaagaggatgaggctctagaacagtgtcagacatttgcaacactgtatatgcttagaataggcagtcaacatgttaggaagaaacaggtaaggctttggagtcagaaaaaccggattcaaatctcccacaggccaatcacttaatttcttaggtctcagatttctcacctataaacagaagaacaaatctttctcataaaggaagctgtaagaactggaacagaaacagaataaagattattatggacaaccaataaatggtagcaatctttattactatcattacagaaaggtttgtacagctgctcaaaattatggtttggggctcattgaaattagaaaattctgtagagaaaatgtccttattgagatagcctaggacaaaccaatcttagcatctatcactgcctaccttccagggaggagtagacagcagagggaagagagatcagctttgtataatggacaaatcaaagataaaccagatagagctaacgaaatgcattctacctaaaattaaacccaatattctataactctctactaatgttacagtgtctacattgtcttcctttgttctggtttctgacttctgttctccctctccacatcttccttccattctctttctgatcatgtctatgcatctgtcaagtttatctgctgatagtataatctatgattccaaagacttaagaaggatgtaaataaatactgctgtgccaggcactatattcaccaggtgtttcatataaattagtttaactaaccttaacaacaaccttgaaaacatagcattagaaaataagggaactgggcagggcgtggtgtctcacgcctgtaatcccagcactttaggaggccgaggcgggcggatcacgagatcaggagacttgagaccatcctggctaacatggtgaaaccccgtctctactaaaaatacaaaaaattagccgggcatggtggcgggtgcctgtagtcccagctactcgggaggctgaggcaggagaatggcgtgaacctgggaggtggagcttacagtgagccaagattgtgtcactgcactctggtctgggggcagagtgagactcaatctcaaaaaaaaaagaaaagaaaaagaaaagaaaagaagggaactgaagctgttttccaattaagaagatttctgaaggtctcacagaggggagcttctgaagccagaaacttaatcgggacttacctacctcctgtgcagtgctggtgctgagtgactcgcttagctgaaacccctaaattagagctccatgctttgttttgttctgtgtcctggttgtttctctgagctccttgtgcatccagagacagcagatcaaaggcatcccttttgctgcatcctccatagctctgagacaggcctgaagaacctgaagagaatgttggactagaagagggtccattatctcactaaacgcacactaatgacctaaaaagaggctttgagattatcctttcataattttgctcagtgttctaggactatgtaagcaaatacaggcttctttgactggaagtaaattagtctaatgatgttttgtggcaatcccttccaacaacgtcaaaataatctgtttgtcatgacttgaccttattttgttataatccctgtgatatggtttggctgtgtgcccacccaaatctcatcttgaattgcaactcccataattcccatatgtcgggggagggacccaatggaggtaattgaattttgggggcaggtctttcccgtgctgttctcatgatagtaagtctcataagagctgatggttttataaaggggagttcctctatacaagctctcttacccaccaccatggaagacgtgactttgctcctcattcaccttctgccatggttgtgagggctccccatccatgtggaactgtgagtccattaaacctcttttctttataaattacccagtctcgagtatgtctttattaacagcgcgagaacagactaacacaccctgtggcagagacttgatgttatttcccaaatcttagtttgttttcctctttggcatgcaatgagactatatttcacggttttccttgcatttaggtgggcatggatgactaaattctggccaatggaatgtggctccagtagctgaaaggtggaagatctctaacatggaacatgctaccccttcccaccttcatgaccttcactgttctctgattagagcaaaagataaatttctattatctcaagctaagatctgagaaatacttgtcatagatagcctacgctgtctaatgcaatctatttcaagaatataaagcagcatccctcaactgggagtaattttgccaattagggatatggaaatgtctggacacacttaagattacaactgaggaaggggtagtattggcattaatgggtagaggccaggaatgttgctaaaaattcaaaaacataggactgtcttccacagtataaaatttttcaacccaaaatatcattaatgcagaagttgaaaaaccctgcttaaagttaagtcctctgggggaaaaattgattatctggtacacactcgataagctcttgattgactggcttctttgagaaagaacttaaaaaaataatgctatcctcatgccgacaatcttttaagcaggtatttattaggaaaaaatttagtcatagaagaagtcactgtttgtgtttcaaattttctatatataggaaattgtgctagttaattaaattggcagatttagtaaaacaaacatcttttattcacagaagtagtgtagtttacttaattgatgcacttaaatctggaggttggccattataatattagcactatgtgagaaatatgtatgctgtttaccaaaatagttaatctgagaagttgaaggaaaccttctaccctgattttggagctcctgctttgtctgcagggatttaccaattagaacaatgtatgtgatgggaattgaaatgaggccaccaaccccttttaaatgtgatattggaacagtccctggttgggaaatatacatttcagtcactggttcgcatttctttttttttaaattttttaatttatttttattttttatattgagatggagtctcaatcttgttgcccaggctggagtgcaatggtgcgatcttggctcactgcaacctctgcctcccaggttcaagcaagtctcctgcctcagccttccaagtagctgggattacaggcacctgccaccacacccagctaattttttgtatgtttttagtagagatggggtttcaccatgttggccaggctggtctgcaattcctgagctcagacgatccgcccacctcggcctcccaaagtgctgggattacaggtgtgagccaccgcgcccggccactggtttgtatttcaagtggcaaactaaaacgaacaaatatgatagaattttctagtttattttttttatttttttaaactgttgtgtttcatgtctttgctaatcatttctagttttttttgtttttttgttttttgttttttgtttttaatagtaaggatttcctctgtcttgaatgccaggaaacaagttatttccatcctggtattcattggatatttgtaagatctttattcttttgtgggatcagggagaggatgggcacccaggcgtgaacctgagaaatttctactgggtttttctggagctcctcactgtaacgtggcattgtccccaaggccagctcttcttccatgtgattttgctactcacacacgcagcaattaccatgtggcattagctgaccgtgctgggcgcagcattattattgtcattattttttcttttttgagatggagtctcgctctgttgcccaggctggagtgcagtggcaccatctcggctcactgcaagctctgcctccccggttcacgccattctcctgcctcagcctcccgagtagctggggctgcaggcgcccgccactacaccacacaaattttttgtatttttagtagagacggggtttcaccgtgttagccaggttgaactcgatctcctgactttgtgatccgcccgcctcggcctcccaaagtgctgggattacaggcgtgagccaccgcgcccggcccgtttattttaaatatcacatcctcgtaataaaaatttccctcaatgttctttgaggcatccacttaaataactcaaaaatgttttttgcattctttaagaggtttttataagccagacaaccttaataaccatggcctcaatcacagacagtaaaaatatgctttgcatttctcttctaaccctaatacctaagccagctcctggtaaaatgttatccgaacctttttactcaattcatgacaggtttttgggatatattctactttccaggcactgagttaaattctggagaccagaagaccaagacgttgtccctacactgacattttatctaatagtcctgttttcagattccttgccctaagctcttcctattttttgatttctctcctccagttctcattccatatcagagggctcctgtggatgctccatgctctacgggattgcactcttccacctgcctcccatctctccatgtaaagaggcacccaaaggagcttccactctattgactctctggagcgatgttttgcggtggccgctatgactttaccacattccaggacaagcaatttaaacctcatgcctcagatcccccacctggaatgtgagaatgatagtggtattcacctgttagggttaccatgaagatgaaataagtgaatgcctgttagttaactattaagaacagtgcctggcacatgataaatggtgttccatgttgatgttgatgctgatgttctcatccctaagttctccctttcccttttcagccagggcaattaatctgccttatgcctgatttcctcaaggctaggctttctaagtgtgggatgatcatgcttcaaataaatgaatccatattaatatactaacaggaaaagacttgagaacttccaggcacactttctttctcctctagtttaaaggaggtgagcagaagacaaatatttgtttttatccatcactacaatctgatagaaatatagaatttgtgtattcaaatatgaaccctcaaatttggattatacagaaaataacattttaagattcttacttgtattagtcagcattccatgaaagaaacatataaccaagatagatagataatagctagctaggtagctagctagatagatttagatatatagatagagtacaaagaattggcctacatgactgtggagactagataagtctgaaatcgatagggcaggccattaaaaaagagagaatggagactcccaggctgaagctgatgctgcagtccacagggagaatttcctgtcccccaggtaaacctcagttctacctttacatcctttcaactggttgaatcaggcccacccagattatggaaaataatctgctttactgaaagtgaacagattgcagatgctaacaaggtctacaaaataccttgccagcaacacccaggttagtgcttaattgaatgactgggtactgtcgcctggtcaagttgacacattgaaatgacaatcacacccctctgtgtcagatgtgtgattttgtatttattcctcacagaaatcccagggcgaggattactcctcatttcgtaagtgaggaaattatgctttcatgatctgaaatactgtgtaactcaactaaatagtaggaaccaggatttgaacacgtgattatttggctctaaaacctgttttacatgcattttctataggaagtttagtttttccttccatattcttgatctcctgcttgggacctcagtctttgtaggcatgacgcatatgtgtaagcatcgatctccaagtacataaagccacccacacatgagttattttggactttcctattgttgtatttatttatttttctgtttaacttcattagtatggaaaaatccaagttcactaactgcatttgttccagctgtaatctgtcttcattgctgattggtattttactatgcaggagaggttagaatattttactatgcagagtaatttacacacagagttgtcaccgtatcaaagccaagtttcaaacacccaagactggtccgcatactgcagttttggtaatgagtctgcctgcctagtaaaggatacctaactttgaaggatttttctccttaagaaaaaggatcccaatacctcttactggatcatagagatttccatatgttcagatccaggtagttttgctcaacgtacatatgatctacataactatatattatatatatattatacaagggcacagaacatccaataatccaattgcacacaccattacctcttctgaggcacacagacttttcccttagatcttcatactgtttacctaaaaatatttcatacacctgtacatgaaatcaaagactgctttctttaataaagcaaagggatgattttaaaggtaacttttaaaaatagcctgccagtatctgcttttatactctagaacagagtgagtgatttgttttctgtttcttgttcccatttctctttcttgccctaaagggagttggtaaaattttctgtggtttcacagggacaattttatggtagctaacagtaatatgaagcccatctatgccagagggctttgctacactggccccatctgcggagagtccaacattgattctgtcacaggcttctgtcttgagcatccaatttgcctctaagatatttcagcgtgtggagagttgttttcttgacaggcagccaaggaagccaagtatgtgattcattttcccagagagaaaaagaaaatcttcccattaattacctctcacctatttgtacaatgcagatgaagggtttgtttctcaatcaaattatattttattatacatgaagaagagactatcctttgtttcatcgcactagataatttattttataaaattgttattaactattaataattgttattacacagtgggccaatattcttttccactaaacatggatgaagtaagacagcttgcaaactcaaaacacacacacatgcatgcatgcactcaccagaaaaagagctcttgcctctggcatgatatcatctgacaagagcatagggtgctgtgcatattatttttcaggttctccaaataggaactagagcagcctgtcatatcaaatctgaacttgtccagcatttctaagcagagtcctccactcccaccttctccaatcatttaagaaatctcctttcctggtactgttcaataacagatgcactacttacatatactttttatttttttggaggcagggcctcactctgtcatccaaagttggagtgcagtggcacgatcctagttcactgtagccttgaactcctgggctcaaggaatcttcctgcctcggcctcccaagaagttggcactacaggcacatgccaccacactcactaattttttatttttttaatttttttttgtagagatatgagtctcactatgttactcaggctggtctcaaactcctggcctccagtgatcctcccacctcggcctctcaaaatgttgatattacaggtgtgagccactgtgcctggccatattttttctttgaatttactttgtacaatattgttaagctcctttttctggccatttggtctcatccaagaaatagtaagcttcttgcaaagaagaagcagacgttctcttttgagtattttcacacatccttcatgctcacagcatataatcaaagaatacaattttttgtaagacctcaacaaaattaagttccttgttcttatagttaaattagggggaagtgactgaacaggaaagctactgttaaggatatcattcctggaccaagtgcttagacacatactaatgaaagcaagtcccagcccattctagctctgaccttatctcatggaagttaccaaatcactatctacagaagcgttaaaagtccaaggagatcaaaagtatataagagctgtttcagaaaaaccagcatcttcttgaaccagagggaaactttggagacgtcatgaatttctcagaagagccctagctctagagactattatctcttgccagtactaaaaaggcttagcattttaattcagattttctatactgagacaacatatgctaaccatatttggaagcaattaaaatggtgacacccactgccatgcgcacatgtcctcattaactttgtgaatgtgttacaggcaggtaggaaagacagctagcgtctcgaaagaaaacccccgtaagtggaattggaatggcaaataatgggaacaatcataatgcaaatgtacattagaaggtcattaacaaactggtcagattacttgcaacctatgtaaaaatcagatgtaccagtacccaccaggacatatgcagattccctcccattgtagtaaaaaccatcttgagtgtaacagattgactgggtgtgtcaggctgagaggcattagcaaagctgctgtgtgcatggaagaaataaagaaggacttatggagcatgcaattgcaagttctccctgggcccaggactacatcattaagagatggctccataataacacacgctcactccccattcccatccacagaaataaagtcatggtaaacctttagcagcaagagcaaccttgaaggggaaaagtggaccaagaggcagctaaaggaaggtgatctggaaaaaaggtccagtgccaccattattaccagatgaaagggaggtaagctaaggacagaaatgtgcaaaaggctgcagtaggggtggtgtgaggcagctttcttgccaactaatcttatttaaaacctatctatcttatttgatatatcttattaggtatatcaaataagatatatcaaatataatcaaatgttgtatctgtcaggcctctgagcccaagctaagccatcatatcccctgtgacctgcacgtatacatccagatggcctgaagtaactgaagaatcacaaaagaagtgaaaatggctggtccatgccttagctgatgacattaccttgtgaaattccttctcctggctcatcctggctcaaaaggtcccccactgagcaccttgtgacccctgtccctgcctgccagcgaacaaccccctttgactgtaattttccactatccacccaaatcttataaaacggccccacccctatctcccttcgctgactcttttcggactcagtccgcctgcacccaggtgattaaaaagctttattgctcacacaaagcctgtttggtggtctcttcacacggacgagagtgaaaatatcaaacctatcttattagatacatcaatttgatatctaataatatatcaaacctctcttatttgatatatcagtatcacaggttttcttttttcttctgagaatctataagagagcctgactcttcaacggtctccaaattttgcttctctcaattcttctctctccttctctcctctattgaccctcatcagaaaatcaaggagagattggaccatactgcttggcgtcctacctttacaagaaaatctgcctcagcaatcagtagttcaagacaaatgtggtgccacattttgtctatacacccctgctaggtccccaaatgtcagcgtgattctgagtctcaaatctttgtagttccaggtaaaattgctacatcttttctccctaccagatgcctcctgtcgtcactgttgacccagagctctggctcagggtgatgtttctaccctgtggttggcttgtctttcctttagaatgcatccagagttggagttggcaaatgtagagtaggtacatattcagaaagaaagcaagacagcaaggaaggaaggaataaaggaatgagggagggagggagggagggagggaggaagggaaggaagggagggagagaaggaagggagagaaggaactaaaaatagggtgactagtttaggtatgattgtacatattttaattgccgcaaaaagatgcttccctctcctcaattaattcttctaccctgattcctcattgtatatgaaatgccatcattaaaaaaatagtttgttggttcttgtccctacaactaatactactaatactcttctataacaactactactaatattcatgaaatatataaataaataaaaataaatagtaaaaataataaagacttcacaatttagattacgtacttttgatattaaatagaaatttacacttttcataaacagactgtctttttaacttcattgcaatatgcggactaggttttattatacagataagaaattgagactcagaggagttaaataatttaatgaaattcacacagataataaattttatagttgaaatatataagcagttcttctgactttaaaatatgatccttcccacccccatatatcaagttgcatgtttttgcttgctgccttttaaaaagtagaaataatcctcggtcaaatgctgcacatgaattcacattaaagtgtctgcactctcctgctgataaagacccaaatgtggcagaaatggtacagaagaggaggcagcttgggatttggcagtcttgtgaagattcagccatggctataaacaagggtatgtggaatccaatgggagccttcttaactaccacatcccaaagaagtaacagagagctcaagcccttcagcccatttcacagatggagatgctgaggccaaggctattagacacgtccactatgctacgttagatcggtgacaaagctgattctcctgacttccagtctagtgagctttctatcatccagtcctgtccctatgtgatcagctgcataaattctgagtaaaacaactgactatattgttcaatatccactgtaacatgcaacttgctcatcagaaagttaaggctaactttttccccaacaggaaagtcagaaacaaatcatttttagtaataatgaagctctgttagaagtaccactcaccttaaaaatatgtttaggaattattaatatactctcagcattctgattttcctggctttctgaagctaagatgttgcaggagagccttcgtggctttgatcacaggcaatcaaagaggactttgtgtagcttccagggacacgctgttgctggaaaagtcggagctctgctatgcaaaagaaactgctacagaaatccccttcattcttaactccagatcgaattaggatcagaaggctcttgttcgctgcccaggagtctgtggttttaattttcttatctgcatttttctttcctgcccgttccaggtagctgtcacaaaaaatatgaaaagggtgttaatttgttgatcgttctttgctgcttctcactttcatgtttacagcaaggagaagagcaattgtttctaccagtagctttagtattttgagttctcatgtgtgtaataactatcttggtaggcccagaacacacaatctcatccaattttgaaatttggattttatgccagatggattatttcagtacggattacaaatgcttatactattctgcctagcagagtttgggtcataaaaatcattaaatgtaaaacattgcacaaagttgcccaaattgtcgtgtctctggccaaatttgtggaaataaaaggagccatgcatttgggttatttctacagtttggaaactttgactcttatcttctcttaagctactcaggaaatttccagactctaaaatctgagaggaattgttcagacagacaaaggtggtccagaatggagactttcctgatgccaaggatggcaggacccgtgagtgtccacttcacccctgtgatcctacctctcgtgaggctttactgatgaccttggcttcctctttgatgaaacttttggtggctgagcctcttgaaactgacttggacaagcttggacaaacaaccttcttttgaatcaacagagtgtaactgaaataccgttggaaaattcaaacaatactctgattaatgccagggagaaacaatatgtaaataaacccaagaacttaaatgaatacttaagaaacatacaccttgctttcacagtgttagctggaactcaggaaaggggtgttggaaaaagtggaggtggcatgtctcttttattttattgtttgagatgaaaggggattaagcatgtttaaattctaagggagaaaaaggttgctgtaaattgtgactttaaaaagactgacattaaatcacagaatatttcttcagtgggctactgaaatttatgtctgtaatcactactcatgctttctattcttttttctttgagatggagtcatgctctgtcgccaggctgaagtgcagtggtgcaatctctgctcactgccagctctgcctcccaggttcaagcgattctcctgcctcagcctcccgagtagctggaactacaggcacgtgccaccacgcccagctaatttttgtatttttagtagagacggggtttcaccatattggccaggatggtctcgatctcctgacctcgtgatccacctgcctcagcctaccaaagtgctgggattataggtgtgagccacccggcctggcccatgctttctattctttcttcaacaaactgatactatctttcttcaaccaactgatactttctgccttcgcctcttctcagggtctgccttgtttaccttaacccctgcaggaagccagatcacaattggagatttccttcctgatcatgtaaagagaacacaacaaggatttgggagattaatctgatgtgtaagagctagacatatcctactcaaaaggatgctcttactccctagccaggaccatgcataaatggcatgcccatattgctctgagactttcttttcccttatcttcccatggctgtgcagacatcagttgagactatattctttcttagtactctaatacattcaggcaggttacaatcaagtcttgcagtcctgggagctcttttgtctatttaaggtaactgtgattctctacttttatttattatttgtttggctcatagtttagctctcagggaacaattttattttcattattcctaagttcttgggagacaccttatggtatccaacaaagactaacaacaccatgcagcagtgcaaattcactctaagtaaaccgatgaaaaatagacctttaatctgattgaggtgtagaaaatggctacctaaaagtgatactttttccttttgattattttgtatggcagtaccttgagtagggaaaaaatgttttctttttctctgtgtgtaaaaatcaccaaaagttactttgaacatcaaaagaacaccactttaaattgcatttctggttgttcccttcaattggcaattctctggtttatatttgtgtgtcatctcttttaatgtcctctctaaacctgttgctcaatgattcattaaaattgataacaccctacttcagatcagccaagtcctttcacttgaactttttctcatagtcactttacaattacaatcattgagtaaaatcttaactctcttgagtgaacatttatgattttctgaattagccggaatgatatcaatacatgtgttagtgtgcacatgtgtgtagacagagaaaatgagagagaaagaaacagggagaccactgaaggaaggttatcctctgtattttattcccacagttctttgttcaaattgtgattaaatcacttatcagatcatgcaatgatgtcactatctgtatttgtccttgcccttacactgttttacccagctttgtgtttcaagggcttggcacataggcagaaatttcaaagttgtttaacaaatgtttgataaagtaattaatttcaaatcagggcccaagtgtggtacccaatccatgttctagtgtagagagatgttaaaattaaccatgcaacctaacataacagtcagcacacagaagtgcaaaatagttccaagaataattgtgctatgtgtagctcttctcttttctcgatttttattttttttttatttttgaaacggagtcccgctctgtcacccaggctggagtgcagtggcgcgatcttggctcactgcaagctccgcctcccaggttcatgccattctcctgcctcagcctcccgagtagctgggactacaggcgcccgccaccacacctggctaatttttttgtatttttagtagagaaggggtttcactgtgttagccaggatggtctcgatctcctgacctcgtgatccccccgccttggcctcccaaaatgctgggattacaggcatgagccaccatgcccggactctcttttctcaattttaagaaatacaaagtttaaaaatgttgctttgattggctaatttaccatacaatattttgtgtttcctggacccacttttcatttcataactgtcaaggacgcacaaaataccagattcaggctaaatgccaggaattaaagtcagaacaagtttgaaatgaaaataataataataattggtaagtaaccaggcagcatgacataagtattcattgagggaatcagaggccctggattttaaccctgtactctttctacctgtgggatctaagtcaagtgtattagttgtctattgctagcaatctattgctaagttatctatcagttacccaaagttatctgccttttctccaaaatgcagcagcttaatacaacacaaatttattatctcacagtttctgagtgaggaatctgggcatagcttaactgagccctctttcttgaggtctctcacaaagctacaatcatacacaagagtaaagtctcatctgcagtttcaacagcagaggcatctacttctgagtttactcgtgcagttgttgacagtattcaagtcttgaggatcgttggactgaggatctcggttgcagttagccagagggcacccccagtcccttgccatatgagcctttccaacatactctcttgttttatcaaagggtacaagctcagaaagcattagagagactctgccaccaagatacatgtcacagtcctctataatcaaatcacagaagtgacatttaaccactttctctgtattctgttgtctaggagaaagttactagccccactttcaagggaaggggactacacaagactgtgaatgccagaaggtggggatcattggaggccaccctaaagactgcccgtcacaacaagtgactacgtttctctaagccgactttcctcttctgtaaaatacaggtcaaagtgtctcctacctcatgggattgatgtggaaatcaaatagtacatttaagccctgagcatatagtgagtgctcagtaaatgttaggcatcattaggtaattacaacacaccacaaaatgtcctatgctgtccttatcccaaggactataggagtacatggaaagaacagataacaagatcttgaaaaatatagaccaaattttcagaacaagtgaagtctatcctgagacctgaatgaaggagagctgtaatcagatgaagaataagaagcaagacaatagaattccagggaggaaaaaaaaaaaaaaacctagctgagagagagcagtagtgccagctagcttgacaactaggaaggatttcttgccccctctcctcagaatgtctgctttgaaaagtggaacaaagacagaagtgatgttggaggtgtgcaaatgtgcatatgcatgcgtcaactccaccacaaggacacatggtacacaggactccacctgatggaagttggttggcctttaataaatacagaaatctctagagagtgggaaagagaaggatgaaagtgggaaaaggagtcagaattgtcatctctagatgaaaaagttttctaagtttccagggatgcctcctctgggagtgagatgccacctggctcccagctcctctcaaccagtaggtccctggaccaggaagaggcagacccccagaagaactcccttggctcatccatcctcaagaattttatttttataacttataacttatgtacacgaatttctatttttttaacttctattttaagttcaggggtacaagtgcaggttgattacataggtaaacttgtgtcatgggggtttgttgtacagattatttcatcacccaggtggtaagcctagtacccattagttattcttcttgatcttctcccttctaccaccctctgtccagtgaaaggtcccagtgtgtgttattcctcaagaattttatgacaccgtttaaatttcccaattctaacactggccaaatttgatattagcctgaaattcatttcatagcttccatattttgaggtaattatattaattttcacttgatttatgttttcctttgaatcactgatacatttagattgctcaaaataaaacaaaatattatttcttttatatatatatttttttctgagatggagtctcactctatcacccacgctagagtgcagtggctccatctcagctcactgcaacatttgcctcccgggttcaagtgattctcctacctcagcctccagagtagctaggactacaggtgcatgctaccacgcccagctaattttgtatttttagtacagacggagtttcactatgttggccaggctagtctcgaactcctaacctcaggtgatccacctgcctaggcctcccaaagtgctgggattacaggagtgagccactgtgcccagcctaaatattattttaaagtacacgctgaagagccactttcccactcccatgtctgtccaccctcttccaaagcataaatggtaaccactttaacttctctccaacttttttctttgattttctcccaacattttattttgaaattttttaaagcatgagaaaagttgcaagaattctataaacacccatatgcccttcagtgagccatcacttgacaccattctgccacatttgcttcatctctctctgtatgtatacatttacatgtatttatttgggagttaggtacagaaattctgatactttacccctatgattgaatcctcctaaagaaacatgcagaaatatctaagaacaccttgaaaaaaaaaaagaagtgaggaagggactagccccatccagcgtgaaaccatcctgtaaaggctctataattaaaacagtgatactagagcatacctagacagacataccagagaaacagcatagaatacgcagaaacagactcaagcctgtttgtggaaatttagaagcaattaaggtgccatctcaaagcaatgagaaaaaaatgttctttttaataaatggtgtggaggaaactggatagctatttggaaaaatgtaacctcagattcactatgttcataaaatacactccaaatgtgcaaaacatgaaaccatacaagtactagaagaaaccgtgagtaaatttctttagaatctaagttcaagaaaatccaagtacaatttcaaaaactgataaatttgactgtatacatgattttaaaacatcacatggcaaaaaataaaatgtgtacaagaaattcatccatgaaaccacttttagtccatatgtttactgaaccacgcagtgaggtttattattcagcattgattaatgttccgtgagttcagacggagctaggctcttttctctgagattgcctttaaagatgggttgagtgactcagtaatatacagtgttgttctgggtccaggaaatggatgttgtacttgaaggatctgctcactttgtctccaatccaagtatttaacatccttctatgtttgtgtggttctctctctttctacttaattttgcatttaatgtatttctaataaaaacatgagactcaattaaagacactcagtttgagtttggaagcatcagaagacagaaatgcttttttttctgattccttttgaacaacagaaataaattgaactcaatcatgtttgcatgaatgattctatttttgtttaaggaaatcttgcatccaaagactttgcagaattagataaattccttgtcagagttttgcaactaatttatttttatttgaaggcatatggttaagagtctttccttgacaaaataccatgaaattaattttgatgtatcactgtaaatgaggccattgtaccttctccatgattaaatattcacaaacatcacccagagctttcaaaaggactctgtttccttctctcagcaaaggcctggcaagtaacaacagtccatttcctagtgatgagtaaatgcaagaaaatatgtaaagatccaagaatttgtcaaatgaaacaacggcaatcaattttctaccactcgacctgtggaaacatgtaaagtccccaatgagattttacactataaacataactgttggataacttaaaatatggcagtttaataaaaatggtcatgttccaacagatcattcaaccagcaagctctgaaaccttctatatataaattcatatatcaagatgtatccttcaagaaatatgtgtcttctagtaggaatgtaggctgttgaaatttaaataagttattttttatcaatatgattttgaaatggttctagaattccaaaggtagaaataggaaagtctgttttctttattgcaatttttaaaaatttgcttcttggctgataagatactaaatagcagctacattcacaatgatttcagaaatgccccccaccatcacccacatttactcacagtttgttcccttttaaaatgtgacgattgctgttttgcagtgacaaaaaaaatgtattgatgttctaatttaaaaaaaacataaattaacctgtcaatgattgaacatcattaaaagagctgatcaatataataaaaatcaggtctccagtttcaagtcatggcatgagagagccatttaatgtcctaggaactcaattgcctaaattgtgcagagcaaagttttaaaaggttgcaaattgtcttaaggacaagaaaagcaccagaaaggatagtttggaggaacattgagtaagccttccaagaaggccctggcaaaggggcaatggaagagactgggattaaccaggtgtctgaggattgagtacacatcgccctggtagtacagaaaggctttctgagagaaacaagagcagtaaggtgtttaagggagttggtttctacatcttcagcttccgtagtcatcttccctaaaatctatcttcttgagaaagtagaatatttcagctatctacttggtgaattgcccttccctcccttagcaaagaaaaggccaacctctcaaccccctgagtcgtctgcagtgccttgtcacgggtataatgactcccctgtgattggtaaccatggttcccatgtaacaaatcttttagcaggttgagcactttcaaatattttcctatcaaacattaaaggagtaactaattgaattggctaatagattgttaaagatactctttgatgacagtttgctgtttgattttggcatgtggcactgaagagtttcaaagacattgctctggcagaagtctctccattcccacctccttatttctctgaacaagatttctgagctgcctcatggggtggttgtgaggatttcagttaattaataggccaggcacgatggctcacgcctgaaatcccagcactttgggagaccgaggcgggcagatcatgaggtcaggagattgagaccatcctggccaccatggtgaaaccccatctccactaaaaatacaaaaattagttgggtgtggtggcatgtacctgtagtcccaactactcgggaggctgaggcagaagaatcgcttgaaccctggaggcagaggttgcagtcagccgagattgtgccactgcactccagcctggtgacagagggagactctgtctcaaaaaaaaaaaaaagaaaaggaaaataagggcagcatgaggagcagtggctgccatgtgataaggaccatgtgggggattgatgctattattactcatactatcgttggtttatgttgcttgatgaatcgtgtactaataaacaatgtaatagtcacttaatccagaagaagttttttcaattgaaatcattttggtcacagaaaactaaaattaatgcatattataaacagtgtgtttgtgtatgtgtgtgcatgtgtgtgcatgtgcatgtgtgttgcacaacatatgacagttatctataaaacatctccaaatcataaaaacactttatggtaaaattatggtggaagaagttcaaagagaaaggtgataatataaaaagagtgaaaaacaacttagtgtgtatttttaaatggatgttggtggaaatcaaatcacactggcgtttatattctactgcatattttaattgagtaaaataattacttttaaatgccaatattttgaggatgttggaaattatatatttggcagtatttaaaatcactataaaatttgtttacatattgttcaaaattacttttttggggagaaaagaacaaaaatgtctgaagacctctgctttgtaccatataaaatgaatgcacgatgttcctttactcttcctaatcttcatactactgtcagagtaaccagctaactgccctggcttggtcttatctctccctagacttcttcaattctacactgccttttggattttaggaaaaatctaaactcttcagtgcagtttacaagccctacaaatattctcccacatccctttcctgtctctacttctgtaattttgcatgacttcaacttctatccacacagaaccactggttatgggaactatccttggtctctccccctcccttattccgtttcctctccctagaatgtcttctgtttctcatcacattcagatctctgtttaaatgtcatcttgccagagagacctacctggaccatcctatctaaaataggagtctgtctccatcactcttaaccccctcattccgctttatttgtaatcacagcacttttcactgcctgtcattatattatatttttaatgtcctttttctccaatgtactataattttcatgaaggcagcaactaggtctacctttttcactcctgtacccctattgcctcaaaaccattctggcacattgtagacagccaataaatattttaaatgaatgcatacataaataagaaaatgtctaatttgatttttgtgtccccagcacagtttaatttcgcaataaatgtgtactgacttgaagacattacaaaaggctgcattattgtttccaagagcaatatctagtttctttatctgaagatattttagtaaatgacaagtggtttttgtttctaaaagaagcaaaataaagaataagaactttactagataatcaagttccttttacattctatgactttatgataattcaagatagatagatgcgttaaaaataatcaccttgtacagtctgtgaattcatattctctgaaatatagttcctccacagaaaccacttggagatgctaccatatctgagagaaaaagaaaaagtcgttgctttgttttcaaattaatcatttattgtttccatacaatttattttcttcagtgtcttaagcacaaaggatcatttctgcttttaccctttcaagtttcatttctgtgggatatttaacaatgcaagagacttgcaaaagaagtcaactctctccaagtgactgcaaaaagatttgaaatccatcctcttggtatgatggaggtaacacctcaaaaactgtttgcttcttctgaatgtagtttggaatcttctcaaaggtgggaagatggttgtaattattaaagatggctttataagagaaatgcatgcatatacacatatgagtgttcgtgagcacacatatacacaccccacacaaacagataaagtgggagaattaggagcacaagtgagtcactatcagcaaaatttcccaagtgggaaacctcactgaagtcagttcatccaaacctctctgtctgcccagtgcaacgcacttccattcagttctgtgctgcctcctgacctgcctttgtagactagcttcttgagctgtctctatggttgctctcagccatttctaaataatccactctggtagtgtgggggagatttgcttcctataatcaaataaatggagtttttcaaggagcagaatagttcacaaaaaaatcaatagcgtataaataaagttgccttcatgggagataaacaaatacatgtgctcaccctcaaagtcatgttatgggatgtaaaatacttcccagacttgtgtctcagatggtgatcgcatctgacaggaatatttgttcattgcatcaatgctaaagtaattttatttcatgtttccagagtggagggtagaaaaccttcacgtgacctccatccttggcacctgccatgaaatggtaaaagccaacttgaattaaaggcttgggttgccccagatgggccggcaaagccttctttaatgtgttagcatgagatttgaagtgagtatatgagaagaaaagctaaaaacccaactaaaacattagttattcccaaggtttggatatggatgtgggaaaagaaggctctaactgatgtgctaaaaacagttttctctttcacgtctccttctggaatgtgccccttttattttgtcattcttggctcggctccccacttttcaagcctcctcagtcgtttcattctgcctgagtatttcctttccaatattttggctgaatgttcagctttgtaagcagaaatgcaaagtgagcgctttgaaacattacccaataaaatccaattttaaacagttagagctacaacttcccccatcctctgggaaatgagcctacagtttctttgtgcttcaagcagaaatgttagagccagaattactgcccaggccagagtctcgccaagaccatcagataagccacctgggcaaggtcttacaggccacacttaaaaggggacttcttggaaacatcaagctgtctttggaaattgttaagcataggtgactttcatattgtgggtaaaacataaatggagaatacatctagaagtatgaacatacttattctctgaaaaaaaactcacattttcttaagtgatctttaagaaataattgttaataatgaaaatgtcgggttgagcatggttgttcacgcctgtaatcccagcactctgggaggccgaggtgggtggattacctgaggtcaggagtttgagaccagcctgaccaacatggtgaaaccccgtctctactaaaaaatacaaaaatcagtcagccatggtggtgggcgcctgtaatcccagctacttgggagactgaggcaggagaattgcttgaacccaggaggcagaggttgcagtgatccaaaatcacaccattgcactccagcctgggcgacagagcaagactccatctcaaaaaaaaaaaaagaaaaggaaagaaaaagaaaaagaaaatgtgaagaccaaaacaagcattgttaaagtctaaagtaaactttccctttcataaaaatgcccacttaataaatatttaaatgaatttatgaaacatatccttaaggttaataatactaattttcagggccaggtacagtggctcatgcctgtaatcccagcactttgggaggctgaggaggaaggatcacttgaagtcaggagttccaaaccagcctggccaccatagtgacaccttgtctctacaaatataaaaaaagttagccaggtggtagcatgcacctgtggtcccagctacttgggaggctgaagttggagaatcagttgagtccagttgagtccagttgagtggaggctgctgtgagctgtgattgtaccactgcactccagcctaggcagcaaagagaaactctatctcaaaaataatcataatcataatcataatcataataacaataccagttttcagacagtatctgatttttataactctttctgaggagatcaatactacaatgcctgcttcacaggtaatgaaactgaggcctaaaggaaataggctgtttacaaatattctatgagcacagtcactacaatgagttttaattgctttctatgtctttagacctaattttgtcttggggtcgtgctagggaaaaacatttgacttgatttctttttatatttcacttaatattctttatatgttatgaccttgcttaacttctttcacttattcccttttctttagtattggcaatgtaccaatctcttcaaatatgttttcaattttttttttttttttttttgagacggagtctcactctgtcgcccaggctggagtgcagtggcgcgatcagcctcccaagtagctgggactacaggtgcatgctaccatgcccggctaatttttgtaattttaatagagacggggttttgccatattggtcaggctggtctcaaactcttgaccttaggtgatccacccgcctcgacctcccaaagtgctgggattacagtcctgagcaaccgtgcccagccgatgttttcaacttttggttacacacagactcaccctgcatacaagtatgatatggttacttagtcatatccatgtgtccccaagagaagagaatagcatatataagttgttccaagccactagaagatttggggtgcaatgaggaagacattaaagacataaaattatatctgtcaataggatgaaattaggactgtcaccagctcatattgtgcctttgtgagaattagaaagcggtacccctctgaatgaacacagcctcactttatgagttggacttgacaccttcttgccactgaaccaccctcatgctgagagaaacagtgatggaattcacctaaagtgaacacagttcagagtcaattctaataaggatccatgcatgaatttaatgaatatttatcagttatctatgtcagatagttttttaggctctggagatccacgatgaataaagcaaagtcctttctttcatgaaatctatgttcttgttggggagatggaaaattaacatggtaggttctgaaccatgctatgaagagcaatgagatgtagagtatggggaaagaaaacaggcagtctagagtttttgagtgtgctctgacttggataggcagggaggtctctttgagaaagtaacattaggttggagagcaggcaatttaaggagtgtgcaagttggaggtccctgcatgccaggccaagaaagcaaagtacaaaatgcactgaggcaggttctctgatgtgtgagaagaatcccaagaaggcaaaagagatgagagcaaaatggtggggaattagtaggaaacagaatgcagaggtcattagagctatgtcaaagaggcaatggtgacaagaatgttgagttcaattctgagtaagaaaggaagacaataaagaactttgataaaaggaggctgggctcagtggctcatgcctgtaatccaagaaatttgggaggcccaggggggtggatctcttgagcccaagagttcaagactagtttgggcaacatggtgaaaccctatccctgcaaaaacaaaaaaattagccaggcatggtgtcacgtggctatagtcccaactacccaggaggctgaggtgggaggatcactggagtcgaggctgcagtgagctgtgattgtgccactgcactccaccctgggcaagagagtaagactctgtctcaaaagaaaagaaaagaaaagaaaagaaaagaaaagaaaagaaaagaaaagaaaagaaaagaaaagaaaagaaaagaaaagtgctatgatccagtatatccattaaaaggatcactctgtctgtagtgtgggaagtggaccaatgggccaaagtgcgagccagaaggacagagtggaggctaagccataattctagaaaggaaggccagtagcctggatggagtggtagtgatggaggtgcttggaagtggggcatttttatttataagcctcttcagattaaataagcctcttcagattaggccaataatgttctggagcaagtttgtattggctcacaagagccaactgttaaattttcaggaatgttgcaagcctattgttaaacacagccattatgaaaaaattgaattacacaaacttacaattaaatatcttatattaaaataaaagtaaatattaaaaatacatagtaaatataatagtaaaactaattatttccctgtattttactattacctatgccttacagttttacatctactatatccatatactaaaaatgtcatacaatgatgtgctactgtgcatctcttttaactgcactgagtgacattatgttagtaaatggtaactggcaatcatgggaatatttaccccttgtaaatctacatctataaacgctaacagaggttcatgtgattgtcgagcaaaacaatccttttcctcaaaatgaaacattttcttcatcacttaagaaagtgatgaagaaatgttaataattcagatttaacttaaaagtgcaccatgtcaagtgctgaagctaaaagaggttttagtttaatgaatataatttgcataagaatgggaaagttttaaagtagcccacaaatttaattacaacaatttttttgaaaaaaaaattaggggattaggatgcaactttatttataaaactatgttcaaatttcaactataagctggatacagatatacaaatttagcaaaaatcaggaaaaaatgttcatatagctagaatatagcaagactcaattggctatatagaatttatgataaatagcattgtgtattttattattatttataagttattggtatacattctaatatcagtaaaatttatatataaacacacatagagttttgagagctggttcttaaatatttaaccagctctggataaggctctcctatgttggtatttagaatttgaaaattatttacacaaaccatccatggtaaatcaaagcatagaaaaatctcgaaatatatggcagatattcatttagtagtagcaaggccccaaggaacagcactgcaaaagcatctccctcagtcaaaatgtaaccgcctgtagaagtaaaacataaatttcactcatatttttatataaattaagttcaatgccacatgctacttaaatgaaaatacttctaaatctaaaccattaaacataataccattttccgtggcattttttcacatttgtcttgttcatcatgaaaattaaccacagatattgctggttaaatagttgccattttgatcttctgaggcttacagtcacacagaactaggatgtagttaaaggaatatattaatctcacggaaattcagatcccatttgttttcatccaaaatcgagtgaggcaaataaactaaccctattccactactagcatatccacaaatacatctccaatggatagaagttattctctcccaatcctctgagaacttttttccttatttaaatatatcattgatatccgtggggtaaagtcaatggcatatctctcttaaagtgatatttatgatatttaacatttaacaacttaaaacttctctatcttaatacaactcaaaaattaatctactggccaactcaaagacagattgttaataatcatgattgcaatctacttaagttgcccatttaggatgcatcacttgaagaaaatcaacagttaattagctattattgttagccccaaattacagttgccagcgccagtggttggggaaaaacagtgactgcagcaatggaaggtggataatgtgtgccattatcaatttgacactaaaaatagtgttgccttcagcccctatgtttgaaggtgctgatgggttttgtacctttctcccaaacttccatgcctatcccccaaagcctggattcttcacatctggaagagaaactttcccaggatgcagaactgggagtttcaggcaaactgggatactttattaccctactttaggtagaaatccaaacgcagtttaaattacaacggtcgttcaaagagttcatggaaagtgcttattatgagaaagaattacgcaaggatttcaattgtttgcaccaaaataaactcacattaacttattataacaaatatgaacacaatctagtttgagtcactaagaaggagaagacatctgtttgaaaagagctcctatatgagtaacataaattctgctaaaattgaaggaagaacaaacatcaaatttatgatggagcttaggtggaagaatgatgaaaatcactgatgctttacaagaagtttatgggacaatgccccaaagaaataagcagtttacaaatggataactcattttaagatggtatgagatgatgttgaagatgaagcctctagcggtagagcatccacatcaatttgtaaggaaaaaattcatctggttcgtgttctaattgatggtgatcaacaattaacagcagaaacaatagccaacaccacagacatctcaatttgttcagcttacacatttccgatttaaaaattaaaatggagcaaattttccagttgatgggtgccaaaactgttgtgcccagatcagctatagacaagaatagagctctcaatggaaattttaagcaagtggtatcaagatcttgaagcatttatttgaagaatttaataggagatgaaacatggcttcaccagtatgatcctgaagacaaagcataatcaaagcaatggctaccaagaggtggatgtggtcaagtcaaagtaaaagcaaactgctcaagagctaaggttatggcaacagttttttggggatgctgaaggcattttgcttgtcaattttctggagggccaaaatgataacatctgcttattatgagagtgtttcaagaaagttggccaaagttttcgcagaaaagcacctgggaaaacatcaccagagagtcctcctccactatgacagtgctcctgctcattcctctcatcaaacaagggcaattttgtgaaagttttgatgggaaaccatcaggcatccaccttacagtcctcatttgcctccttctaacttctttttgtttcctaatcttaaagaatctttaaggggaacccatttttcttcagctagtaatgagaaaaagaatgcattgacatggttaaattcccaggaatctcagttctttagagatagactaaatggctgctatcactgcttacaaaactgtcttaaacttgttgaatgatatgatgagaaataaggtttatatttttattttatcttttaatttcatttttaatgaattttttgaagttccctcatgtcccataggacaaaagtgtaggctaaagataccgtggctatgaatgtcatgatggtaaatgaaatcacaaaagaattgtgaatagaaagagagaatggtaaaataaataaatgagcaaacaaacccaggaaatatcaatattatggagcaggctgaggaagagaagctaataaaactagaagaaattagaggataaaaagagagccaggaaacagctatgcaagttcagctaagttctgtcttgcaaatacatcccatagctatatctgtgagcagatgaaatttcccttggattgatgtaatcggctatttgaaatcttatctgcagtttctcagaaattttcactctgaagagctcatttacattgaaaactattcttcagaatattgagacacataaatactttggtttaaaaagaattcctgtgccattcctgagatattttgattggtgttaagatttcctctgcttatcctgttttgcatgcatattctaaaatacctacctctcagaagggaattcaacagataaaatttccttctgagtggtggtattatttaaaaaaatacaataattattataagtagttcatttgtgctgtagaaagtgaaaaaataaatttataccgcaattatgtactttgtagaattgaacagttccttcaggtacggactggccaactagggatttaagcactgtttacaaattactgggcgaactgccataactcagaaattctgcttttctggaaaaggggaccacatttaaagtaataaaaccattgggaaaatgtagtgattatgacatgtttgctataatagtgtcgaagtcatgcatcttggcatttgctttcttctttcaatccagggagagattagaagttgaaaatcggtattaaaccatcttaattgttttcatgggcatccagagcatgtaaaaacagccaaaactgctcttcagaatcctcagactcaaaatcactttttaagtttaggatgaaaactcaattcaaaatatacagatccaccctcttacatataggtaacatctccagaaactatctttctctactacagttacagacatgaaaaataccttcaagtggtgaaaactgaaaaagctcaggccctttaggataaatgaagtttcaggacactcactagatcttatgactacctaacccattgttcttacatcacagcctatataatttatttattctgttgcctatttatttccctgtctaccctggtagaatgtaagctcacctggcaaggattttgcctgttgttcactgatcatctgaagaggtgcctgtaggtgttcaatcatttgttgcagaaatgatactgaatatgacaaacaccacagcatgactagtggtctgactaatgtccttcctaaatgaaaggccctgagcagtggattttgggggaaaacaatagggcaggcttccaaagggtgccactgctgccaagattctccacctcctaccttcctttttttgacttttctgctgactagggcttcttccggcatgaaataataagaaatgcccagcctcaaccattcaccaaacttccttctttcctcagcactcaagaaacctctagactcgatggccagagaaactggaaaggacttgaagcccagggttacaaaaagtggtatttccaacacattatgagtcaaggaagctttggggaatgggatgaggattgattaggtccccaatcacaatcactcatcttactccttggggaaaaaaacctctgagttccaactaatcaaaatccagatgacaacttggaaagccacacattcaatgcattcatgagttggaacctacttatatggtatcgcctcttctttcacatcatgctaatcaagttttcctattcttcttccctgtccatgctacttaaaactgcaaactatctcttacttaatccttctagttttctctttgatttcttgttaccagctgccatctcttaggtcagatgcatattttatgtatttattctgtttattgttttatcttcccttgttctgctagactacagctctatgaaggcaaggaatgtatcggtttttgttcacctttgtatccctagggcccagagcagtgcctagcacatggtgaacgtccatcagttatttgttgactgaagaaatgtataatctaattgacacactgcattctccacttataagctattatgatacaacccttcatccacactgtgatgtaatgatttatagcagtgaaatatgatcgacagtgctaactctcacatcctcattcttatagcacttgctcatgggtctcatccaccacctgcatcccttggcccttcactcatctcttcactgagtccattgtattcttactttgttccttattcgacctaggccctatcccccttcatgtcaagtttcctctcaccaattcactgagccttgctgaccttggccttctatcacatattccctgcagtttcccaaacctaaataattgaatccatcctgcacatgagtagccaatcaccaccagagaaaatataattgtgtggatgctattacaatagtatggttttgaacttcagcttgaacctcagtgctgcttggcaaggtttatacaatggttaattttatatgacaacttgattgagctaaggaatacctgggtagctgataaaccattatttctgggtgttcctggagaagatgagcatttgaatcagtagatgagtaaagaagactgctctcctcaatgtgggtgggcttcatctcacccattgagggcctaaacaaaacaaaatggtagagggagggcggatctgctgtctgcttgagttgagacatccctcttctcagcagtgctcccagttcttagacctttggactcagactggcttttccggggctccgcttacaggcggcagattatgggacataatcagattatgggcagatgatggaggctaaaaacagcctccataactgtgtgaaccaatccctcatcataaatttatttcattctatctatttatatcccattgattctgtgtctttgaagaaccctgactaatacagttggtcactgacatgttctctgtccagttttctacttccctacatggacagttccggacatttacacttcaagcctcttacaagagagaatagaaactattatgtgtgaattcccttaactttcgcctgctcccgtttataaacctatctctcctcatactcatgcagttaggtcttctctgcattcccaccatgggtggcctggccctctcctcagatactggccatatgaacctcataggataagagcaaaggtgtggtttctactgcagacagcacagaatggaaaggattctaaagcaattgtcaatatacagtaccattatatcaagttttataaagaaaattctattatttctatgtctaactcatcatcctcgaaaaacaatgtgataaacaaaacactccaaatttctcattgtaattgaatagtttatataaatccctaaaaatatgttcctatcctttgctccacttctaaaaattgactccaaggccaagcacggtagctcatgcctgtaatcccagcactttggaaggctgaggcagatggatcacctgagctcaggagcttgagaccagcctgggcaacatgatgagaccccatctctaccgaaaatacaaaaaatttttcttgcatgcctgtgctcctaactactcggaatctgaggtggaaggatcgcttgagcctggaaagaagaggtttcagtgagctgagatcaagatcgcaccactgcactgcaacctgggtgacagagtgagaccctgtctcagaaaaaataaaaaatatatataaataaaaataaatataaaaattgaccccaaaataatacagtagacagatttagattatatgaacattaagattattgtttataattttctgatattagaagtaaagcttttatatacatatgtatatacctatatatgtgtctacatgtaccaataacaattgtaaacaataatttaaatgtttgtacataagaaggattaaataaattatagtcaatttatataatagggttttatgtaaccattaaatagtatgttagatatttaatgatataaaaatgattacaatgttgttttatgaataataaattatataaaactatatagagagcttaacaatgttttgaaaatatacactcaaaagaaatactccaaaatattaagcagagttatgtctttgtgatggaattataggggattttaagtttgttctttgtgtacgatattattcacataagcgtaataacaaatgacattttaaaagtacatgttgaagctcacatattttgactttctaaattagaaggggtgtgtgtgtgcatgtttaatatataattaggcataaaagtcactttggcttgttgatgtcaggcaaattgtatttcatctatgagaaaaaaaccagagtgcttttacaaaaccctaaaaatacatcaagaatgctgacaaagagttaaatattctggccttgaaactatcctcattttcctaaaatacatttcttaaatattcatttccttctgctcacataaagactgataaatctcattcagtcctaattgcattggtttgatgatcaaaacaggcatttcctcttcctcatgacaggagggggttttttaagcagaccaagcacaaaagccttttctgctaatttccccattttgacatgagtgaatactatctgtctttccacctgaaccagatctcattctaatgggcattaaaatcccttttgaaaatgtattaatgctctagttgtaagatacctttgggaacgtgctgaagtgtaaagtctgaaaaatcagaaatccacccttgttttgcgtgtgggaggcagacgagacaatcatttattgcggagagaaaaggtatgctctattggcctttacaaaagctgtaattttattttgaagtcctcaagttttgttctcctggtttatggttttatgctaaaattatggctttgtaataggttgtgaggcatactttatgcactctcataattataagctattacagttcattctttgtatcaggatggttttatggacgtttaaatgaagtttccgacaatgaagctatggttctaataggactacattatggctacacctggtcgtatgcagtctcttggattttctaccatgaactattgggaagaggagggtgggatttcaaacagctgcttgcctcacactgagctctagcacgatatgtggatttatcaatccatttgtatttaaataatgtatatgcttgttccctcactgagccacaaagccatcaaagagaaagatcatcctagtgattttatattctttttgccaaggaagacacctgaaagtttaaaaacataaaacacagtgagtcacttgtccttttccccaacgaggaagataagaattggcaggttgttgcttactctccaatgtttacttactagcaatgatctgttagcatgtgccaagggtcatttctcacggcatttatatttactatggttttggttatttcttactgaaatgctgttgaagatggtgaccttgttcgcaatcgcttgcagttgagcattcaatgagaacacacttctccagctggagggagcgttgactgagtggactctcagaaaaggtgtaattaataattttaaacatcccatgtggcagtagagtttctttttttttttttttttttaggtggcaaagggaccaaggtttcagtagctttctgaaggaattcgactaaagtcaatgataaaaatatgaaagtgaaattaagcacgactgagtgtcaaattcccacgttaaatgacctccaagaaaaggaagaaactccaattaagataacaaaataaaacatacgctaagaaaagattacatgctcccacaaagcaaggatgtgagaagcggcacttagggctcctgtagccccttaattcaggctctattatgcccacgaattagaggacatatgctcttctatcaaattgttccacaccactggggaaagtatttatttcattactgtgagctaagtatctttaaatcattgctgtgcaaatgcagcctccaaagaaaatttaatgtattctttaaaaagaagtcaacagtatcataaaacgtctctcccatatttagttgtagaatccgtttggcttccctctttaagactcccagttcttgcatattttaacacttctataaagctgtaaataggggtattgcaggctattttcactcaatgctttagaattcactaatgaagatgagagtgaggatttccaaatataggaacagccctcagtggatgaagaaatgaatcctgccagattgatagttgcccaacaacaatcgtatctcagacacctgacctaactctcgcctacaacataggaagggccagtgatgtaggcctttttccccacagggaattatttcattctcatcttccacatcataaaaatgaatcagttgcaaaatttgggacattcaaacaaccatttgactgatgtcacgctaaaggaattatctggttaattacttggccacgaggatcgattttgtagttgtggttgtattcatattaaagctgtcttcttctacatatacatagcccaagtggatcttataaaaattatatatgtacatctccaaaagagggcacaacatttcaaaccaattaggcataatattcctgggctaatgttcttgttgattacattggttcatgaatggaaagtgcaggataagacctatggaacagctgtgattttcccaatatttgcttgaatttacacatcagtgaaatcaggagtaatactaagaaagaaagggcagttagtttctttgcttagagctgcttgtgttagctttagaaagtatagatagagtaaaaacaatattggagttccaaaaaaaaaagaatgagtaaaaatgtactcctgtacttcaggaatgcaataactccattattcatcatcaggaagatttctaaaggctggtccattgttccatatgcattaattgtgactacacttagaaaattgcctaatattagaaaaactgcactctaaaataggtttcccaatatctctgatatgaatcaactggaagtgtattaaaacaagacaaagcaaatttctaacttcttcacttggaaatcctgacaatctgtttatctatttgtttcaataagctctcctttccctcatgttctgtgattcctctcatgagagaaatttgggagcaattactctaaaactactcggaagataaatatagctcaatagcttactaaatctgtaaagcatgatgaaagcttgaatgataaaaatgtgcttttaaaaatagttgtaataattataacagttaagattcaattccagatgcctttataatgagaaataaattccaatagctaatacttttaattatttgctggaaaacagtattctcaaattttaaattaaagaaatgaattagaatttatctatttcttcatttaaaggagagcatttccaaactataaattttagctagtaataattttttttggtagaaacagggtctccctgtgttgcccaggctggtcttgaactcctgggctcaagtcaatcctcttggcctcccaaagtgctgggattacaggtatgtcagctactgtgttggacccaaatatttttcagtatctttttatccagtaataagtgttacttgaagaaaacttaaaattgagatagacataaacagtaaattacaaatcttctatgatcaaatttcctaaaattaactgctacgaacattttattcaatatatttctaaacttttttaagacatagaatcttgattttagtttcttaaatctcaattcaatctctttgctttgccttcttatgtggttgtagcgtaggaaagaacacaatggcaaatagcagaatagatttgtgggaaatggataggaaattaataatatttttgttttctgattctccatataatttgtatataatgtatgttacagcacgtattttcatttttcaaatctttcaactaccacctaatcttagtttacaatggctaaaaaagaaaataaaagtattagtttgggagttttttttttttttttacttttatttatttacttttttttgagacagagtctctctcagtcacccaggctggagtgcagtggcacgatctcagctcactgcaagctctgcctcccgggttcacaccattctcctgcctcacccacctgagtagctgggactacaggcgcccaccaccacacctggctaattttttgtatttttagtagagatggggtttcatcgtgttagccaggatggtctcgatctcctgaccctgtgatctgcccatctcagcctcccaaagtgcttttttaaattttttagtttttatgataataccctccaaccaggctgttgtttagaagaaagtgaccacaaatctgctgtgagtcatctctgccttgatcaatgtccttcttctaattagagcatccattatcagtgaggaccacagggaaggcagcatatctcagggtatgttattatgacagaggtaagcatactcaagctcttccaaggtcagagatttattttaataagacctaattttcaaagggccttatgagaaacccaaattgcttaggaaataagaattttcttcctttcatcgacaggaaatacattgttaataattttattgtggaaaaattctttctccaaatgccttgtacccatgagtgtcatgcaaccctgagctttgtctattgcattccttggaactgaacaacagtagttcaggaggaaggcatggacatttagaggtaacgagatgcaggagaggctattgaagggtagatggaaggggcaccaaaccaagacttaaacattgtatagtttttctagacttcaataagtagagtttctttctcactgcagtcagagattttacaggctgttaatcctgggacaccctgcttctaaggtagttttttgtttgcttgtgtattttaaacttggggaacataatatctgcctatttcctacctcttcttcttcctttattttttttttttggtatgtattctcctgctactctcattcattctctttctattgtccattgattgctttttagtcacttgcatttttttttcattttgcccattgtcgattcagcttcctaaggcccttttcatgaaaggaggatttacagatctccccgctatagccctgcaccactgtgggtgtaacctgctgtgaacttttaagagaaagcggctggtctctcactgcgatctttctctgcccttttcatccacaatgttccccaaagctttgacttttatcatgtggttatctaataaatgtctgtaaagttatgtagaaaagggaaaaccttccatctatcctcggagggttcaataactgagtctatgaaacaaactgacaacaagcacatcaacaggaaaaaagatatgcaaatttttacatgctcaaggacaccataggaaagaaaagtgagtgctcaataacactgtgagctcaagcagcttatacaccttcttcataggggagaggggagggggatgtaagcaacttagggggagagtaaatgattttggggaaagaggaatgagccctcggaagaataggtgatagcctgagacaaagtctgtctgggagtggggtcaacttccagtctcctctccggtgataggagtttaatcttacctggttaatgagattctcagggagaggattctagaatattgcattccttttggagtatctatcaaaggaggctctttgtggtgacatttcctgaactctttcagttttatctgcttgtgtaaaataaaggtgcatagcttcataataaggatggaaaccttgtaatgttaacggagtgtgaattgtaacaacatttctggggtgcgtgtgtgtacgcttaggaagcactcagtaatctctcatggaggtgatcgaagctgagtaagagtgttccagcaggcgaagtagaagaggtgactgctgtaaaccgaagctccatgagccggccagctattccagatgctgcttgggagtttcagccctttctcagttggatgagctccatatgccattgagatgtatacatacacacatatacacacacgcagcatacacacacacacacacatatacacacacatgcaactggttgctctatcacttaacttcaaacgaacaagctaaatctagtgcctggtagagaggggctataccccaaggacatattagctggcacaggcacttagaggtagcaagatttttctgaatcagagataggctgataggctacatctggtactaacttgtaaataagaaaatgtgttcatagatgcaaacagcatagaataaagtaagtcatattttataaagacagtggaacaataaaataaaataataatctgagaaatatgtgcacacagttttaaaaaacacgatggtctaacaatagtgattcatgtgactcagggattgtggagccatggcaagggctttatttattatctggataaataatgttcttcttttatcatgtaaaagcatgatcagaagaaatctaattagaaattagaacgttcaaattttaatgaagtcttgagcagcttggatccttttcctacttaaaagtatttttaaaatgaaagaaaggaaaattcagaaatgactttattgtgattagcttttaacctgtatttctgaaatatgctatagtctgtgaaatgtattatgtaagtgaatcaagataaatagtctttttcctttaataaaggggagagggccaaattgcataggagccttgaaacatgaattatgccaactggtcctttgggaaatatctctcaattagaaagcttaattcaaactgatccccttgggaaacagtgagtctcattgcttaatatgcataatgggatttttatattgtacagaagctgttgtcaaagaggatagagacatgctgcagagcttttaaagctgagatgcctggcaggggatgatgaccatgctggctggagaaaaaaaaaatcatctctgtgagcccatgtttctttcttctttctttgaagcttagttgaatatttgaaacctatatgttttaaattcttctcaaggaatttagccctaattttacagagttatattttttacaaagaaatgtagaaactgatgaagataaaggaacaagctctgctctgtaaggctgaaaagttactttattgatggaaaatcccagaagttttaggatcttgccttatcaattgcttttacaattgactcagagaatgattcctcaagtcttgggtgggtgatagctgaagatagaaaaatttgtaaagtatactatcactaaggaaaaaaatttcatctagataaaagtattttttctagataaaaataccagataaaaatactagataaatattttttctagataaaattatatataaagtagtacatatatataaaaaagcttttatctagataactttcaatggcaaaactgcaattacttttgcaccaatcatatatatatatatatatatgtatatacacacacacacctttctactgtaactactggctcaaggacatgaattctgtgcatttctgtatctccaaagtcaaatctattttgaccagaacagaagttgaagcaaagtgcaaatgcaatagaaatgtcactatgatttttgcacattgtaacttttaaagaaacagtttcacaacttctcccttcagaacactaaagggtgtctttgagcagtaagagctgagctaaggagtgcaaaggcactgagcactagaatgccccataacagagggtttctgattatgcacatcagctcttcttttctcaaagcaaactctgacaagtcacccactttggctctatgtcttggcggtaaacatgtgatcatgctttgccattgtcaagggctcctgtgcacctgccgctttccaagctctgacctatgaataataaatgtattgcttaagcaaatatttcttgcaatatgcaaggcctatgacatctctttgaatcactgttgaaaccaggaaatgaagctgagaccctgattcatcctgtctctcaccatcccattattaacaatgtcataaagcaacagcaaatctggttcataccttttgatacattctcatgatgtattttccaaggaaaccaggtttgtgagtttgtgttttagacgcatatgagtgtttatgaggcttctagttactccattttttttggtaagtggataaataataaatgaaaacaagtgttttgtaaccatactgactcaattccaatccagactcttacatttgccaactatgtgacagaaggaaagctgcttaacatctcagagcctcagtttgctcttctaaaaaattaggcttatagtatctgtattagtccattatcatgctgctatgaagaaataaccaagactgagtaatttataaaaaagagatttaattgacttatagtttagcatggctcaggaggcctcaggaaacttacaattatggtggaaggggcagcaaacacatccttcttcacatggtggcaggaaggagaagtaccaagcaaagggggaaatgtcccttataaaaccatcagatcttgtgagaactcactcactaacatgataacagcatagggtaaccacccccatgattcaattatctcccactgggcccctcccacaatacaaggtaattatgggaactaaaattcgagatgagatttgagtggggacacagccaaaccatgtcattcagccctttgcccctcccaaatctcatgttctcacatttcaaaacatgatcatgcctttccaacagtcccccaaagtcttagctcattctggcattaacccaaaagtccaagtccaaagtcttatctgaaacaaggcaagtcccttccaactatgagcctgtgaaatcaaaagcaagttagttgtttcctaggtacaattgggggtgtagacattgggtaaatataccaaatgaaagaaattggccaaaacaaaggggccacaggccccaagcaagtccaaactccaataaggcagtcattaaacctaaaagttccaaaatgatcccctttgactccttgttgcacatctaggtcatgctgatgtaaaaggtgggctctcacagccttggataacttgcccctctggctttgcatggtacagtccccctcccagctgctttcatggctggtgttgaatgcctgtgccttttccaggcacatggtgcaagctgttggtggatctatcatcctggggtctggaggatggtggcccccttctcacctttactagggagtgctacagtggggactctgtgtgggggctccaaccctgtatttcccttccacactgccctagcagagattctccatgaggggtccacccctagaatagacttctgcctggatatccagacattttcatacatcctctgaaatctaggtgaaggttcccaaaccttcattcttgacatctgtgcacctacagcctcaacaacctgtgtaagccaccaaggcttggggcttgcaccctctgaagccatgacgtgagctgcacttgggccccttttagccacagctgaaactgaagcagctgggacagagggcactatgtcctgaggctgtacagagcgggagaccacaaaaccatttctccctcctaggcctccaggcctatgatgggaggggctactgtgaaggtctctggcatgccctggaggcattttccccattgtcttggtgattaacattcagctcctcattactgattcaaatttctgcagtggacttgaatttctctccagaaaatgagtttttcttttccattgcattgtcaggctacaaatttttcaaacttttatgctctgcttcctcttgagtgctttgccacttagaaattttttctaccagatacccaaaacaatctctctcaagttcaaagttccatagatctctagggcaggagcaaaatgctgtctctttgctagagtatagcaaggatcacctttgttccagttctcaagaagttccgcatctccacttgtgaccaagtcagcctggacttcattgcccacattactatcagcattttggtcaaagccatgcaacaagtctctaggaagttccaaattttcccacatcctcctgtctctgagccctctaagtctctaggaagtttctaactttcctacattttcctgttgttttctaagccctccacactgttccattctctgcctgttatccagtcccaaagttgcttccacatttttggatatctttatagcagcaccccactgtgccagtacaagtttactgcattaattcattctcatgctgccatgaagaaatacctgagatgggtaatttataatgaaaagaggtttaattgactcacagtgcagcatggttggggaggcctcaggaaacttacaatcatggtggaaggggaagcaaacatgtccttcttcacatggaggcagaaaggagaagtgccaagcaaagggggaagagtcccttataaaaccatcagatctcatgagaacccattcactatcatgagaacagcttaggggtaaccacccccatgattcaattatctcccacctggtccctcccaccacacatagggattatgggaactacaattcatgatgagatatgggtggggacatagccaaaccatatcaacatctatcttgtaaagtaatgtattgtaaggattataataagataatactacatttaaagaacttaacattgtgcttgacatttatagagtaccagtttatatttttagaaatatttttagtgcctaagctactcttaggtagaaaggggtgtgttgggaagcatttgtaatttttctacttcactatagaagtagaatacgacattctagatggtccaacatacattgatgagaaggctactctgtgatgtgactatggccctaactctctaagtctagttcttggtagggtcagcattagggggaggcaagcgatgtgagctacatgcaagtgcagtgttggatcctgacttcactcacaattgagatattttgtttcccacacatttttgcattaatttgatttaaatattacattaaaatattacttatcttggttactaaatattttggcacaagtttaaattgtacatccaaggtaaatgcctccttgcctcatcctagtcccagccctggcctcctgtctctcctcctagtacatttagaatggtgtaagcccctttccaccttgagctgccttgcgtcagcagattatgatagtcctaggggaaactgctaactcatcagactgaccaccggcagtcactagtgaatccccatgtgctatgaagttgagggcaattgtagctcaaattatggtgcatagtgtgagccagtgtaactcacacacattcctgaacaaccctgaattatgtagcaatgggaagggacttcaacccaatcctatagggcatttatgagagataggttggttagtgatcttcagttccccagatcatttaagagttcatccaatatcatgctacaattcactactgcttatcctatggggagctggactctgaattctaatgaaaataatgaactatcaactaaattccattctgaaagattaggtattggaagaatattgacacaatgcttacaaaatgctttcaatcatttagcgttatcataactctgattgccctcatttagtgttatcatccccatttagtaagttaaaaaaattgaggaacaaagagattgattgatttataaagaatctcaagggaaattagaatcaaagctataaaaaagtatttacagctagaggtaattttacagctgggttttggaatcctttccccagcccttgcaatgacattgcctgaggtgctctctgatttgcatcttagaaagaataaaacttatcgcagtgcattcaggtggcactacccagtcctgcctgggtaggcagactactgggtaggtagatatccacctactcttggtgaagccaaagatgttcatactggtcaggttacagggtgacctactgtcctggtttcagcaccaaatgtcctgcatccctggaaagccacccagtcccaggtcagtaaccctcattgctaaccagaactgtcctccacattgaaaatacacattgtatttcttttcttgttgcttttcctggttaatatcttttttgggtgattcacacaaattacacttttttagttttattatagcatttgatattaagatccatcattacccttagttaatcctttggacttaagagacacaaccttagatataccaaagacaatcatgggaagagtgtgtaaagagcaaactgtaccccacttgtctgaaaaaaaaaccacaaaatataatagagcaaaaatttaaagatactctaaacatatattatggaattataactatagaataacctgcttaaaatacagattagatcatgttaatattctaggaaaatctctgagctatttccccactgcttctcgcccattgaaacatacactcatttattcatccagttcataaacattaattgatcacctcatatatgctatgcagtatacagttgctgagactataaagacaagacagttcaggcttatagctcagcaagggagactaatgtaaacaaattagtgcaataaaaattaagaggtgctacaccaaagactgtacagctgaagcaaaaaaaaacaaatggcagaggaaaagttcagctgtatttccagaaatatctgtcccaaattagtcaatgtgttccagatttcaaagatcttttctagtgttttgcctagaatgtactttctccatttgtgccgtctcaaaatttcacacatccttcatagccaagcttaaagagtttaggaagtgtatcttaacccccaatcaagatttactattcaatttgtctaaaattccacaattagagtttattttattatggcatatttattaatgtatttatggtccgttacccatttcaaaaaacaaagattgtttccacatgccatgcctcaagataaattccaaatgcattacagcactaaatatttttaaatctgtggaaaataataatattaggcaatatttctctgatcttagagcagagaataattttataggcattacaagaatgaaaaaaatacagaaaaataaaatatcaattacaactatggttgtatttaacaaaaatccaaatcaaattagtttaaactaaatagagaatgtattatatggatattaagaagcaaggacaaggatgtggctggaccctagaaataacaagaaggagagacctgaatcccattaagaattttttttttagatctctgctgctctctgcatctccttcactcttatcactggatatagctccctctatttctctaatcaatatgatgaaaggcagtgtgccgacagctgctgagctttaagtctgatggcttgggtacctgaagagagacagacgaatttactgctggtcctcatacaaaagtccagcaagagaaacattagcacatgttgaaacactcagctgtcaacatagcatcacaaggcaactcttatctcaatgtgaacaatggtatagaagcatgagtgggaagaaaaaaaaaaagtttccaaaaagtggtggagtaaatctcttcactatgagaagatagattgaattacataaaactataaaagtgtcatgatcagaaaaagaggtcaaaagaagttacaagacattacaaactagaaaaagtatctgcaactgtaattggaagatagtttctttccttaatgtataagtgcaaaagaagataaatataaatattcaaaatgggcaaggcaaagacttcagaactaacaaagaagcaatccaacgaaatacaataaaatcattgtggaaaaacgttcagctacattaataatcaatgtaatatgaatttaaatagccatcaattgcaaagtttattcctcagaagttgattttttttatttacaatacttggaaatttagagaaatgagtactttcatacactcgtggtaggcatgtaagttgatgcaatatttctagaagacaattaggtgatacgcatcaagatccttaaaaaggaacatattcttcataatatgttataattttatataaaagaactaaggaaataaagagatgtaccaataccattttattcacaagaatttattcattgaaacgttatttttatagcaaaaaattggaaatgaatataatgtctggcaatagagttacctaaataaacttttgtgtttttaggtggaatattgtacatcactaaaattatatttgagtaaatattaaataacatggaaaatgccattaagaaaaaaacacaaaatacaacattttatatgcagtatgattccaggacctatatatatgtgtgtgtgtgtgtgtgtgtgtgtgtgtgtgtgtgtgtgtatgtatgtatacatatacttatatacgtatacacacacacatatttataaatacacatagcaaaaaaggattggaagaaaatacacccaaatcttgatatcagtaactctctaggtactagaattgtagatgatttttttctccttttttctttattttcaaaaaagaaaaatttcacaagttttctttttattttcagtaacatacttgagctactttgtttttcattagaaaaaaattacaaaatctttaaacttttgaagtttaaaaatacgtctaacttttgagtcaatgaggaaataatgtgtgcatttaaaaatatctgtaaaataaaaatgtaaatacccacaataaaatgtgtgaaataagccagagttacatagagcagtaaacctacaaacccaatgctttaacaaatttttttaaagtgtaaatacattggtacatttcaacagctaaaatgacagaaagtatagattgcatggaagcagagacccataaaagtcacattgatactattttctgctaatctctcaaaaagacaaacagattccttggtgtctattgtaagggaaggggttactgattcctcatactagatatttatcttgttattgtctggaaaaatacagtcatgtctatattctggaaaaatgcattcttaggcaattttgtcatgcaaacatcatagcttattacacatgtaggctatatggtatagcctactgctcctaggctgcaaacctgtgcagtatgctactgtgctgaatacttttagcaactgtaacacaatggtatttatatatccaaatatagaaaaggtacaataaaaatatggcattataatcctataggataaccttcatatatacagtctatcattgaccaaaataatcgttatatgatgtgtgactgtaatatgaaaatgaatatgcttgatgttctacctcatgttttaagaagttttgagttaaaaaaacactgaaataactatataatagcttaagcatttaattcaagtagttagaaatatatcaagaaatattaaatatgagtaaataaggagaaactcaaaacaagaatcaaaaccaaataagtgaattaaaaatcaaaataggaaggcgacaatccaagaatgggttactctttaaattttaaagcagataaaactgctggaaggaaagaagaaagggaaggagggtggttggtgggaggagggagagagggagggagggagagaaaaggaaggaaggaaggaaggaaggaaggaaggaaggaaggaaggaaggaaggagggagggagggagggagggacggacggagggagggaaaggcaaaagttgaaataagaaaaatataacaataatggtagcataacaatttaaattccaatgataattgttatataatatgatttaaataagtatatgaaaaataattaaaaatagtcattgaaatagataatagtctaaaataaataataattaaaattgtgtcattgaaataggtaacagtctaaaacaaattcttgacatctactcaaaaatatcaataactaaggaaaaatgtttttcattttatcgaagaactcttgacagaagcattcagagctacacagtcacactgattagtttttttaagctgaatggaatttctacacttttccaggacaggatagaaaactatcctttacattttattaagcttagataacctaatgacaaaattgacaaggccaatacacaaaataagaaaacttatatacaaatctaatttattaataagtgcaaaatgctacataaaatatcaacaaatcacattcagcaacatattgaaagaaaaactctcactgatcaaatacaacttatcccagaattgccaggatgagttaatataaagaatagtattcatatgaaataacttattagaagggcaaattgaactctgaaaaatatttaataaaattcaatgcatattgagatatgagtataaataatatttattttaatttgcatttattgtattatattaaattaataatatagcatttatttcaatctgccttccaaaccataaataatggtttaatagtacaggcttttctatttaaattaagaacaaaataagatgacccattctcattttcttactctgaaaattctaaccaatgcaataagcaaaacagaaataatgaatatttgaagagtattacattatgagaaaactcaaaataataaagaggaaattaaagtatttcataatgtgagaaggtgagccaatgtaaatagacacacacataaaatcaagttaataacaaaaaaaattataaaagatcaaactcaactgtgaaaaaaacctgcaaaatacctaggaaaaaatattgtatgatttgtttttgaaaactataaaataaagctaataaatataaatatcctgatataaatataaatgtgcccatgttcttagatatgaagatggaatttaaaaaaatatttccccatatatttataagtttaatgatattctcaacaaaattccaatgaataagcaaatcttttcaagattacctgaggtcaggagttcgagaccagcctggccaacatggtgaaaccccatctctactaaaaacacaaaaattagccgggcatggtggcgggcacctgtaatcccagctacttgggatgctgagacaggagaattgcttgagcccgggagacggaggtttcagtgagttgagattgcaccacggcactccaatctgggcaacagagctagactctgtctcaaaaaaaaaaaaaaaaaaaagaagaagagtaaatggatcctatagaaagtgtcatttatttaccagcaagttttagaaccagtattaacacaatgtgatgctactatacagatggatcaatggaacagaagagtccagaaattaaattatatgacaattattatgtcacaaaggtggtataacagatcagtaagaaattatagacatatatgtgtgtaggtgtatgcatatatataaaattataaacagcatgtggtatacagttatatattgcatatataattgtactagcttttcttctaataccacacgtcaagatatttcaaatggattaaatgaactaaattatgaaaacacaaaaatcttgttaaaaacccaatagcaattatatttatcaattatgtgggcagaggagaaattttgaattccaacagtcccacataggctagattctgttactgtaacaaataattcttccaaaaaaaataaaaattaaaaaattttaaaaagaggattaaaattgaggcttaaaagatggatttttgctgaaatggctgtagtgagtctgttgcaggctctgctccaacgtcccaggctgaaagagcagtcactgggcagagggaaacagaagagaggtgtgggaattctctcactagcaatgaagtcctctgtccaggaagtgacaccagagacttctgctcacaagtcatggaacagagccagtcacacagccccaaccaaccccatgttaggtacaatccacgcatgtattccgaagggaaagaaccggaaatagtaacaactactatgaatgcttcatgtttcaggaaaaaattaatgtatttgtaattataaatgtaaacatttctctgcccaaaaatctaatcaacattaaagctaaataataaactgagaaaacatttgcaataaaaaatactgaccattttatatcattatgagtaagaaagtaatgatatctcaggatataaaaaaggcaaaagacaggaggaacaagtgatttaaaattacagaggtataaataggtagcaaataagttttaaaattaaactactcagtaatcaaacggatgcaacttgaagcaataataaatattttctataatacattgacctaaaatcatacagattctgagggaggttgcaattcagttgggcatttctacatggtggatggatgcacatataaattgctcagccttcacttctgcaggtccctgtagcattacataataaaagcctaaactgtttataccttatgtttcgtaattacaagacattttactctctccaagtaaaaacacgaaaagtgcttaatgtcaatcataatagaatgtataacagtgaagaactgacaacaacttacccaaaaaagtggggtggattaagaaaactgtgacatatccagacaatgaaatattaaatagccattgaaaaggtggattatgttcaggaagaggtacctatgtgaaaatgacaggagaaaataggatagagtcaggccaggcgcggtggtttacgcctgtaatcccagcactttgggaggccgaggcagctcaggagctaagagaccagcctggccaacatggtgaaaccctgtctctactaaaaatacaaaattagctgggtgtggtggcgaacgcctgtaggcccaactactcgggaggctgaggcaggagaatcactggaacccaggaggcagaggttgcagtgagctgaggtagtgccattgcactccagcctttgcaatatgagtgaaacactgtctcaaaagaaagaaagaaggaaacaaacaaagagaaagagagagggagggagggagggagggagggagggagggagggagggaggaagggaaagaaagaaagaaagccggatagagtcatcttaactatttcagagaaaattcaggtatgtgtaggaaaagaatagaaggaaattcaccaaactgttaatagtgattgtttcacagtgttatggttgtgtcttgttttttcccctttctttcaatgtattacccaatttatagttgtatgtgtgcttttaaaataaaattatttagaataaaaaatgtctccacacacatcagacacaccagaaagtaaaatgcctggaatagcccgggcgcggtggctcacgcctgtaatcccagcacttcgggaggccgaggagggcggatcacgaggtcaggagatcaggaccatcctgcctaacatggtgaaaccctgtctctactaaaaatacaaaacattagcagggcgcggtggcgggcacctgtagtccaagctactttggaggccgaggcaggagaatggcgtgaacccgggaggcggagcttgcagtgagctgagatctcaccactgcactccagcctgggcaacagagcgagactccgcctcaaaaaaaaaaatgccttgaatatccattgtgggagttcacagagtgcagcacatttaaaaatacgtgcattgagcagtcaagtggactttcagatgttactactttaaaaataaatggtgtgtatttccaaaagttcttatttgaggcattcctaacacagatccctctgtgatatgatgtttaactgtcctttattttcaatcaaccagaagctttcttggatatctgtattagtcaagcttatctctcttcatctgggacctaactacttcacaaagaaattttctctgagaaataactttcatcgaactcattcattattcatgtcaatgcagactctcagttcattttaaagtgttggatcttagaatgaaactgagagcaatctaggaaggtattagtaacagaactaccttctgtattctggggtaacttatgaacaatagtaaatacagagtttcaatcagacactttaaaggaaaagtgtcgtggtaaatgtgtaaatgcttgcatctgagatgctgtcagctttttagatgttctacagcactgttgttgcctagtgtgtatcattttgtacaattatttaaatcagtaaatgaaaaagttattaaaaggatggattttttaaattttcaaatgctgaaacagaaatatacagagatgttttaaaaaccaaatggaaaatattaaggaagaaaaagaagaggccacgcatggtggctcatgcctgtaatcccagcgctttgggaggccgaggcggacagatcatctgaggtcaggagtttgagaccagcctggccaacatggcaaaaccccatctccactaaaaatacaaaaactagccgggtgtggtggcacacgcctgtagtaccagctactcaggaggctgaggcaggagaatcgcttgaacccgggagccagaggttgcagcgagccgagactgcatcactgcaatgcagcctgggtgacagagcaaaactccatctcacaaaaaaaaaaaaaaaagaaaagaaaagaaagaaaaaaatatagcaaatgcattttaaatatttacattaaatgtcatggacatgcaccttacctgcaacatatctgtgagatacgattgattaaaagatgctgtttttcatagacatacagaccatcttaatgcttaggtatttttgtaaatgaaaagatgaggtaagatttgatagtataaatctgatatgaattagatacaaagtagtgtcataattagaggttttatttctgatcaagaacctgatgtctaacttttcattaaaattagcacaagaacaatatttaagactgcaaattattttagtcagtcccaaagagagtagatctacagatcaaacttttcaaaaagtgtttcttaagacaacaattccactgcatgtcacggttacaaggaaaactgtcctatcatcaaatgaatttgggggatactgagttaaacactcaaattgttttctttgctgcaggacttctgagagacaaatgtcattgtgtagtgtgaatttttaagaaggatgaaatgaagcagtgcctcccaagcatatttgaccactaaactctctatgtataagatctcatgggcaacatatacgcacacacatcggtatatactgctctgtgggagctgtgagcctccatttattttggcttcaaacatcagttctaatctttaacagcaatatcttcttctcagcaagaaatttcaggttgagaaacaacagaaatacagaagaagaaaactagaaaattgggatgcaacacataatatagcttccctggaaccacaggttgtgaacttgtcttattccattcatttaattaataaggagataaatagaatcatgagctcttcagcatgaatatgagtcatttaaatgagatgttaaaagctaaaactataactgctgtcaagagacattaaagtgatcacagagtttcataagaataaaagtttggcatgaatttttggcaatattcctggttcttgcctgaaatctgctgttgaacaggagatgagccataccttcatgatgttaaggggctggcagcctgatgaaaagtatgctttgaaagtgcttggggacaatgggccgtgattgttgggagagagtgagaaatcactgctaaaaaggcagtaatggaaaaagtcaggcagtctcactacagacctcaataaccaccctccatctttcctacgtatctcaaaggcctctctcttggcagaacaaactactttgtgaggcatagtgttaaggcacaagaaggagagtaagttcaactgaaggaccatttactggggacaacatactatgaccaaatcattgcatttagctctgaaggagaaggcacatttcaataaacatctgtcctgatcttcaaggaacaggcagagcaggatgtaggcttattttacaccaaaataaattccttgaaatatgtagtagattttatggttaccaaaagaaagggagagttcacctctggctggaggaatcaggaaagattccacataggaggagacaaaaagcaggctttttgctttattgatagaataattgactactatacctactttctttttctgtactctacaccagtaatgcagtatatcccaaaagactggaagctctgctgagggcaggaaccaagcatctttcatctttgtattttccactcctcctagcatagtcttagatattaatagatggctaataatgttttatgagttaaactgagtgttgaataacactggaataagagtaactttggctttgggtaatttatagtgcaactcaaatttatgaaggaaaattactaatagtatttactaaactgcccataatccacggcctttctcttactagctaccctctgaagtacatccataattccttgctccatattttcttatccctcaaaggccattcctagtgaattaatgcaaatctctttaaggcatcaaagagtgagtctggatgtggttattgtctcaacggtgacatcaaaccccattctccccctctaaaggatactaatacctgaagacacttatagcagactgaattagagccagtttccagttgaagctgtccttgtccttaaccacagctctgttcttggctgggactttctgaaaggtaaaaatccaatctcttctgtccattcactttccatcaggtcaagaaacacctgcttcccatccaaatccatctagcatgggatctttaccaagaatgttttgagctccaaagataaaacaaaaatacgaaagctgagtgaggaagacagcatttatctaagggaatcttagaatttaaatctgtagccttggaattaaaggtgcagtaaatataggcctatagtaaattgcttatgatgtaatcaactagaattatggatgtggcaatagagaggctatagaatattgtatatttaaggagcagctatcagcaaaggaatagatcaaattgccatcttgttttctgttgatagcttctggaatggttattattccacaggaatgcaaaacaggagtcaacactacaaacgctttccatgtcttgattgtcagctaatggttttacctttcttcctggatgacctcacagattgtcacaacaggcacacagaagttagttaagggagcaagcgagctttgttagaatacatatagtatcttggccctgtcacattcagaataggaaaatatcataaacataaaaactcaatgtgttgtacagtacaactatgtgccatatttgcaaaatcatgctagagagttaaaaattgctatttgaagaactgaataaaataacatttcacaaacaggaaagaaatacagtaattaaaagtgaccaatatgaaaactttctgaagacaattgagatgctgcattagtttcctgtgtctatcatcacaaattaccaccaacagtggcttaaaacgacagaagtttactctctcacagatccccagaggccagaagtctgaaatctgggtattggcagggtcttattttctctgaaggctctgggagaaattcatttatttgcttcctccagcttctggtggcttcagtcattccttggcttctggctgcatcactccagtctctgtctgtttttgtttgttttcttgtttgttttttgagatggagtctcattctgtcacccaggctggagtgcagtggtgcgatctcggctcactgcaacctccgcctctcaagttcaagcgattctcctgcctcagcttcctgagtggctgggattacaggtgcgtgccaccatgcttggctaatttttgtattttaatagagatgggattttgccatgttgaccagtctggtctcaaactcctgacctcaagtgacccatctgcctctttaaatctacacttactcctgggtgatgccattcagtctcatggctttaaatgccacctttatggtggtgactcccaaatttctatctctaggcccaacctctctgccataagatccagattgatatatctaacttcacagctggcctctccacttggacttttttttaaaaaaaacttccattttaagttcaggggtacatgcacagttttgtacataggtaaatatgtgtcatggtgggttgctgtgcagataatttcatcacccaagtattaagcctagtacccattagttatttttcttgatcctctccctcctcccaccctttgtcctccaataggccccaatgtgtgttgttcccctctatgtgtccatgtgttcccatcatttggctcccacttatacatgagaacacgtggtctttggttttctgttcctgcatcagtttgctaaggatgatggcttcacttggacttctaataggcaccacaaaagaatcatgtcccaagtcaagtacctcctgcatcgttcctcgtcttggtcaatggcaatttcaagccaaaaacctgatgttatcctcaactcccttcctcttacttatgcatcatcagcaaatcctgccgaagtccttcagattttatctagaattcaaccactttttgtcacatcccaattccactaatttgtacaaagccatcatcatctctcacctggattactgaaatagactcttacggcaagagtgttattgcaacatctccaagggcagatctccctgtgctttgttcttgcccttctcctcccttcagtctattcttaatacaaaagtcagcttgattctcttgaaatatgtcatatcatttcactcctctgctcaaagatggccagtggtttcccatctcacccagaacaaaaccacagccctgtgatggcccttaaggccctctgtgatctgctccaatccacccatcacttctctgagctcgtcttctaccagtccaagcccagctcacccgacttcagcctcactcttcctcaaaaatagcatcaggctgctcccaccttagacattatatttcccctggctgtaacgctcttctcccagtatcttcagagtggttttctcattatctttaggcttttgctcaaaagtgccctcccagtaagcacttttctcacctctcactctgacatgtcaatgcctgtcttcctgttcatgaccaattccccttctaaaataaaagctccaaaagtcagatgcgtatctgttgctcactggcacatcccagtgcctcacacagtatctgtctaggcatcttacaaataaatgaggaaataaatgaacaaatcattggatgagcgagttattcagtagaatcatggacataatatatataaccatgaattgaagtagaacaacaacaacaactaaatataggtggattttaattctattgcatttctgaaatggttatcgttggaatatatttaccattacaaggtaagttgagtcagaacaatatattcctttgagaggaataagatagaaaaccattattttcctgtgttttttttgtttgttttttccatcattaaatgagatggattctctgccacaatgaaacattgtctgaaattccttttgggaagaagagggtaaatttaatactttcactaatctctcagcacaggcttaatctagagacagatggaatcagtaggcagcagtggaattgcctccctttaaggttcttacccacaacaatggcttgatttccaccatgttacactgagttgattcggatagctccctgttccatggaaacagtgattgaaaagcaggttaggaagtatccttggaacctaaaaaaaaagtcaatcagtgagacctagagccaggcatggtttttttcatattaagattgctgaattccacccctttgacattctgattctctccatataatgtgggattaagggaaagtttggaagccattgccgtgggtttaccttgggtgtcttcacgaatagcacattattgaccttagccttctctaagtgttaccctttgcctacaatgattatgttgttgacccagcagttgtagagttgtgattcagaacaattctcctgtaagtctagatggaattatgtggcacaacccaacatccttcatggcaacccttcattgcacccatcatccccccttaaaggccacctgccaggtgtacaggatgttgccagctgtggcttccatctgtgtttaggtagtcacaaaacacaactgcctacgtcctcgctgcacttcactggttcaagagtctacccaaaacagacagaaatgctcctgtggtgacggaactctgctgtctaaaccaagatttcaagtgaattcctcttggcttatcttaaattactgcgctgtaaagtcagaatcttgttagaagagaatattacttgaatatatgtgagttcctttaaaattattttcaatttcaaagcccttgggagaaaaaaaagaagatgttggctgggcacggtggctcacgcctgtaatcccaacactttgggaggccaaggtgggcagattacctgaggtcaggagttcaagaccagcctgaccaacatgccgaaaccctctctgtactaaaaatacaaaaattagctgggtgtggtggtgcttgcctgtaatcccagctactagggaggctgaggcaggagaatttcttgaacccgggagctggaggttgcagtgagccgagattgcgccaatgcactccagcctgggtgacagtgcgagactccatctcaaaaaaaaaaaaaagatgctgataaatgtactagtctatgctaggtttgctgtaaaaacaaacacaaaaaaacaaacaaacaaaaaagaccatagactgggtggcttaaacaacagacacttaatttctctcagttctggaggctggaagtccaagatggaggtgtcggcaggtttggtttctccagaggcctctctccatggcttgcagatggcctccttcttgcttggccctcacatggcctttcctctgtgtgcacaagtccctggtatatctgtgtgtccagattttcccttcttataaggcccagtcagagtggtttaaggcctaccctagccgcctcattgcaacctagtcactgttttaaagacactatttctaaatacagtcacattttgaggatccagaggtgaggcctgcaacatataaatttgagggaggatgcaattcagtccataacagtgacttaccaagaaagcaagtcgcttctgagtttcaaagctactccagaatgtaggcacaggcattattgtctcataccctttgtttagtgaccatatgtggcaccttgtctcaggtgagggaacacagagtatgaaggacagaccagtttagcatcagcattatttgtaccaacatctatgcttcccagaaaagtacagtgggagcaatcaggacaaagtcctcataggtaaatcctaaatacgaacgtgtattaataaaaaaagcattaatttttcagaattcttatctattctggtgtttacaagcagtatgattttacccttatcattttaaatggcacaaatattcacataagacagactcattactcaaagaaaaagcccaacttctttcactttccaaccctttgcttcgacaatggtgggtgaggtggagaagaggctggggaggtggatattaagcatgcaccttgaccgttgatcaagcttcctaatgatgatcagacaaaggattactgcccaaccatttccagtctataaagactggcaggtgatctgtactgactcaaactgatctacgacatagacatgataaaaaaatagtttaacaatacttctcatgcttcaggtacacacgagcaatgaaagagaacatggacaacccaggcctgccgattttgaggtttctcaccctcctgtgttccatctgtcatgcactacttctctcaagaattatagcagaatgaaaaagcttgttcttcatcctgagctctcagtcctgccttctcccttcacccactgccctggcttgggaaatttcaaaaatacaaggggaggggacaactttgcctctcttccttgagcctaagctagatttttatttcaatttcctaacccttccatggtccacatcattgttaggagtagaagtcagctaagctcaaatgagagacagagagaggaagaggaacagagggatgaaaaaggtagggatttctcatctcaaaccaatgggcctccaaatgaatgaggccagaggttcacaacatgaagacccctaaagccttcagacgtctcattgacagctcacactcacaattattatacaaaagaagtaaaaagggaggaagggaggaatggaggaagggagggagacagagagagagaaagaaagggagaaggaaagaaagaaggaaagaaagaaagagaaagaaagaaagagacagagagaaagaaagaaaggaagaaagaaaaaagaaagaaagaaagaaagagagagagagagaaagaaagaaagaaaagagaaaggaaaggaaaagaaaggaaaaaaagagagggaaagagagaacaagaaggagagaaggaaagaccgaaggaggaaattatgcaagggccccaacgtgtgtgcccctttattctgcttattaaagactctacatctcgttttgttgtatctgaagctatggggaggagaaggagggaggaagtggctgatcgttaaacagtctgcccacatgtgaggtaatggtctggctcctattaataactttctcctgtttctgtcagatctcacttttttggtacatctccagctttctatttacctcataccacagtagatttttcgcatttatccgcaaccctctcttgaagaaagagagtgtgatggggtcttgagctaatgacaccattcataatgcctgtttgatgaaaaaatgaaaaaaaaattgctctgaaagtgacaaaacagttcacctacacactacccaagcacataatgaaaacacttgtaattcccttaaacccaggttcatttggctttatgtgatagacaactacatagcaaaagaataattttgaggcaagtagtcagttcaccagttggtgccaactcctctttttatttccattatccaggtacgataataaaaaaaacttatttctagggaatttttgagttttcagggcactttgattacattttctcatttgctttatagagcaattctccaagggaagcaagacaacactattagctcacatgtatgagacaaagaacaacagaaataacttgatgaaatgaaaacatttacattttttggacattcagacaactgagtcagtcccagacaagactgtgattttgaataagcaggatgtaatgtgtaatcttcttgttcactttttcatttataaaaatggaaaaaaaccctcctgccttgaatgttataaagtgtaattaaacatatgtaaaagagctatttcataataattttctttctgatacttaaaaatccttctcaaagaggaagtaggtagatcaggtttcaaaattcagaatttctgtttcctattcaggtatttgtttcctccaagcagcctaccctgcacagattaatggtgctcacatccatgccagtgattgacttttcccctaaatacctgcagcctgaacgtcctaaagatgccttggtctccccaaggatgctgattctgagtaagacacagtctctctacatgcgggctctccctgtggggctgaggagacagacaagtaaacaagtcattgttcataatcactgtggaagccctatcgccaggcagccctctgtatgggtcacctagatggtggcagtaagacggacttatgtccaccttctggtgaccaagtgtcttttgcatcatcttgtcacctcactgttgagcatccaccaacagttctgagagaaactgaaaatcaactccagagtctctccctaccattgtctgacaaaagtaaaacacaaaattcacttgaacagcaacatttttccttacgttcatttcaaataaaggtcttaaatggctccttaggtaaaggttaacattaccaaataactctgtcatgtaattttccttcttttaatttcagtttttgtgggtacatagtaggtgtattgtcatacaattttcaactatgatttctcagaaaccagggaaattatctatacctgaatgtcccatattatcagtctacaaaagcccgaaatatttccaaaaggagccaaaataattcactataaaccatcttagctttcacaacccaacactgtagttagttatttaataaagtcatttcagcaggaacattacagatgtgtatttgtttattgcatttttttcaaagtaggatcagggtaatttctttgaattacagtctgtccattggagttccctttctaacaaaaaatgcacataaatgacgcgcatgatgcgtatttgtgattttcgtttcagactttttctatattcttttttttccccctttgaatggagagagaactgagagcacttgtaaatcaacctagcatagacaagttaggtaaaacctacaactgacttttggtaagggatcactcaatcctgagagtagataaaaaatagcagcctgggccaggcacggtggctcatgcctgtaatcccatcactttgggaggctgaggcaggcagatcacgaagtcaggagtttgagaccagcctggccaatatggtgaatctccatatctactaaaaatacaaaaattagccagtcatggtggtgcatgcctgtaatcccagctactcaggtagctgaggcaggagaattgcttgaacctgggaggcggaggttgcaatgagccaagattgcaccactgccctccagcctgggcaacagagcaagactccatctcaaaatatatatatataatagatagatagatagatagatagatagatagatagatagatattgatatagatatagatatgtcagcctgcaagttacaagtgtttagcattccatgagcatcagttaacatgtactttcaaaagaaatgaggagtattggtcaatcaaggagtaacttaaatggagatgggttaagaaagcttccactgtaggccctgtgtctattaataatcctaggacgtctctcagaaaacatctaagaactgtacagttaacaacacttacattgtttctgtcaaacatcaatgtctcaagcaaaatcagagctcattctctgatgaggctttaagcactaacattttgtactgttacttgcagtgagatcctcatgtttaagacaccagagcctacctagaacatgtgcacttgctcagtgaagggacatatttcttcagttaccagatgcaggtttgctttggactaaacagtttctaaaaacaaaaaggaaaagaaagaaagaaaaaaagaaaagaaagaaaaaaaaccagttctttgaatattctcatgcactttggaaagtactagaatatgatctcagaattctgagccatgaagcacaaaaaaggacatttttatcttgaaaaatctaacagtatgtatgtgtcattttgatcccatcaactctgcatgatccccttagagtctggaatgtaggcttctgaatagaaagatcttcattctaaagaagaatggtcctacaaggatacagctcaaattatgtttagatcgagcatggtgcaattcttgtccacatcacagaaaatcgtcctctgccatattatcagttacacttttataccactaaatgtttggaacacatttgccatctgagagatggtatacagtccaacactggatttaaaatcttaagcatacatatgcagttagtcctatttatctgcatgtggcacatgctgataaacttcacttttagcccgggatttaggatctgctctattactctatttatcatttggggtctcttatttgtatatgtacattcttctttttactggccgggtgtggtggctcatgcttgtaatcccagaactttgggaggtcgaggcgggtggatcacctgaggtcaggagttcgagaccagcctggccaacatggggaaaccccatctctactaataatataataattagccgggcatggtagtgcacacatgcagtcctagctactcgggaggctgaggcaggagaatcgcttgaacccagaggcggaggttgcagtgagctgagatcgtgccattgcactccagtctgggtgacagagcgagactccgtctcaaaaaaaaaaaaaaaaaaaaaaaaaattacatgtgaaccatgtgactaacgcttctcatgcatctcttttgcttctgcaggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagaggtaactattttcccacttttaaaagcttctttgggtgatatgtctgctctccaagtcaccttctttttgctacctgccctcttttaaagcgggcatctttgtgcaaatgggtcgcgggaaatctgggtcttcgatgtcactgatcagtgtaatctgaactaacctaatggacgttgctgagcactgttttctgggcctttctgatgagcttacccttcagtgccctccactctatgattaactagctcagctgtgaatggaaaatgtcaagcttgatctgtttttccttcctgaagctgagataccaccatgaaatcgtgcggtgcagtcaaataaaacattatggaaggtcaatccactgagcatgtggaaatgcccaggacacacataactcacaccctgaattttaacaggttgtaaactactgagtttacctagcatcctctcaacttttttttactcttttccacaaaatcatagaaatatgaagattaaacctgtgagagcaatgtctacatccgatcctctttttcttctgaactgaagccaagtgcctagcctaaaaagtaatctaattcatatgttggctgcaaggtttctctcatggaaagattcattcggaattgtggggcttgcttagacatcttctagacaatattaggacaagtctttgaagtaagatcacatagttgagggttggcttctaacagggacactatctagtcactaaataaatgtgtttatgtggaaacaaaggctactcatcaccccagattgggggggttctttgcctcagagaggaatccttgcctactaaatacacacaaataaggaaacacaatgaacaccatgtttatgctgatttccaggttactaaatgctggttgtttccatgtagaattaatctagttagatcataggttgtgtccacctgatacagcctcctgcaagaattctagtgttctttgcaaacaaaatataaaacttattttcttaggagcacagataaaaaattaacaacatagcagggcgcagtggctcatgccggtaatcccagcactttgggtggccgaggcaggtggatcacgaggtcaggagatcgagaccattctgtctaacatggtgaaaccctgtctctactaaaaatacaaaaaaaagtagccgggcatggtggcaggtgcctgtggtcccagctaccacaggctgaggcaggagaatagtgtgaacccgggaagtagagcctgaagtaagccaagattgcaccactgcactccagcctgggtgacagagcgagactccgtctcaaaaacaaaacaaaaaacattaacaacataatatttttatatctatggcctgacttaagtataaagatattttctttttaaaaatgggtagactttgagatatcatatgggtcaaaattgtctatggacaaataataaaactatatacttatacagcattttaaagtttccaagctatcctcacataaattatctctataatgtagagatagatctatcacttttctttctctcatcgctctctcttacacacatacacctatgcaaacagacactaacactcctacacattgtggagcaaatactgtagaaagccaaccacatttagcaatggaactctagccacataaaaatcgaaagctttcctgtggtctgaagtacctggcttacttgtcagttaaacacccccagagcttcttaaaactggtaatttgctggcaaacagaattcaaaaggattgattttctgtcaaataatattagtaccgcagagctaactattaacaggaatctcaatccattgcttatgctggatagaacaacactatccagctccacatgctggagttcacacactcccatactctccttttatctggctaaataatgaaaacctaaccagaaaataagcttctgaagacaatgacagtttacacttccagcacataatggacaaaactgtacatcttcgtagttaatgcagtagttcactaccaaagagcagagtagcagaaagtttttcttgtaaacatttgctgttccttagatacctgcaatatggctgtcaaagttgtatcagttattctgtctgaattaagtcaggtaactacagagccatatcatttttcaaactatttttatttgtagaatgatattaatattcaatacaattttatgtattaatttagctaatttgatatttaattatctgatgaccgttctaaatttgcagaattaaaatataaatttgaaagtgtgtttaagctcttatttaattcctaccaacataagattaataggcactattttacatggttgtagagggcaaactgccccaacctttccggaagggaatttggttaatatgtttcaagtgacttcaaactatctataccccttaattataactggtaacttaacttctggaaatctactcttagaaagtagcacaagattcagagaaaaatataagagctaaggtaagtgctataatattatttataatagccaaaaattaggagcagcttaaatgttttgggggatgtttgtttgtttgctttttgaaacagagtctcgctctgtcaccccagctggagttctgtggtgctatctcagttcactgcaatctctgcctcccgggttcaagcaattctcgtgcctcagccacccaagtagttgggacgacaggtgcacaccaacacacctggctaatttttgtatttttattagagatggggtttcaccatgatggccaggcaggtctcgaactcctgacctcaagtgatctgcctgtctcagcctcccaaagtgctgggattacaggcatgagccaaatgtttaatattataggaatgcttaaataagggatgacacacctatgaaatggtctattctacagacactaaaaatatgctttaggagaatttgtaaggacttgaaaaaaagacatgctatagtgttaaagaaagtaatatgtcaaactgtatttatataatgattctaattttcccaaatattaatagatattattccaaaatgataggatgaatcccagagcctttttatccctaattttaaatattctaaattctctcagtgagtgcttatattcttataatgagaaaaatacatttatgttacaactaaatttttcagtagatattgacttgatgtatttaggctacctgtcagctgaccctggggtagaaagaggcctgatgttgagctaaagctcctgtccagtggccatgactctcttcattgtctatgaaatgagtgggttggacaaaatgtcttctgagatccctttaagctatgctatttcattatttgaaaattaattagacagcagcactgcttatgaacattctttagcagtatttcatttacctggaacttctttctgagttttggaaagataggagctaaagcactttgtagttaccgagaggttctacattaattttataaccacattaatattttcaatgccaccctgctgcatgacagaacttaattcatacaacactcatttggcaaagggcttgttggtaactaggagtgctttcaggtaacaccataccaagcaagggatttagactccatctgattaaaggtaataaagtgagaccagcagggagttggccttgttggtatattgctaatcagttctaagtttacatctatcagtacattagcagctcaagaaagttggaagttggaccaaccgtatttcctcaatatgcagacagggattgtaaaagatttttcaatagttgcattaaaaagaggaatcatgaaagaaaaaattaaattcatagaactctctttttctctccccctttccctgccctccctccccatcctctccttgtccttgggcatcagcatgtgaccagctggctcttggtgtggctgctctctttggcccttcccatagctcctccgtcagtgctgtgcagtctatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacagtggtgtatgaagacagcacaggtatgggactcacacaagacctcacccgaccatgtctgctctgaacaaacagaacgaaagtatcaaatagtcattaaactcatcagatggagcataaaaatgctcttttatataaagctaactgaatattctgaagtaatttaataatgcatgtgtatataattcacatttctttttgtttgttgatcctttctaacgatccttttatcatcaaatatatgggaacttttttttaaaagaaatatcatcttatcagtatatgttataatccaatcacaatattaaacatgtattttcatttttccagctctaataagactatgaccacaattgaaaatgaccatggaatatgattccaacttgataagtagctatgtaaatgtttagaaaagtttctaacgtaagttaacaaagaggaattcatttagaggttgtaccaatagagtggattatgtcatgggaaagggactatgaatccccattgatgagtgcttaataaagcttgctccatgtgcttgttcagggtgcaggatggaaatatgcctgcttggagtccagtcctcatcagccactatctctgacccgcccccatttgaactttcttttactggcaccacccccctctgctttctgcttattgtccagaatttttcaaaaattcaggcccctttttatttaaagtcaggcagtgaccctccattgtccacataataaagttgaatttcttctaattcaaaactcttcatcatccagccattttcattttcattaactcaggcactagcttccctcactgcctgtactctcacatgagttatgatgaagaatctatcatttcttcaatatccccatgttctcctgactcctgttttctgaggctggcacctcactttggatgatcctttgcacgaccttcacggtggtgaactccctcattctccacgaccgcacgcaaatttccctcttccttaaagctctctgagaccaccagagggttcactagcactttggaagcaaaagcactgaatcccaagttatatttcaaatatctgtttacatgtctgtaagactggaaatttctaagcatcctaattttatcttatttatgtttataatctgctacctgtcgtaaacctgacatagaggaaacagtttagtaattccacatggatagaataataccattgattgtctgaattttttttctccaagagttgaaatgagttgctttccttgatctacacattttgtaataagattatgaaaattacaagtgaaagttagtaaagtgaaacagtgtcaaactttgcaatacggtttcgcttttcactgcccctttcgccaagcactagcagttactattcctcaaaggatgaatatgtgcctcctctttgatgttaaactctggttccattttatatagtcagataaaagtgacgagtgtggttggaaatatgcacttatgtattttcttgtgcctcatctcattttagaaagaattgaagattctaagtgagtgggtatatattttataagtattgtattcgaaacagtcccatcaagaagaataagctacaagcagccatatttttagaactttacctgcttgctgtgaaggaataaatcattatctaatcaaatccacacgcatactttaaagggctttgaaaaagaatatcatgttttaaacataagtgtggttagatcttgcatgttgcctacttttgctaaacatgaaattttgtgagctcataaaatcaagctatagctcattatgttgtgaactctgtagtataatcatctctcaccatttctacagcaaagctggaccatctaaaaggaaaacataccaatgaataatattgaaactcgtggatttaatttaagaaagagttcaactaaagacgtaggcattgtagatttcaaattgtatttagacaaaatataattagtaagtaaatgacagaaaacttgatattctaaccactctctgatgtcaggtgagccacacatatgtgacatccatttttcaaagcaaacaccaaactatcatttccatcatcttctacaagaaactgaaatgtccttttcatctttgtcaagttcacctgtgctcagtgactcaatagatacttgttgaaatttacaatccaaaatgatttcgtatgtcgcccattgagagatgattcaagttaaaatgatttttgcccacaaagacattaaaaatgtaaatgaataatcaattgagccattaaattggaacccagagaataaacaggccaactgagatcaataaaagcacaagccttgtgactgtgagtgggttttatactgcttgactcagggttcttgcctttagtaattatcacaccataaaaaggaggaaacttagtaaacctaaaggaaaagaaaggacttaggtgtgcttagcacccgcccctacaccagaattaagtacccattaaagagcactttattgggatttgtttaggagtttgttaaatagcctgaagccaacacagatgtcgcgggaccaaatggcccattactcccattgaagtcaatgggagcagtgtgcacgtctctaaggacaaaattcaattcgctaaatactagcaagcagaattctgtcctctagaagataaaatgtcgaaagactctggagaactcttaggaggagcaaagtttcgtctcgcctcgtctctcttctctctctttcctggatgtccttcccgttagtcacctacttgtcgctgattcccacatccagaggtgaccccaggcaatgagaaattgctgcccattgacctcccctcatgattcattagaccctggtggaaacctggctatcacttcacatacagcaaaaagagctgagaagctgagcctcaactgcagtgtgtggcatattcagcagtttctgccttctcaaagccaatctcagggaaatgcacccacagcgattcctggagagcagggatcagcaaactttttctgtgaagagccaagtgctgaggctttatggccatgggggtcttggtcaaaaccactccactctgacaaagtagcaagcaagcacacggacaatatgtaaacgaatggacccagtgtgttccaataaacctttatttgcaaaaatacatgctgggctaggtttggccttttggccctatttcacctctgctatagccttaaaagataagacaactgagctaaaaactaagattgtaattttgtacacatatgaagtgggttcagctcacatccaaaactccttcgttttggtttctgggttttcatgcccttctttcctcctcactggccctcctggcttcctcatcaatacgtgtcagtcctttgtctcattatctctgtgggatttgccaggtgatattctggttcattggataaacaaattttcaaagaagtgttgggggaacagatacctttcctcacccatcataacaatcacaactgacattcctataacaaaagacaggttaacaagagaaaatcatagcaaatttgtttaaccaaagttttacatgactcaggaggcttcaaaaatgaagaccaaagacctagggaaaactgtctatttctatgcttagattccatgaagaatgaacaacatgtggaaatgtgattggacaaaagggtagaatcagtggtaataggctgagggggaaagcccagcaaggcctgtgtgttcggattcttcttagcctctctgtgcagtgttccttcctcctgagcatgggtcagggcccctatgaaataagagtcttcaagggaaaagagaatctttctagattttatatcttgcttttggggagaggagttctagcttctatgctccacttagggaagtgaaattctactttctatgactcacgtcagtggattaagaggggtaggataccgggggtcaggagaaagtcagaaagaccttgtttctgagaactttccagtctttttcagttcaaagtagtcagcatgccaaggtgccatattttggggtgtcatgttctgagccccaacagtgttaatggctaataatgacttaaaatgctgtttcttactttaaactaatcatagcacattttaggtttggctctcttaaaagacaacaaaagcattgaatattgcatgccacagagagtgggatttcaaagtgttttcttatgcttggttaggcgattacctacgcagtcagcatagagagcaaataagcaagtgctaattcaaatttcagtggcaaaacattaaaaaaaaacaaaaaaaactcctattctgcttagcttttattttgtgaatgattaagaaaaacctactttatagttttgcctgtctctcttctctactttaacttgtccttaactaaactggcccaaagtttatattcatttggttcaggtgatattttctgaaatattggggaaaatagtcaagacagcacatatttgcatactctgtactatggctgccttttcctgagatctaaatggcttctgcaatacgttgtttgaaagttttatttttatatagttttttaaaaaagattgctttgtttagaaaatgttaaaatgaagaaaagtgtaaggacataaacaaaaatatccagaaaacctatcacagatagtgtcttagtgtatattattttagatattagataggcaggcaggcaggcagacagacaaggagataaacaggtaggtagatagataaatagatacatacataatagatagataatagatcatgataggtagatgatagatattaatagacagatgataggtagatgatagacaataggtagataaatgatgaatgattaatagaggacagatacatgatagaaaatagatcatgataggtagatactaggttggtgcaaaagtaattgcgtttttgcagccgggtgtggtggctcacgcctataatcccagcactttggaaggccaaggcaggtggatcacaaggtcaggagatcgagaccatcctggctaacacggtgaaacctcgtctctactaaaaatacaaaaaaaaattagcctggcgtggtggcgggcgcctgtagtcccaactactcgggaggctgaggcaggagaatggcatgaacccaggaggcggagcttgcagtgcgccaagatcgcaccactgcactccagcctgggcgtctgagcaaagactccatctcaaaaaaaaaaagtaattgcgtttttgctattaaaagtagtggcaaaaactgcaattatttttgcaccaacctaatagctgataggtaaatgatagattagatagatatataaataagtagatgatagattagatagatgataggtagatgatcaattagatagatagttgataaatagtgaatatagttgacagctaaatagatatatgataaacggtagatagatgatagatagatagatagatagatagatagatagatagatagatagagatgatagattcccttgtttcatagacatttactgccagacattatcctaagtaatggggataaaccacacacaaaaatatctgacttcatggaatccacagtctgtttctctaatgaacaaaatatatagtaaatatttagtagatagacagtagaaaatgttatgaaggaaaataaagcatcaaacagtattcgggagaccgacagtagagatgaggtatacagttttatgtaaggataccagggaagtgctctagaaaataacgtttgagtaaaaatttaaagaggataaaaaacaaatcatgtagatacctgggggagagcatttcagacatcaggcagagggaacagccagtgcaaaggccctgacaaaataactatttcctggtagcactgtgctgaaccccatcattaagtatttcatatcatggaggctttgcatatgtaaatagctaaaggacaatatttaataatttcaacttttggtttagattaaagggtacatatgaaggtcgttgcatgggtatattgcatgatgttgaggtttggagtatgaatgatcctgtcacccatgcagtgagtgagcacaggtaccaataggtactttttcagcccttgcctccctcctctagtagtcgccagtgtctgttcttcccatctttatgtccacgtgtacccaatgtttagctttcacttataagtaagatcatgggtatttggttttctgttcctgtgttaattcacttaggataacggcctccagctgcaaccatgttgctgcaaaggacatgagcttattcttttttatagctgcatagtattctgtggtgtgtatgtaccatattttctttatccaatccaccactgatgggcatctaggttgattccatgcctttgctattgtgaatagtgctgtaatgaacatatgagtgtgtgggttttttggaagaatgattttcttttggatatatacccagtaatgggattcctgggccaaatggcagtcctgttttaggttctttgagaaatctccaaactgcttcccacagtggctgaactaatttaaactcccaccaacagtgtataagtgttcccttttcaccacagcctcaccaacatctgtgtcttttgactttttaataatagccattgtgactggtgtgagatggtgtcttgtagttttcatctgcatttctctgatgatctgtcatgatgagcattttttcatatgctcgttggccacttgcgtgtcttcttttgagaagtgtctgttcacgtcttttgcccactttttaatggggttatttggtttttttttgtttgttgatgtaagttctttatagattctgaatatgagacatttgttggatgcatagtttgcacacattttctcccattctgtgggttgtctgtttactctgttgataatttctcttgctgtgcagaagctctttagtttaattgggtcccacttgtcaatgtttgtttttgttgcaatttctcttgagaacttagtcatgacttctttaccaaaaacaatgtacagactggtattccttaggttttcttccaaaatttttgtagtttgaggtcttacacttaaatctttaattcatcttgagttaatgtttgtatatagtgaaagacaggggtcctgttttattcttctacatatggctagcaagttatctcagcattatttattgagtagggagaaggataataccttgaattcttattatagacaccattaagctaaatatttagaccaaaaaaaatgtaagcaaaagaaaacagggtgcttcaaataggaactttcctgttctaaaatttacctatggataggcccgcctcccaaaattcacaacgacgccagcccttacttcattataaatatgtggatattgagaacattcatgtacagaatacatgagtaagtctaaaagaactaaaatgtttaggctgcaaaagaaaaacataaggacatagaagttaatggctactgaacactgagtctaaagggtgatggaatagaagaagctttagctagtcctctgggctttcatggacaaagtgggtgaaggattgagggaagcaactttagcatcactgaaagaatgaacttttaatcaccagatctctcaagagatgaattgcatttctctccaaaatatttaacaccctgacccagaagagttcaagcccaggcttggaaaaccctgtcataggcaggtcctgatataaggattcctgtagtacccaagaggttaccctggcacctaaagttgctcccaactttggataaattgcttttctaaaacacaaattgccactgcactgtcccatcgtgatgccaccctggtagatcatctgtttcttcatcttcactaatgctgtcagagtctgtcattccacaaatatttattggatatgccaataaatattggtaccaggcattgttctaagcatatggaatacattagtgaataaaacagatagaacccactgacttcaaggagcttaggttctatgggaataataaaccattttttcattcaatataaaatgattataattgttgaacggtggtgagtctgtggaagaaagaaaaagtagagcagattgaagggaatctggaagccagaaatgtggtttgcagaattaaaggtcatgtcacattgcacagatgaggcttgagcaaaggctgcaaggagctgaggaagtgaaccacgttctgtgagagagaaggcggttctagtcagacagaacagctaatgtctcaggtgagagtgtgcctggtacctcagagcaacagcaaggaggccagggtggatggatcagagtaagaggggaggggagatagaagagacggtcagagaggagggccttgtaggtcatgcaagactttgtaaaccattggaagagcttgtgctctgcctggaatgggaagccgtggaagagttttgagcagagggtggataagatcagagtaacattctgcagtagtctctactcatcctaaggggatacattccaagacctccagtggatgcctgaaaccacggatagtactgaaccctatatgtactatgtttacttttttcttttactttatttttgagacggagtctttctctgtcatccaggctggagtgcagtggtgcgatctcggctcactgcaacctccaccacctgtgttcaagcaattattctgcttcagcctccccagtagctgggattacaggcactcactaccacgcccggctaatttttgtatttttggtagagactgggtttcactatgtcggtcaggctggtcccgaactcctgacctcgtgatccacctgcctcggcctcccaaagtgctgggattacaggcatgagccaccacgcccagcctgctatgtttatttctatatatacatacctaagcacttcttctatatttgtctgtatagcacttgtatgaataataccatgataaagtttaatttataagttaggcacagtaagagactaacaacaacaatgatgaaatgattcacgtcccatgtggacagagcaggatggtacaagacttcatcatgctattcagaagggcatgcaattgaaaacttatgaattgtttatttctggaattttccatgtaatacttttacaccacgactgaccgtggttcgctaaaaccatggaaagcaaaacctcagataaggagggcctactcttgaagaatagtaggagtaaaagaatcactgtacactctacagaggcaaaggtagaaatatggcaacctgccagatggctcctatagaaacccagggaagagatggaggcaatacagtagaagagtaagatacgctcaggttctggaaacatttttaatgtagagctggcataatatctgagaggatatttgaatgtgttccccatttgaaagtttttattatatatgatcatgtcctctttcctttatctccatttgtgtggtgacattgggctatgtttgaatgattgctcaaacattgtagggtctttgagggaactgtacaaaaatcatcatggatattctcaactgcatgcattttatctattagtttcactactactttaagatgtctttttgagtatccagcacaacctttgggtctgtatgacacttattttgatttaaggaactcaatgacctaagaaacttgggacacctcaggttgcctcaagatattaacctgtttggaagatagcgagcatattccctcctatggcaaactcctctgaaatatcaaagtttggctcagtgtttcaattaaatcaaatgtcaagaaaaacactttgtattccttagacacaagacaaatgccatatgttaagtttatttttaaatggaggataaaaacaggaagaccgtgttccagtctgagaaaatattgatgccatggtgttggtgaggcaggttacggtttaattcatacctgtagatcaaagaatcaaaaattaactcaaaatgctaataatatcctgagggagtagaggttaggaaagaaagaagagagaaataaaagattgatctttttgtcctgagccaaaggatggagttgtcattacctgaaacaggttataggtggaactagtttgaggaaataagaatgatatcagaaattgagtcattaatatgttaagtttgagtttcagatatctattagacatctgaataagggtaagaacaggcagttaatacctgagtctagagtctagaaaatggatctgggctggagacacaaatttgagtggcctcagcctatagataggacgggatgagtacatcaaggaaatgagcaccagacagatgcctctagccctgaatttataacacatcaaccttgagaagtttatctttgtttaccttaagtcatttttctcaacacatcacagccatgagatttctaaaatgcagcctgcagtgaagagttagttgttagtcatcacatcaaatatagtctccgagctttactgtaaggattaatttgaaatgagaatagcatccctaacagtggcagtgattgaaaaaaacaatcaaccctgggagaaaacatacatgaaatgaaaatcgcaataataacaataactaaattcttgagtgctgactatgtgcactgtcctaaatagatgattaactcatttaatgtgctcaaccagcctgtgagtaagtgaaatatctgctcttatagctgtatttaagtaatgacttagtttttaaaaactctatctgtcatagttccttccattttcccatagaaaacagaaataatatactcttctagaactaagaatcttgacagaagcctgaagtttggactcaaagaaaatcaacactttggcatgagtagtcaagctaaaatgcaagatgtgctatacacagtcagtgccaaataagtgactcttttcaccttctgtcatcaccactcaccccactgtgtcattatgaccacttgtgatagctaaaactcttctgctatgtgctctcccaccattccactgaaataacccaacgatggaacattctttacactcaatatcaaaaaaaatgataaattacagtttctttttttctctgtactcacttttttctacccttcatatctcccacctcggttctttgaccagaaccttacttaaatattcagaactatgcccaggaaaccaatatttagatattccaggccaggcatattctttttagctactgttgaaacttaacgagaattcagcaccaacatatactggtggagctgagtgcaatacactttcttgaatacttagactagattcttctataagctcctttgtaaccaaggtacacaatttttcttttgggaagactcccacttgccttctctgttgcacttctgaaaaacgctatgtatgaagatctgcactttaaaagcattgtgtttccccaggtaattcgctcacatacccgttttcattttttagttttgatttttcctccgctctggaggatgcacagatccccttaagaatcgtattagatttgggtacattaatatacccacaagtttatgaaatgccattttgcatatttccaagttcaaatagagaagaaattaacatttaaaatttgcaacctgatctttgggtcccagtggtttataacattcatgcttatggcatcaaactcactgatggtttaacaaacaggaaattggattaagactcaagaaaacctaggtacttttcttttgaaccgagactcattaaagatagctaaagctatccagcaatggattggactgcggtgtaaggtagagaatttctcacactgagaggtgttcagcagtggctgtgtagaggggactcatgcatcaaaaggagtttgacctgaaggtctcttccaattcctgctatttgtgacccattttcagggccgatccaaacaattaacctcaccatgcctccctttcctcactgtaaaatagcactgacacctattcacctcagaggtatattctaaggtttatttcgctatttataaggcatggagcagacttcataaaaaggggcaatctaaatagcaaagtttgttattacttaaaaggaaggcataggaaatcttcaatgctcactggaaatagcagaggttttttttttttcctcctccatatgctccacctgttgcctgagttacccaatgtgcatgcaaatcagcatttttttctgtgtcacatctgagtgcaccgagtagacaggcggccaaagcaagtgtttagaattggccatttggatatttttgaaagttgtatctatatgcagagcttagctcaaattcatgtgaaaaaaaacagccttctttctgtaaagcgtttattcaaccaaagttgcatttccaatttcattcttggggatagaagtggaagaagcttttatgatatgattttatatctgtatgttttgtctttttatttagaaagatttgaacttagagaaaagttgcaggacatgtacaataaactcctgtacacccttcacctagattcatcatttattatcatttggcctcatttgctgtaatgctctatcattctcttaatatagaaacacctacaacaataaaaattatactaagtagtagcactgttgaaccatttgaaagtaagctgcagatatcttgacctttttccccataagtacattagcatgaatttcctaggaaggacctttctcgttataaccacactaagattatcaagtacaggaaacttagcaataacgtaataatgttatctaaacatatagaaatatatatttgctaatattattattggcaaaataataatatatgtttgctagttgtcccaggatcactcatggcattcagttgtcaaatccctttcatctcctttgattcagacaattcagccttcttttgccatatatgacattgacatttttaaagagtccaggtcagttttattgttgaatgtccctctattgggtttgtctggttctctcttgcctacgttttatttttaaattctctccatctcagtgggctagaaaaaaattcacgttatcagcattacatgcaccttcaccattcactgcaactggggttctggcagggttgggtcactccatcagggctggcatccacacgagagaggattagcaaagctaggtgttgtgcctaaatcaatgtcctttttctgaagcaattatatgtttagcaaacgacttttaactactcattacaaagaaatgactgatggattgctgcaaaatgcaaatataagggaaagcttcctctaaattttgtctactgtgctttttgaattgtaaattctccatcatttgctaatgaaggcagaaaggcttttcttaagcaaacaattgcttcaggaagagaaataaaaaactcactccctccctgttctttgttcttcccccagtttccatccctaatctttaaatctgctgatcctccccctttctgaagccagtttacctatatactggcaaaaggagaaaaataggagtttaacagtaagctttttgtaaaagataaatttattccaattagaaactagtcttttggactgaattgttctcctatttcctctattggtattaaaatataccttcttttatgaaacaactgtaaaagttgatggtcatatttgggggtgtgtgtttattaacggcctagtgtgccaaataaggatttaatattgtgtgctggtctagaaatgttctttctctgttacttatatagctatgtattaatatagttaattagtcagttaattagtttttcattcagccagttgacaagaaatcctaaagttgggaggggccactgatttggaggaaagagccctaaatttggtatcagaaggtggatttggccttaatcccgggttctgccacttattagctatataaccttgagcaagttactccagcctccagcagtcttagctcataatctgtaaaattaagtggtaattgatgcctcatctacctcaagagagttgacaggacaaaattatcctacaggctgtgaggactttgaagcaggttgtgttgtcttgcatccccagggcttagcatgaagcttggcatctaatgagcatccagcaaatgttttcccataaaaataaatgaaagaagtgagaaaatatatgtcaactttaaatcctataaatatgtaagtcatcatgatagaaagatgtgacattctattcaacacagaaaaagagagcagttcattgaagcacacaaaatgcactttttaaatgttttcccaatgttatttagagaccacattaaactgtcccttgtggtcatggtcatgaaaaaaaaaaatctatgtgattgcaaagcaggtgggtggtaacagaaaacaggagagaaactcaggcagcctggagtctctattttttccccatctcatcaacaagtcctaagccatatctgttccctcagcaccaacaatttgtatttataaggcaggatggtgacgtcaaaagattaagtgttggattcacaaacagcaattttaatccaggattcttcttaactatctttgtaagttacttaactactctgggccctgaattcctcatttaaataataatagtaataatggttacatcataggattatttcaaagattaacacatattacaaataacaaatatacgaacccacgttctatattttgtttcatttttaatgctcctcagtagttcatgacgtggctgtggaagtgagaagacaagcaggtgattataagtacctgagggacttcagttgactgatttgaaaaggagcaagaatccaggaagcctactattctagcaattcaatctttgtgtaaaaagagaaaagattcatgtgttagtccattttcacacagctataaggaactacctgagactgagtaatttataacgaaaagaggtttaattgactcatatttccacatggctggggaggcctcaggaaatttacaatcatggcagaaggtaaacaggaaggaagaaatgtcatacatgttggcagaagagagagagagagcaaggggggaagtgccacacttttttaaaccatcagatctcatgagaattcactcactaccacaagaacagcctgggggatatccgccctcatgatccaatcacctcccaccaagttcccccccgacacatggggattacaattcgggataagatttgagtggggacacagagccaagccatatcagataatgagcactaaatcttgataaggttctacagcaaccaccctcccattctactactcctacacatttaactctgaagttcaatatcattataaatttattgtacatcagaatcaaacctaactatggtggtagagaaacctttcctcatctgagccacacacacacacacacacacacacaaatgtaacttctggtaaaaaaaaaaatagctacataaataaaacaagaaaaagaaaaatgtgactttgacagtagctggaatacatgctgaatcttgcacagagcatatcacaattttcatctgaatactcatgaaacttaatattccctactgattacctaaagctgacaaatcctgaaggtacagaactgcatactaaaaaaaaaaaacaacaaaaaaaaaaactcaatttttccgtatgatggaagttcttgagtgagagccaaggtgcagcgtagtgagcacctgctaacattagggaacataagagggagccttttacacagcggctttccttgtcctagtaaagcatgtctattaggaaacagtgcagatcagtacatccacacctgtggtaaatcaaacattctccatcaagttagttggacgtatatgttttgttgcaataaccaatagggaatttttttttaaattctgtttctgcttttatgatcttaatttctaaaaattctatggtctttttaaaaaatcaagtaggattttccaagttaacattcaaatatattagcaagaaaatgtaatgagcatgagccatttacaaatagtttatatggcatgaactgaaagattatataaagcaacccaattaattagctggttaagggtatgttatatataaatacttaataaaaggcttacagaagtttatagcctagacaaatctccatattctatcggctttgtaagtgagcaggtgtgatctatttcatcgaacacttttggaaacttcaaccaactttttgtttaccaagttttacagttgcaggcttgatttgttaaagatgggaggtgtttgctgaaagctggaaaggacaattgcattctaaataaatttaaaatgctcctgggaaaattatgcttccaagccacacacacccacaaagggaaaatggtataatccaccacaggaagatgagtgacaaatgggaagtcaggagtgtaacctttaggaaggtggccactgggtatgttttggagttgaaacgagtttaactaaatggcaataaacaatactctgtcgacagaacagtctccattgcatgattgcatgtcattttctaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcaggtaagagggctagggaggaggtggaggtgtgggataaatgttattttctatttttcaaaaatgccatctagttttcacttaatgcagcataataaaactgcagcagtcccgtttatgctaaagattataattttcagagcccttttaaacaggcaaggggctcagagagttcatggggcttcattgaagccataatgtgagtgtttagttgtaaatgtgtgtttctatgggtggaccgagtggtatgtgactcctaccagctgaagatgagagaaggacatcattttgaggtgattaaacatctctctctctctctctcttatgtctcttgaaaagactgtgccagatttcatttccacaatgcctgacttgtcctaaatacatcttcctcatggcaagacctttttgtcaaacatgcaggattgcaaacacaataaaaaaggtatacagggacagttacagaaaagatgcctctttcttctaatttgttctagacaataaactgctatgtgttagtctccacagataatgtggatagaaatatttggtaaattgtgaaatcctatataaatgaagacatgagtaatgttcaaaaaaaaagaataataacaacagaataataatttctgagcacttggtcttaagtttaagaaagtaaattcattgggaagccaaggcaggcaggatcacctgaggttaggagtttgagaccagcctgaccaacatggagaaaccccatctctactaaaaatatgaaattagccgggcatggtggtgcatgcctgtaataccagctactcaagaggctgaggcaggagaatcgcttgaacccaggaggcagaggttgcagtgagacgagatcacaccattgcactccagcctgggccataagagcaaaacttcatctcaaaaaaaaaaaaaaaaaagtaaattcagaattagaaacaaagcgcagactggtgcttctcaccccagagtgattttgccctctggaaacttagagcaatgtctgaagacattttggggggtcatatttggaacagggcactctactggcaactagtgggtactgctaaacatcttgtaatacacatctggaaaggctagtgagacgtttaaaatagaagcattaataaaagatcagatgattgaatttgggagaaagaaaaaatatccaggttatatttatgtggtctgccggccatctctttatatttaagtcattattgtggcataggcaaagtttttatctaaaataacacaagctgtattgcactcctttgtttaaaggtctggggttgctatgttgttgattggtaagggccagtaatttcataagtagataaaccccttcgcaggaatgcagaactgtggaattttgaatcactaggaagagctctcttcaaataatcatctggcctgactctctggtgctccatctcacacttgcagagcacctccatgcagccattgagttcagaattgagtttttacttgcactgaacatcagcagtcaaaaaagttgaccaaatgtttctattatgtgctggatgattagagtaaaaaaaaaaaaaaaaattctatttaaagttggagttgggaggttaaggtgggaggatcacttgaggtcaggagttcgagaccagcctggccaacatggtgaaaccctgtctctactaaaaatacaaaaaaattagccaggtgtggtggtgggcacctgtaatcccagctacatgggaggctgaggcaggagaatcacttgaacctgggaggtggaggttgcagcgagccaagattatgccactgtactccagcctgggcaacagagtgagactctgtccccaaaaaataataaaataaaataaaataaagttgggaacacaaagttgcatttgaaagcaatcacagacatcaccatatctaattctcacactttgcaagatataaaatgatattgccagagtcatacatccagtgctttctccaccatgagatgctgtcactcctgctaggcagaagagtatccattgcttaattctacgttatagttacattaacaaatctttagatattaaaatttcctctcaataaagcaagtaagcatgtggcagtagtgtcaacaactgaagaactttaaaggtaagtaaatgcaatcagtaatcctttatcataaggcttcatttaagaatgttaatacagttcattaaagggtgtaatgaagtgtgtgggtcagaactgagaaaaacacccagatttatgtgtagccctcaaaaggcaaagaagcatcccttcccaggggcctgttgtaacagaggctgaggacttctgttacatttaagagaatgatttgctgatgagacttctctttgctagatactcatttgtctcacataactggccacatctctcccaaaggcaggtctggaataggcaagaacagtgtatggtggcggcagggaagggctgctagattttctcttctatttcactaaatttggacttgaagttcctttgatagaagtagctctttcctagtagcctggggattacatcattcaaaggacaattaaaacaaaaacaaaagcaaaatatccaagaatggcactctcaagaaatgtctagctggtacagcggggagtaggattagttcagctttgtaccaaccactgacacagacatttttctctctatcctctctcttatcatgttttggcctatgtttgcttttcctaatcattttagtgttaagagtggctgtgaggcttggaggaagacactaaagagatggcttatccagttttcgttctagactaataatctgcaaatattttggagataagaacccttttttaaaggtcctatcatgaaattcctaccgtattgcatgtaaaagggcaattgcgctttttggaataactacagaggactcaggtcagcttaatggggcttcattggaacctccagaggctgctgtgcttgaaacgggatattggagacatcagaacttttctgttctggtcaaagtaaggcccaagcactctatgtgatccagcttaacttgctccatttgccctggagaaaaaactgtagaaagagacttgtctgctaagagattccctagggaggctgaggactcaggagttctgggtcctgattctggctgccattccactaatccttctacccaaggaaaggaaaggaaggagacttacctcttttactgagggtcctaagaggtgccaacaaaggtgtgtggcatcctacatgatcatagcatcaatctcaaacaaccccctgaggtgagtttcttattctcactttcgaggtgaggcaactgacgctcagacaggataagtgacccatataaggtcattctctgagcctggctaggctgccatgtggtctccagactgcctgatctcagagcctgtgtgctcactttactctgaagggcccccaagcagaatggatgactattctgaagtaggctttcagaaatgtctggaaaaaacacagccatatgctgctggtcttctttagataagatcagtattaatagcttttacttttctggtagctgaaatcactgccaagaacatttctctgccaggtcaatgtggtaccctctttatgtgcgttttccatcattgtcctgcatttccctgcacctttatcatattttctcaccttttaatgattcttcagaaaagaagaaatcaaaggcactttaaagatatttaacatttatctaaaagcaaaaattggggaaaagtctatagttattcttgggcatgctaattactccagcaaagtaattatttctattcatattgaacaagtactatatgatgaaaatctgagaagttatttccccaaaattcatttgaaatttgaatgtcaagacttgattaggctacagaagatagggctttcatatgaactttcttcatgaatttctacagttggaaaatttccataaaccagaaggtcgcatgtgtcctctccccaacttacccacccaccacctcgcagcagggtcctgatgctttgaaaagatgctgctctctccttaacctgccttcaatgtggaaaccattgctcctcctcactctcatttccccaagtccaactactctttcgccgactcttcgctgtttatccttcatatacaccctcattcatactgagtgtgattttactgagggagtggctgaaaggaggtgaatttaaagaatgaagcaaagggcaagaaagctctacctatggaattctcaacttgtacctagcaggatgctgggtgctaagcaaccatctcatttaagtgaccaaataacttttaatatgattggcattattcctcttttgcaattgaaaattgaagccaattttatctaccatatactgagcatacacttaaatagaaaacaccaaggccgcatgacctgacctggcctctttctcctcttgctggcctccagtatccgatgctccatttcagaggcatcctttctggccacgtgacacagccttttctccccacatcatagcctttgcacttgcggttgccaaatcctggaacattctaaattcccagtcattcccacctaagtcttcatgaatatctcttaagagataaaagagaggaagctcccttctcattctctatatcccttcactctacttagtttgctctatcaccacaataaaaatcatagtgaattaagacatttactcatgtgttgtccatatcctttactacactgtaagttccaagaggacagaagccttctttgtccttttcccccaaatccctagcacctactacatttgacacacaacgagtgttcagtacagctctgttgaatgaataaatgaaccaaacgaatgaatgagccaagaactgttctagattctttcagtaaatcatccccaaagtcatattttcttctaccccactgagtctgctatactctcatctctgccaagcacatttgggtgagttgctcctccgtgcctgttacctgaaagaaaggctttgttcaactatgaaatcctatactattaagaaaccgtaatgcatttgagcctgtgatttcacttcctgaaaataaatttggctctttggagaactgcctagtcacttttaaatctatagtaggattgagtgagcaaatcgctatttcaggcacccattcctaatggttctctgatgaaaagcaagatggcactgtcttgctccattcaatgggaagctccctgggggctgggccaatttcctgagctggagaatggccagcaggtgagcatgaacatgctgtttcccactcagaaaacctgccctctcctttacatgaacaaattgagggagattttttctcccacaacactagtggcaatgaatatttagctataattgagccattagtctgcataaaacatttagcaccaaaatagtttgtacagctatattgcattttctcctgtcaacatttgcatgcttttgcttttttctccacccccaacccactttttttttaaatctctttcaattaacataaaaacaaggcaaagaagaaaatggctttttgtttgtttgtttaatgcctggtcttcctctgctagaaagtgcaatgacaatgctagttaatcaaataattttgtgcattgattctctcctcatatatgttgtgctcagtggctgtaatgatggcaaacagagatgcttaaattggtttcatcccttgtttagataagacagaagcaaccatcagctgtgatctctcactatagaaaacatcaagtcaagcatggcacactatgctaagggatggtaaacatgtgcccactaagtcagatctataagtcaatcatttttttcatcataaatacatagaaaaggccgaagacctcaggggccattttatactgaacacgtaccgtatgctggcactgtgctaagcagcttaaatgcatcagtcatttaatttttatgagaacattctggatagaagaaactgacagagcccagagagattttgtaacttgcccaaggtcacaaagctagcaagtggcaggtctgggatttaaaacttatctgaggctttgaaaggaaaaaaaatgtaacctcttctgctactgttgtgtacaacaagatgtcaactgattctcgtcttattgcaacctgaaacgtattttagttaagccttgcacttcttgaacgaaggtgtttcattttattctcaaacatctaatcatgtctagctttacacaattccttaagaaatgtgaattgtatcaaatgtccaatggcccagtagagaatgtggtagggatatcatagagaaatttatttttttattcaatacttatttgttgagcactgattgaaggtgttggagatacaacagtggaagcaacaacaagaataaaaacccaaatctctgcccgattaaggcaaaaagagaccttgaaaatgaatgtaacaagtgtaaaattatccagtgcttgcaaattggcctaataccatcaagttactttctttttttaattaataaactttatttatttattattttatttgagacagagttttgctcttgttgcccaggctggagtgcaatggcatgatctcggctcactgcaacctccacctcccaggttcaagcgattctcctgcctcagcctcccaagcaactgagattacaagcatgcaccacaacgcccagctaatgttgtatttttagtagagatggggtttctctatgttggtcaggctggtctcaaactcccgacctcaggtgatccgcctgccttggcctcccaaagtgctgggattacaggcgtgagccaccaagcctggcttatttatttatttttcacttttgttttcagttcaggggtacatgtgcaggttttttatataggtatgttcctgccagtgagggactgtgattagaatcttagactgaaagttgggagacccatttgcaaattctgctttttccctaacagaaaaaaataactaccatttatctggtatttactgcatgcataatatgctacgtgtttgactggaatgatttctttttatcctctcaaaatagtctttgtcatagatgaggaaaatgaggcttcaggtcacacactcagtgacaggtctggaatttcagatcagagtatgatgttcacatcacccatgttgctcacatcctgtaaacaggcaactttgagaaattctgttgatgcctcttcaactcagtcacctcatctgtaaacaaaattatcaaagcttgctaatatttccatcagctctgagcttccatgcatacacgtgaccaagaatcctcttactagcgtttagatataaagaacttgcttgtacttagtaggctttcaaagaaatgggaaattaattaagcagttcattctttcttaaagtttctccagtcctttgatagtctttgagccagttaattgataagttcattactttggataaatcctgacaatgtaatgatgatgaatctcaatttatactaatttgatgataatttgtagtatgttatataattactttggcggtacattctcatcgtaattatgtttctctcaggctgatattaaaatctatttatattccctgaacacatagttagttttagttgtacggagcggttcatagttacgagtatattattaaatgtatacaagaattaattgacctttgtggataaccaacaatttactaaaggtgtgtgcaatttgcccatattcttagtgtccaggatatccatttgaggattctcaaaggcctccaaaaagtcagtttaagaaaggacttagatttgcttcaacctgaattgggaagcgagaaaaaccatatatgcatatgcttcaaaaatgctctaatgcttaatcccggttatatcaacttttgactatagtaggagataagaaaaattttccttgcagtggaagcaggggaactttagaagaaactgttaaaagtatttgaagatatgtatgtcagggcacatcttaagcctattggatcaacaaacttcagctttattcaaaattgtaggaaggtgcatgctcttgggtgtgccttttttgtggaaaggggtttgtagtgtccgtcagattttctaaagaagcctgcatactaaagtggtttaaaaattactttgctaggttaaccttatctacttcctcaatacttcataaatgcaagatcttatcaaaaggatccttccttcctacttttcccatgactgttagccaaatcctctctgctataagggtaatcctatgaaatgtaactttcatcatttatccagccaaattatgtgccagatttttttttttggcccgtagagttctatgtgccaaagaatcttctagggtgaaatgggaattacaatatcattaaaaactctaatgtgttagacgagatcattatttagtgaaggttcaggtgattcattattttccacttctctaaaaagggaatgtattagtacatatgtcacattatttgagaaaatttaaatgtgacaatgtattaaatataaggcattaagctcagcaccaatatataaaatattccacttagagattatcattgtcattagtagcagtagtcttttgtgtaggcaaaactacaggtgtgatacaattcttagaactggcttcccaattccaactctgtatcacgacatcactccctgctctacatcataacaatgatttccaagattcctctcagcctaacataccaagtctccctgagatctcacctaatgtaattacatttccatgctagaattaacactttgcatcctctttgttcttcccccaaccaaccagtttctcctgctctgtccctttcttggtaactagaaatttcatccaattactgcagccagaaaccaagaaatccaccttacttgctctcacctttcacattcattagttagcaaacagtggagattctgccctcggaatatgtttcagattcaatctccttttctctatctctcatcatcttccttctccactaatataattgatctctctgccacaagttcctttcccctcctatttcctaaccatcctctgcatagtctaaaacactattcattctgagtaaaacatctgattttatacctccatgtttgaaattgctgagtgccaccctctccaccctggatgttgcattaagaataaaggacacatttcttagcaggccatgcagagctctccacatctgtccccactgtcattataacatgtattgcaaaaatatctattatgtctaatatacccttttagccaaaaaaaatctgttacaaattttagaaactatcctttcttactccattaaggagattaaagttctttccaaatgtgacctaaagggattcaaaatcacaagaaaagctgtatctaattaattctaatatctccagggatgtcataataggagatcaaggtaggtctgaattcttacagaagaagaactgtgagttaagcacctcctagtccctggaacatcatccaagggcctttcacagctgagtccagcatttatacaggaggctccctcacgggtagacaggaaacttaacaaactctggcaggtggattgatgcatcctacttaagataaagctttgactcctgtggttctaactttggtcttaaataaccatatgcttttatttgggatctcaaactccagcagaattttgtgcaaattattaattttcctgccacttgcacctcctattatcaattaagaaattaataaagtcctaagatcccaagattgaaatcaaacctgggttcaaatactataactatgctttatctctaaaatctataaattaggaataacacttcctctccaattaaatgtcaataacctattactgtagtgaacatcgtgttgtggcactcagcaagcagtcgctgtgaatattattgttgtagcttaaaaatatgagcttggttaatataaatcagtggttctcagcactggctgtacataagtatcacctggggagtttttagtaactatcaatgcctgaaacatatcccagacaaaataaatcagaatatttaggaatgaggctcaggcattggtattttggagaagtttcttggtggttctaataatatactaagaaacactgatataaattattttttaagcctgatagttttcagataaattaacaaagtcaagtcacccaaaaagctgaagatcaggccccagactcatgaagactttactgggcaatagagatctcgtgagaccagcaagatcaccatttaatggctgcacccctgtctctccttcaaaaggtgactttcaagcaaatttgaggtatagttttcattaacatcattatcaaagaagcttgttgcaaaaagattacactgaatcatctggggtagataataattcaaaatattctgttaccttccagcttctagattttgttcaataatttgctgttaaaatttgtttcctccgtattctctcttacatatcatctttccaccaattttccctagatgttgcagagaggttattttttagtttcatgtaattgccccaaaagttccattctctcctgtttaccagattgcctatttcattctgccatgggaaaacttcttttcctgctctgttctcaacagtctgcactccttaaatagcataatctcatctgttgtgcacctgggtgatgcaatctggctcttctagtaggatcatcttccaagctaaactaaaccccaatgatttgcactccttttattaatatctattagtatgagcttcctttctcctgcagaccatacctctaaggagagaagcttataaaggagttaacactgagaagaacttccaaatagtacagttatttaattcatcaactctttgtggaatatcttttgcttttctttagtttaacttggaggtaggagaaaaaggggctggatttatacatcatatagcacagttttcaaatccaaggaaaaaccctagacttgtggttagcttatcacctgtgtacatgcatgtggttaacacgtgtaagtgaatggagggaaacagaggaacttagcaagttgtcaacctcaaatgaaaaaagtcaatttttcctcttgatacatgtttttgacgttaccaaagctggagtaatgtaccaatcactggagttagggttacagcgatttcatatgccataatcacagaaagatgagaaaatgagatgtattggttttctattgctgtttaagccaaatttagtggctttaacaatatatttgtttacagttacagaaatcagagatctaaaatcatgttgttagcaggtctgctttccttttggaaacttctggggaaaatccaacttcttgccttttcttactcacagaggccgtcctcattccttgtcttgtggccccgcatcacactccatctttctctctccttctatttacgcattcccatttacaccttctctgccttaagaccctgctgttttcattgtgactacattgggcctacctagataattcagagaaatctccccatctcaaaatctttcatttattcacatctgtaaaatccatctccaggtaaaggaacatattccattggttctggaattaggacgtagacatctttagagaaccattatttggtcccctccataagtagatggatatctttctgtatatcaggatttttctggtgtcaaatgctattttctgtatattccactattacttttgtagatgtaagctataatcattcaatgtggcatgaatgtactttctatagcaataaacactggtctaaagactgtcttatatccatcttgttctactgatgaccaccattaaaaattgcatggccaaagaggcatctggctcagaggatagtatagatgcagcctaaaatattacagttagcaaataaaaaagagctacacactgaagctcaaactttcatcttaaaattgctgctcggagacttgatatcattcacctggttttctgaagactcctgtgccaaaaataccttatttctatcttgaggtaaaaccattattttagccacattgcatgttcacacatttggaagttattcacttgaaattattgattacaaaccatgtctggtggtttagaatttatcctgatattgagaaaggctataaaaagagaaatacacttcggcttagtcagtataaacttccaagatacctatttttcaatggaaaaaaagcagtaataaaaaaccatataaatattacaagaacacctcaaagttgctcagtagcactccaggttccattttgagtttctgttaccacaatagtagcagcagaccaattatgtgtggcatatggatttcccttagtgatggttgctgagaatttgtggagaggaatttttcattgctgtctccatagctctgcattgccttccaggaaatgatcagactgaaatatggtccaggcttcttaagataactccatgtgtggttggaagattctgagccaaagactttccctgtattttgtagaatgactctgtcaacaaccacagccattagacccctatgagctacgtcctggtcatctttacctagacttcattgaggactcacaagacaaactaaaatatggccttggtgctgctcaggccgtacatgataacttcacccatcaagatctaagagatcatcattgccaagaacaactaggctagactaagaaggtcaatactactgtgaacaaggtcatgagtgttctgtggcaaaaactccagaaagcagctggaccaatgtgggatcactgctgtcaatgagcaatgactgtgtcccaggatatattgataacagttaacagtagggccttagaattgtcctttcaagaggcagctggcagtgagggttttttgttgttgttgttgttgggttttttttgttttgttttgttttgaaacagagtttcactcttgttgcccaggctggagtgcaatggcctgatctcggctcaccacaatctccgcctaccaggttcaagtgattctcctgcctcagcctcccgagtagctgggattacaggcacgcaccaccactgccgactaattttttgtatttttagtagagacggggtttctccttgttggtcaggctgatcttgaactcccgacctcaggtgatccgtccaactcggcctcccaaagtgctgggattacaagcgtgagccaccgcgcctggccggcattgagtttttattctgccttctgatgacccatttactgcaaataaaataaagcagtaattattttttagctactggaacaatggaatagtcttgtggcatttccatgtacagtagcatgatacggagaaagcatttacaataggtacaagacactcccccgctgctgatttaaggattatgttatctagatggaatggaatttcataagtatgcaggagcttaagtcttttggtattgatgtcttttgagttcttataattaattctgtaacaatgtagattagaattaactaacaatggtgatcattagaggtagggggggaaaactgttttgttggaaactttttttcattactctaacccaactcagctacatcagatctgaagaattccactcgtttatatggggaaaaattatttgacttgtcccaatcatgattatttgtttatttgtaatatctttattctataaagaattggagctgcctggaaaaatatatttgaaacaaactaataaatgtttttaaaagggaggggaattggcacaaaggagaaaactagataacaaaaacataaagctggatgacattagcacatgaaaaatgtatgccctgtgctcctgactaattgccaatggaagacccgtaattttgaccctaaacctcctagcaatcaaaacaaagttgtaaacaagatcatttacatgacttgcagtattcatgtaacagaaaaatgtatttattcaaaaatgaacagcttgttctggcactgataacaatgctagtgatattagggaactgagatctctggagagtgacatatgtcagaatcacctccacttcattggctagaaccagcacatacccccacccaagcccaagggactaggaaatgcaatcctagtatgtaccctttgagttggaaaactggaaaaacagtactaatgacgtccacactagtaatcttccaaaatcaatagatattccacaccctgcctattttagatacataatgttaacaaaagggctgggttgtttttaactgtcaatctaagtcaatgatataatgtcaaaagttgtttaacaagattaattccattaagaaatgagacttggccaggtgcagtggctcacgcctgtgatcccagcacttagggagaccaagacaggaggatcacttgaggtcaggagtttgaaccagcgtggccaacatggtaaaaccccatctctactaaaaatataaaaattagccaggcatggcggtacgtgcctgtaatcccagctactcaggaggctgagacaagagaatcgcttgaactcaggaggcagaggttgcagggagccgagattgtaccagtgcgctatagcctggggcgacagaatgagactctttcaaaaataaataaaaataaaaaaaagaaatgggccttattagaagaacatattagtggaagcaattcggaggaatatgctatccatatgaacagtattgatatctgcctttattacattttagtgtgtgtgacatgaagtgttttctgccaaaaaaaaaaattaattgtgacaattaagtaaagccagagatggttcctagcaataccgccctaataaagtatacatactgcctaggtcagcaccatttggtcagttcggcagacaagtactgtatcaaaattcaaagtcattctcaggaaaaagtaagttctgcaaagaactattagaaaactccctatatcgtgattacactttttatttttaaaactgacatttattttgatgtgacattttcttaatcccttaatgacttttagttgaaataccaacatgcagagagaaaatcaaaatgggaatgcaatcgttttatttacaaagtatgcgacaattagacgacagggctactggtctcagctgcttaaagaccatcacaagaacaactgctttaaaagcaccgcctttggtgctgttgactttgttgttcttatcaagatgtttttcattcacctgggtgagtgtccacaaagttgacaggccaatgatcaatgactggactcgtttcttaatttccatttctagtaaattcaagggaagaaccaggaggcactaatgcaagcaattagctaggaaaaggaacgggaatttttctactacagcaaataaaatgtgtacctggaggaccccagggttctttttgcaataacagctgtcctgttggctgtttattcgctgcattttaatatctctttcctaacgctgagaggcatgtcaaatgaatatttacctccaggaattttaaaatacaataataaaaataatcagttaaatggttgtttaaaaaaatgcttatctcttaacaggggatccaaagcctccataatgaaatttaaaaagaaaaattttacccaagtgaaaagctataaactcaaatgcctttgtgttctattttcagtttcagaaacaaaattttaaaccttagcattcagccctatatcctcacatgaaacctgcccagttccctttcaagaggtaatcttggctgcaattacactatctaatgaccaaagtgaaaaataggatttctgactgaccctggcaggccagctctttatgctcgaatgatataagagaacagctaacaagacctcaccatgcatggccttaaatgttattgatggcactaaagcaagtctacccttgaaaaaaaacatcctttagtgtgcctggtcttgttgtcaccgtaggagtgacttatatcctgtgggctgatgattcatggagtttcctgtcatttgtcttaagttcatgacattgcaatttcactaaatattcctctggttttcgtgttagtagagacgttgttgagaagtgtaggactggtgttcatgcagttatgtgctgtcatctaataccctctttatttcttattccctttcacgtaaaatcattctagttcacatatcttaggcaccttccagaaccgctgataacttgcaatgtctttccccagaccttttcaatccatctcttcaactgaagatctgaaagtctttgttatttaatgcaaaggtacatgttttccatagagcagtgattttcagacacagctgtgaaatgcagaaatcaaggctacactctcagaaatcccaattcaggatgtccctgtgatggtgtctaagagtctttgatataaaaacttccagagggaatttttacttgcatccagaattgaccagagttgtgcggaaaactaccttggaaatgtgatttctaagtcttctctcttcatttctttttttttttttttttttttttttttttttttttgagtctcgctctggcccccaggctggagtgcagtggcgcgatcttggctcactgtaagctccgcccccgggttcacgccgttctcctgcctcagcctcctgagtagctgggattacaggcacccgccaccacgcctggctaattttgtgtatttttagtagagacggggtttcaccgtgttaaccaggatggtctctatctcctgacctcatgatccgcccgcctcatcctcccaaagtgctggattacaggcgtgagccaccgcacccggccttctctcttcatttctatgcaaagacaaaaaaaataaaaataaaaaaagcacccaaatagttattttggtaatctatcccaaggaaaggaatatccttattcatatttagaaagaattgtctccaaaccatttgcatcttcttctcagttgacaccatttccgggactccaaaagtaagatcacagttcaatgaacgtagaacccctgtccttcctatccacctccttttttccttcttccacgaagtaaaaacaatatacacgctcacagaatgtccggaactattacgatcccaagtagttatttgagaaccagcatgaagaaacagtgtgaaattggtgtcagaatagtccctatccttttatctgtaaatgaatcctctcttccccttctcatggaaaagggggagagagaaaggtttcagagatatactcattcataaaccttcatttaaacatatctacataccagtattgacaattcaacatttaatgagttctactcataatgagggtggcattatgctaagtcgtaagtagggagatcaatgaaatacatatttctaagtatgagatggctcagacacttaggcagtgggaaagacaaaaccctgtgcattatggacaactccaaatacaaaatttgtttagtacaaactatttttttttttttgagacggagtttccctcttgttgcccaggctggagtgcaatggtacagtctgggctcactgcaacctccgcctcccaggttcaagcgattctcccgcctcagcctcccgagtagctgggattacaggcatgcgccatcacgcccagctaattttgtatttttagtagagacaggatttctctatgatggtcaggctggtctcgaactcctgacctcatgtgatccacctgcctcggtctcccaaagtgctgggattaaaggcttgtgccactgcacctggcccaaactatttttaaatttgatcatcaaacccattacttcgatgtaggtcaagcagtgtgtaatggaaatagtgttggctggaggtcagttggcttgctccacaccagccactcattggcctcaggtttctgatctgctgagtttgtggatttccaaagtcccttcctgttctatgtttccaagcatttgcagtcaccctagaaattatcccattcttattataattctgttcctgattctttccccttatttctcttttgcagattctgttcatgggcatgatgaccgagtactatcactactttttcacaaccctggtaagtgcatctgggagaaatgtattccacatggtaggaaacgtcttcacacagttatttcagagtcggcctcaccagtgtcaaaggcaggatattgtcatggagacttgccttactttcctaagaatcctctaaatccagcaatgctgagcagcaggctttttttctttctttctttctctttctttctttctttccttctttctttttcttttaactagtatcaatgcatgtgcattcagagagggattaaaatgaaaattccattaaatagaaactattaaagtaaaaactattcataaaaaacatcatctacaatttttatatacattagaaggtgtatccaagtgtgtctggcattcattgatttgatgtggctttgctgcctgtgtccagtagatagctgggttagccaggggttacctgtcagatgtctgaaaaaccttcagaaaggggagttttggagatgctctgcacattgaacattttgcctcattaagaaaaatcatggtcctaagccttagaaatctaaaagaaaccataggacatcttaaattttgagagactatctgatcatggagaatgatttagggtatttaacacatcaaaatgatgtgataattttcattcagtcaatttcagaaatcagtgacagcccccacctccccacctacacactcacacattccacttccttacatgagaagaaaaacagaatcaagctcgttttctaatctgtaagagtatattagctaaatttgacctggattctgggggggtcagtaacagtgccattttagcaaattcagctgacaagctagtgagtaggggaattcaaagaatttagaataaggacccgaagtagtaaattctatttctgactcaaatgtctttgagagtgcagaggacatcatgaaatgaatgctttgggacagttgtcaaaatcattactgctactgagcatagggtggaagtgggtacagggtagaaattcctgaactaaggtttgcatagtcttcccatagggtggaagtgggtacagggtagaaattcctgaactaaggtttgcatagtcttcccatttgcctcttactgtttcttgatcatgtcatccttgagaacagctgagggaaaacttgagaactgcaaagtgtcttactctgcttacaaatatggttcttcccatcacgaagaacacctgagggttactcaaggtgacatggccatctgcctcggaactttctacctcctccagctgtgaacaccctggaagagctggtgtgggagaaatttgagaaggaatacgaataatggaacctaccaaggctaggagaccatagaggatgaataaatgtgcacttttattcctcttcacccctaacactcattctgcatgcacaaggggatgtagcaaatcggattttagacttctgacattctttgttgcgtggaaaccctaaattgtaggacaacctaattttgcacatgtttaatgtatgtcattttagcatgttaaatctatgtactatgaatctctaagagggttcatgtgtattctggcagtttctgtcttacctcctgagactggacttaactgtctttctattcactgagtgtgctaccggactcatttttgcctgggtcctcttctttaactttgcttctttcatccttttcctctgattttatctgcattctgtcctggttggcttttatattcttaccattcttgcccatgagtattaataaaagttaaagaaaaaaatagttacttagtgttaaggaaaaaaatatgcaatgctttaaaaggcagtattgtacacttttctgatactgatctcggagcacagagctgtgctcttacagttctactgcctcatccaaatatatcttgggaaagagagagttcatcaaaagaataaatttgtatgcatcttccgcaaatgcaaattgcgaagtgtttctgaagctgctgcttttcagtacctgtaatcatcaggataatgtcctgtcttgcaatgcactttcagaaagcggttgcattgttaagaaacttttatggaagtatttttcctgttaaatgttatcttgaaagttgagtttcttctgaaatgtgatatattttaatgatgtatttttaaatctagtcttttcatataagaaaaaagttgaaattattacataaccctgtcttaaatgtgaatcaatttagaaacttctggtttacactcagcctcatctgtaatagaaaacaccaggatgagttcaactttttttcctgaaacattgtctgcaagggaatgggttcccttattaagatgttcttgcatccatgtaaccttgtgctctagtatgtcctctgaagagcatcctttggtacctattctgagcctatgttcagcgaacattcttcatgccctcgttgtatgagatatgagttcttttcaacaagccaggagatgattttttttcggccaggagtgattttcctgccaaatgcatatgcagttttcaaatttcactttgtggcaagacctggaacagcctggggtgcaagatttggtggagaagagtgggtactgccagtggttcattcttgttctgatcacatcaccactcagaacctcagtttcttcatctgtaaaataaaagcattgaaccaaatggaaataaatattcttcaaaataccccaaaggctatgaactgggaacagaattcttagctttttagaatgttacatcctgtgcccaaggacatactaattatcagcagccaaattcctcctcttgacttatctaaactctaacagtactgcaaaaataaaacagatgaaaatgaaaactgattactgccctagaatttttagggcagcatgttaatgaaaaacaatgggaaaaatgttcttttattgaaatagtgtggtacggctgccattttgttttaatctatagcagctcccctttatccaatgggtatatgttctgagacctccaatagatgcctgaaatctagtatggtgccaaaccccatatagattatgtttttcctatatatacaaacctaggataaagattaattgataaattaggcacaatactcttgcagactggaaccattatgaagtataagggtgacttaacaaagcacttccataccacgatactctacctcataactgagacagctattaactgactgatgagcaggtggcatctgtagtatggagactctggacaaataattcatgtcccaggcaggacagcatgggacagctcaagatttcctcatgctactcagagtggtgtgcaattttaaaattatgaattgcttatttctgaagttttccatttaacatgttccaactgtggttgaccgcaggtaactgaaaccatgaaccacaaaaccacagataaaaggtatcattgtattagttggtgctacaatcattaatattcttttgtataaaaaatgaaaattctaattattttccactgttatcctttttgatactatgcaggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacagtaagtcattttcaaataaaatcatttgcaagaatatttgaatgccttcggggttaagatctcacgtatctttaaaatattagagaaaagtgttacagtgggtgccttgacttgcagtagagaagaaagagtttgctttttaggtaatttgaaaggctgtgactggctactagcaaaaactgctacttttagcttcctggatgtacttgccccagataaaaaacttgacaagagtaatcaccattatcagccaaaccagtgcaaggacaagtgaagagcattttattctaggaatgtggctgtggggaaggtggctggtgggggaagaggaggaacaacctacctgtgagttttgcagaaccgatttgtgttcctcacttctgccacatttcagcaagcaaagccagtgtggaaaaatgtcggatttacaaacagtcggtgtattcagctcttcctgtcctggatgcgtataggttcacctctgcagaactgacagtgtttaacaccagccatatgtcgctcttgaagcagatgccagacctgcctcctgacaagtcagagatactctgctgaacagatacattgcgaactgcctcatcagagagcttctccctaacatcatttgtctcttgtcaaatgcacctaccttcactatatttctctaatgaagctccctgggtgctgaagaaaatagcaggaaataattttttaaaatgcttcctatatgggagccatctaaggggaaagatattgtggaatgcaggcaggtaatagcattttaaaatggcatagtattttattatccattcctatcatcgggagacgcactctcgcttttaagatgcaatttacccaacatctcacagagaacttgggatttttttcccctttttcttatgaggaacaaatgaaagtgaagaactaaatgaatgaattaagtggttctggatgattctatgttcaggctccctaactgtttttcaaacctgaaataacttttaaaatattcaaagtgaactgagagataatgatggaaagcatcttggtacaaatgagccctgggatgatttgaaacatttctttgaataggagcaagtagagaatatccagggaaatattatatttctgaaagggagagggaacaccagagacagagggagaagcacgctaatagatcggtttttctcttcttcctcttgggtttataatttcaatgagttcaaatatggttcgaaatcctctgcccacttttccaatgaagtttcaatcacaggatgagatctcaaatcatttttacctgtgtttggtatataccactaaaagagttacagtttgaagctatgttaacacagactgtggacttatgccaaacattaaatattcatcacaagtatggcttaatttacaaagaaaaaaagtctgtgtgttcaattatactgagctgacaaaacagtttgtacatattgactgaaatgaggaagatcgttgaacaaaggagacagacctacgcaattcatgtggaatcaggccgagcgtgaggtgaagctgctatcccagggcagcagctggtgtcctgagctaacggtaatcccctgggcaggaagtgtgataaggttgagtcccagtggatggaagaggtcctggtctgcctgaagatttttactgtcatcccaactaagagaggggtttctagactgtgttcttacagttattattataattaactatataaaggaaagtggggatttaccagagcagaagagggtagctcactaaggtgctgcaaaagtgggtagagtaactattgaatatatcaggtcgtgtcaatactaattttttaaaaagtgataggatgcaggccccagtatgagttgtatccaacagtcatgcagataataactttgaaattatgtgaagcgtaacatttacctttttttatccaaagagtctgctttgcacttgactgttttctttctgtttctcctggatgtggctactttgggaatgtggaaactgtgtcatgggaggtgaagggcattgaagggcacgaaaggacctccgtttgatcaatagctaagccaagagagcaaacttatgaccccaaacccaggcccaaagctaacaaatctttgctgtcaagttgcctctatttaaactctttcttctctacgttaaagataaaaagtcctttggtttcagtttcattgggtccacatcgcagaccctgcccttcattcattcttgcacatcaagcacttgctgtccccctgccttgaagtctcacttatccaggctacaaaatgccacttcaccagacagagcctccatgaatcaccatctagtacagtagccccctccctggtttttctctctttcttcttacctgtttttgttttcttcatagcccttatgacctgacgtgttatattttgattcgtttgttcagtaccttccctacaagaatagacacttcataaaagtgtcttttatgaaaaagaggctttgtgattttgtgctttgctttctccccagcactagaaaaggcccagtgcgaagtacaccgtcaataaatatgtatttaataaagaaattaatgtgctaaataaataagaattaagcttctactaaaactgaagatgttaaatgaaaaatatttaggcagccttgaaatagtcccataaaagtgcagagagttcctataaacaagatatatgtgaatgtgcatgattagtaaaatagagattactttaaaataatagtgtttttttaaaattagtcacagactggccactcttaatatttaaataatgctactactataatagaattgaattctctgaaatcatatgcttcattccactattcttcaaggtgaatttctctgtagctgtttatagtcatattggtatgtggtgcatacatacatggatgaatataggaattagaaaaaagcataaggaaaatgcatgtgttttgatttcccattcaattgtctatttttctctctaatatttctaactattaagcatttcctagaatttcatacactaaaaatcctcaaaaatatgattatatcaaaacattcaaacctgaaaatagagaaatcagtcatgcctatatccaaaaagtcttgacaccagacttaagaacaatagaattaattaaagaaaaaaatttagtttaaaaattaggttaaaattaagttactaagaaaattgttactgagtcaacggagttgaaaaacagtaaaactcgttattaaaaaatatcttgagaaaaagaaagagtgttttatcaactgaagtggtaattgacagaattaacagaagtttggagtgatttttataaaatctactttgttctcttttataatgtttacatttttctcagcaattgggctgattcgacctttcagcttttggatagactgggataatacagaatggttcattctcaaatgggtccttctcagtggaccaaaattgtgtatgagtcaacactgcacaggagtcaggggaacaaccaaacattgatctgacatctgcctttccagttcttcatatccactcacaacataaacttacgtcagagccttatcctgctctcttgcctgtaaacatttcccttaatcatgacccacagggaagacgtcatagagttcccactttgtacatccactgctactccagcgatgaaagaaaacaggcagctggattcagtacagaaagcaaaatcttccgagataatgaaagcctagggttaagtcctggttatgtctcctaactaagtgacctgaacaagtcatttaacctctcttagtttgtctgctcatccataaatctgtacaataacaccttacagtgttactctacagattaaattagatcacatatgcaaaacctctagtacatagaattgaatttacttgatgatacctgatgttttgcccatttgtagtcaataaaagaacaagaggctgggcacggtggctcacacctgtaatcccaacactttgggaagccgagccaggcagatcacaaggtcaggagttcgagaccagcctggccaacatggtgaaactttgtctctactaaaaatacaaaaattagctgggcgtggtggcaggcgcctgtaatcccagctactcaggaggctgaagcaggagaatcgcttgaaccagggaggcagaggttgcagtgagccaagattgtgccactgcactctagcctgggcaataagagcaagactccttctaaaaaaaaaaaaaggaaagaaagaacaagagatattctgaaatatcatggcagaatccatgtatttccaagaaacacattccttagcttgcacatatagcccaagatggaatcttatctgggacctatatgaccctgtgtgatcaacccatttgatctctgaatattaggtctctcttcagcaccccaatctcctccagctttttccaacaacaattatacaccatccaggcagctaagtatggggactttctaaggccatatagtgtcgtcagtccttgtctctaagatgaggtggcatctgactggcttatgttcagagtcctcaagaccatcttcagatttgatgacttgctagcaggactcacagaactcagaaaagctgttatactcacaatgacagatttatagcaacagacgatagagtaaaatcagcgaaggaaaaagtgacagagagtccacacagaaaaagcatgaacttccaagtatcctctcccaatagagttgcatgaacagcacttaatcctcagcaatgatctatgacaactagaaagtattgccaaccagggaagctcacccaagccttggggtccaggttttttattgggatgatgggtcacataggcatggagctcccatacagctggccttagttacttagtaaccagccttttgggagatcaaattgatacagcatggcccagagacctaggccagcaaaaataggcattcatcataaatcatgtttttagcataaactatctgacattgcccaggacccaaagaatacaatgacactcttattgggatattccaaggagttaaaagttatctctcaagagccagtcaaggggccaatcttctctttggaatgtgcaaggtctgagtaccctaagcctagtgagttaatactttactgcaaattgtaataaccaaagcattgtgtactgaggagaagtatgctttcaatgtgcttatttcatggttcagattgtggtaaaaagattttcttagggtcattgagcaatgtgatttcatccaggctttagatatacataaaatgtgaacagaaacacatttggaagaagaaaatttgaacacaggccagtttctattacattacctattacctaaaatgatgacagtcattcagtaagcaggcctcgagcacaaaactgaaagggggaggaaaatcagtggtagtttattagtgctataatatagttaatgtaaacattttctccatctaagaaaacattgtatttcaaggggtagcatattttttcgaacaaatagttttcttctttgggttgaagggcacaaattagacctataattttgaatcattttattgcctttcccaatatggagcccgccttgagaaagaatgcccatcctttctaaactaagtttatggaaaagtcagattattagaattccagtccttatacttctctatcaaattggtcattcagcgaattaatgaaaacacatacgaattttcaaaaaagtatatcctattgataagaaacagtccaagtcactgtagcatgtggctatggtcatgaggtgaaatctgagtttgcatcacgaattagaattctcactctttcccttaatgtctacaaaattttaggcaagttattctacctctctacaagcctcaatttccctgtctgtatacctatttcaaaagtttaatttcagtaattaaaaaagatgacatatgtaaaatgcttatagtgcctggcacatagtaaattatcagtgaatattaacctttattgaactattattgtgactattaaatcatcagaccaataacttggtgtagaagcagcacagctttatggttaacggcatatactctagcaccaactttgtgggtttgaatattgcctgtccccccatgagtttggggatcccatttaacatcttttttctttatctgtaaaagaataaaggttatagtgaaaatttaatgtttgcaagggatttagaacagcatgcgacatatcataagtgctcaataaatgtcagctattgctgttgactgcatttccaaaagtctcaatctgccagtagcttactttcctccaattaaacagaattagtacagcaaagtggtaaagatcatgggtgctagaatcaggcaggtgcaggctcaaaccctggcaatgaaattgattacagagtagccttataccggtcaatttccatgagccttagttttctcatctacaaagtggatagtgtaagtcctgaactgaaatgatcaaaacatttttaagcattataaattactgccaccaccaatccaacgtcagtatgtcaattacataagcatgaatgaaatgctttttcttaaaactatatcttaaaaccttgcaattctacagttctcacaaaaataaatgtcattttaaggaattgagtagtattaacttcgtcagtgaacatgtttaaacaacttttctgtgtcaggaaccatgttagtcaccaaagctaacttaaatttgagcagtttctgccttcaaaaaaccaatattcttaacaagatacagacataaagatccatgaccatgaatagatggaaaatacaatgataaagattgaacagaataataatgattcaaagtagaggtattccgtgacctcaaagactgataaaattgtgagatatagtaacccctgtcctcactttctacctccaccaagacatgagcaatcaatgcatagtatatgttgaatgaatcaaccaattttggaaaaccatatgataattttcattctatgacctagattctaggtttaactctgaaaatgattagctatgtatataatccctattactctccagaaataataagcagaagtagtgacatctctgggatttctcactatgattgtgtatgtggtgtgtgtgtggctgtgcatgtgtgtgtgtgtgtgtgcatgtgtgtgcccctccacaaatatcctacctcgaagtgagttttctcacataataaatagctttatctcttctgcttattttgaagacttgttgagaatttcaaatgagctaatgtatttgaagttgcaatgaaaccctcaagtgaaatgcaagggtattataagattttatccctaaaggaaaccacagggaagcatattttataaaatgctgtattatgtaaaattgtgcaagtgagaggaatttcatgaggaagggaagaacgagatgcccaaccccctaaaaggaatgaccgacttgtttcaatctctctcaagaaagcacatgctggcaagaggaggcatgttctgagcaagctgcacttgtctgcccttcagagggtctcccaaaacttgccgttgagtttcattccatgactatgaacttcttaactctgctaaatgaaagtgaccaacaccagtatccttatctggaaatcacctgttagtgattgtagcagtttctttctaccaaatataaaccagtaagtagatagataaatagatatagacaaatgctgagaaacaaatctgatattgcaactttgagctttagtagcttctagctcaaggtagttgatcttaacaccatgcttaacatggaggacacttcgcaaaatatttgttccttgaatcaagtcttttgtggctgatctgggttgctttatttttttttaaagaacttgaaacgaagcagagttataacttcaatttactccaaagtgtgaggtattattttggagaaaaatagctattggagagtgaaaactacctagctgaagagtaaatggcctttgagatcagacagataagagctatggaagcagggagagtgattatgcaagtaaaggaaggtaagcaaaagtggaatttaagatgcggtgtgtgttttcctccacagactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcaagtgatgctccctcacagcccaggggcccttctgagcactgttgggcttgcccatttggtatggtcctccccacagggttctgctggcatgatgcccctaagagagaggaagccatcatcaaccagtctgctcagatttcagtgtcaaaagtttgtccagaaggactagcaggaattttccattgtgatgctgagaagttcagtgacgctaccagataccaacacttactctccttcatgccagccatggccatagctcctgctggctctccacacatgtccataagggcatatgggtgtttcttccatgtcccactgagtcaaggggagagttgatccattactgaagggtaccagagatagttccagcattatcagtccacaatcccagtggcctcctaaagctcaggctgtacaggactgagtggaaggacctctttaattatatagtgactattttgtcatttatcagctaactggaaaagtttattcccattcaaaacctactgagcacataaaagatttttgagagtatggggtatttgcagggatagatatcttcactgatgtcctgggatcctggactgtcctccaccttttcttttctctgaggcagtttgactccttgtcacaaggccctgttctaagccccgtgactccttatcgatatgtacactgcatgatcatccattccaccacgaacctcagggtgtgtctggacttgatgataagaaataaggctctttggagtagctaggcctgagtatgcgcaatgctctgagatgctattctaatatttctctatgggatacagacatttagttctcaagtgaagagtatttttttcctttctgtactggagaaggatggaaatatagtgtaaagaagagggagggcacaggagaatacccagctaagagtaaggaaagacacctgctttggactcgtgtctctgctggtctcttccatgcctgcacaccctctctcagtctgttcaatgcaactaaaggctgactctgatccatgagggtgaggataaagcaggcgggatgtataaggattaagtacctaggctacaaatctaggttgcttgcaagcccaggatgagggtgcaatttaaggaaacattcattcttgggtgagtattctatacttgcacaagattaagaggaaattctcgcttaaattttgtaccctgagcacctctcttactttatcctagtcctggcagtgactgcatgggtttaaatcttagttccactaacactgatgagcaatataacctgggcaagtctattggtccattttcatgctgctgataaagacatacctgagactgggtaatttataaagaaaaagaggtttaatggactcacagttccacgtggctgaggaggcctcacaatcatggcggaaagtgaaaggcatgtctacatggtggcaggcaagagaaaacttgtgcagggaaaatcccatttataaaaccatcagatttcatgagacttattcgctatcacgagaacagcatgggaagacttgcctccatgattcaattacctgctactgggtccctcccacaacacatgggaattgtgggagctacaattcgagatgagatttgggtggggacacaccaaaaccatatcagcaagttacttacacttcttgtctctcagttttcttatctataagatgggtatagtatcatctaccccacagcatgactgtaaggataaagaattaggcaaatgcttgtgaagaatagttcagaaacctagtaagcatctgaaatactattctcttgccattggaaggcaccactaagaatagcctcattcagtttactgaagatgataccaggaatttcaaactggcaacaacaacaacaacaacaaagacatcacaaataggcatgaaacaaaataccttttctgacagctacataactctgacacactgtgcctaatagaaaaacatcacaccacctccttttccctgcagtgatcatggttgtgtcctgaatcgccatcctgattaccttgatctttaacaagaaaacagctggttttcttttatctcctagaagttcaaggagaggcagaagtgacatgaaagcttgggatcaaacactcaagagcccccaagacaccttatcacttgtacttaagtcgcataagaaggtgaaattaccaagccacatttaggcatatttaaagaaataatgagctccaagatgagggaccacactgaaaataagaaggcattttatattcattcactccaaagaagcaaatctctcatttttaatctccacagttaggggttacaggaagggaggggggaatgaatcagaaaccattgtcaacattgtgctcatcctcttttgtctcctgagtcaggatgtcatatgctacctttggcagggtgtaggtacctacagagaagatggaatggggtaaccagaagcaatgcctcagcctgctggaggactggcactgaggaaattctgagacaacctaaaacatgcaaaagagaaagtgcacgtgttttttcagatgagtgcataactgaacaaaattttgcaagtatcaggtttcattaggaaacatgaaataaggaacttggtccccaaatttcccccgctgcttcttttttttttttaagttattctcactttgtaaagaagttccaaaactagagtcagaaaaaaaaaaatgaaaagaagcaagtcagcagattgaatttatggggtgaagaccaaattcatcacaggaggtaaacttcctgagcagaggttgttgcatgtgcggtaatttctgataactccacacactgttgggaatcagtaagcttttcagacacatgtttccagctcactgcctttcagtgtatggggctgactagataaaggggaagagttaaagaacatatgaaacatgatagagtatgttactatgttagctctccgagcatttgctaaacaaatgcatgctaggagattatacattcccactcaacaagcattactggaactccactacataagtaatattaacttggcatcttaagggataacacccttgaaaagtagaagaggtggcttctgccacctagtaatgtaaattctacatggcagaggattgacacgcttcattaaagctttttcttatacctcaggataaaacatacactcttcagcaggatatacaggctcatgatcttgttcctgatccctttgccagctctctcatctcctgctccatctgcagcacctgctgaacctactgtggctcccttgaatatgcaatatgctcctaccaaattattttaactctgattgcaatgccgtgctcctctgggtcatgctttacgtctcaactcaagcactagctcctatctgcaggaccctgactcacagatgtaggctttgtacctccattacaactgtgggtatgctattgtgtttgtttccacgtctatctccaagctatgcgttttcagtctcaattccctagttcttgcacaatgctggacatagaataagcacccaataaatacatgccaaacaagtgaatgaattgatgaatgaattaatgaatgaattagcaaaggaaccgaagaacacacacaatctataagcatgtgcagtgcttcaggacacactgtgttcataaaaatcatatccagaaacaattcaataagacagagtcaggagctggactagacctgtccaccagggccataggtttcgataggagagtgaggcagggatttagggaaagaccaacctatttaactctggtgctgggaacacagattctgagatttcatcacactttgctgtcagtgtgaacttagtcaagtcatttagcttgtttctcagttcctccttctataacatgggtaataaaatgcccacaccataagtttgtagggattacatattttatatgtatagcctagcaaaatatttgtcatgtagtgattgtttaatgaaggatagctaccatcaaatgaaaggttctgttaaaaaatgaaaaacagttttccattttcaagaaaaggaagtctattggagtaagattgcagttagattaacaccttttcttgaaatgaacttacagaaaaaatgtacatgtataattcagtccactgtatcctcctttgaactagttttacctgcttgttttctcatgcataaatatttatgtttctttgacatatttatgtgaggattatgtttttaatattctaacatcacaaagtagccttttgtttctgtattgcactttacgggtaattgttattttgccacctctttgtacaactgatatggtttggctttgtgtccccactcaaatctcatctcgaattcatatcctcacgtgtggagtggggtacccataatctccaagtgttgaaggagggaggtgattggatcatgggggcgtttcccccatgctgttcttgtgatagtgactgagttctcaagagatctgacggttttagaaggggctcttcccctttcgctttctcctctctctcctgctgccatgtaagacatacctacttccccttccgccatgattgtaagtttcctgaggcctccccagccatgcagaactgtgagtgagtcaattaaacctctttcctttatttaaaaaaaaaatgtctaccatgtaaggtagtggtcaggaaaaataaggcaacacctaggaaacattaagtatattgccaaacatattataagcactgcatgtttcttattactgttattggtgtcatcattattattattggagtcatcattattattattggagtctaggataaagtagcagttgtttgcaaaatggaagacagtacctagtggtggaaaaccgaaagttccatggagacaggcatgcagcatgcagtaggccaactgcaacgaagccaggaaatgaggactttcaatcatagaccacacacatgattgttcaagaaaggtgaaaagacattaggcaaaaattcacctcaaccaaggctgagtttcttggttcgtttgggctgctgtgacaaaataccataaaccaggtgtcaaataacagcagaaacttactagtcatagttctgcaggctgggaagtccactatcaaggtgctagcagaatccgttgtctggtgaaggctggcttcctagttcatagacagctgtcttgcactttgtcctcacatggtgaaaggggcaaggaatctctcaagggcctcttttataagggcactagtgccatccattcacctcccaaagcccccacctcctattaccattgtcttgagggttagaatttcagcacatgaattttaggggtaaacaaacatttgaactacagcatgagctaccagaataccatagcaagctgcttctcaggtcagtctgggaaatggtagctgaatgtaggggccgaggaagccaagaattacgctgtgtccagattaggttccagctggatataggacaatcagtggagcagctgtggtagcagcaagcactgaagcatctggaaagaagaaggtttctaatcaggggtgctgggaagaacagtgaacagagtacagaaccgggaatcagagatcttacgttacatcagttgtccttagttattttctgggtcacagtgcttctattaaaactgatttaaacataaatccattgtcccccaaaatgcaaacacatttgtctataatctcagtggccttaaagacaccctggcttccctaaaacccacattcaaggtgcctgaattgagttttagagtagaatttggttgaaagggcattccagtataatgaatggcaaatgtataaatgaagcataaggaatcctgttgggcccagatggagtgatcctatgtggaagcagtgaaaaatatgtttaagtaaatgtggaaagacaattggaagttgtctgctaaaattcaaatttgactgataattgatataaaaaaaaagccactgtttttgaggcagagacaaaacgaagtttcagatagtttatcttggtagctatgtataggtatgattgaagcaggtaaaccaacaaagattaatgtggacagaattgcagatgtcttggtttagaagtgatcaccattcataaagagctgaaagggaaacagatttattcaagagaaatatgcaagtgtttatttgagtacaaccctaacttttcccctaagtttaaattcatccagtcacctcccttctggaaatttccacttggtgattctgctgctacctccatatcaacaaattctccatcaggatatattatttttttgcctgttaaatctattattgttaaaatagctccactgtcagataacgacaatgcaactggtatatcaaacaaacacaactactgaaacagcaaagccaattctatttttaatctcccctcctacttaaaattattcagtagaatgatctgggcaaatctcatgacttttttgttgacttaaggtaatgacagtcctagagcttccttatgttaaagcacagcctcaacttcatgattagaatatccagtctaagatattaatcaaaagtccaagttgatttaacatcaaatacctcccctctctgagactgatccttctggaagactagtgacatgacggaggggggatgaatgccttctcctctttctcctttccctgtttacttcctcccaactcctgtggctgttgtgccttctactaggctcaaaaataaacaggacagatctcgctgggctgggctgctctgtgctttctgggcttagcagacagtttaagatggtgtccctggtaggcctgggagatttctgaagctaattctttttcttgaagcatttccttttgactctatgagttcctgtttgaccgtctcttctgaagtttcttttactcattgggtgatggattcctatttcagtggaagcttgcactgtttcctcagcctcttgacatccagcagtacacctcatgctctctctgctgaagcctcctgacccctttagacagtcccattgactataacccaggacattcccacaaagtatgctggatttaaatctggtgcacaggaaacactcacttattcctttcctggaaattctggggttgtctctaatcccaatgcaaccaacttctccctgtcagccaaaaaaccaattggtcaactctggttagcactcttttgtcactcgggagtcacatcacagtctgtagtccactttgcctttctcacatttatatcagtcactggtcttctgcgtcttcagctgcagtgaacctatttcagacttctcttgagtgaccccctggaagctctattcaccaggagtggtgttagaaagtggcatcccaaagacaagactgggcagtgtggacacacagagagacaacagctgtccccagagaagtctcttcagcaatcacctctaccactctcgtgacctcttttatgtatgcttgatttcgtagttgggcccacaagatctagaaccatctctggagaacacttcctttatacttatgtattgggaacactgagggtgtctgtctcccactctggtgtcctgatacccattttactagtacctgagtgaaagcattacagtacgatggagcctgccactcaaaccatagctctacaggttatctaagacctcatcccctcagtacactcatctgattaagtcctgtcaactgtctgtcagagatattttttctcaaccttctttgcccactgccctcatcatttttcacctggactgttaaaatagcctccaactaggctctgtatctttaatctcagcccttttgtaactattgtccacatataagcaaagtgatatacataaatgtgcagtaggtattctaccctttacgaacacaaacttgctcatagcttcctgtgtccaccatccagttccatacagagtggagacagatggctttttgttttcctgactaaacctgcctaataacaccctttttgtcatatacctttcagcctgcctgcaaagccctacctcccatttttcacttagaccaactcttagaatttcttttctctagaaagcctttcctgaacctctgctggagggtgtatcctgctttcaactccgtagctctgatatatctttatgttagcacttaacatgcttcactcagcaccgtaagatctttctgtgggacagaaagtcaatttatctttgtgtcctcagagcaccgtgcctgtacacggcaggcattttaaaagatgcttattgaactgaagccagaaagttaaattctagcaaattcttaacacattttgctaaactaatactcaattttaaactatataaatagttcctaattgatctgctccaaaataaatttactgcataagaatgaaaaattatttctaaatatcagtgcttatgggatgtcactgagaggtatatgaaatatgggcagttttctgccactgctttgctatgaaaaatgtaatttatggttctattttgatgaaatggagattatacatttgaatatataaacctaatatttgaattcaagcttttaaaaatcaaagagtaaaaaataaaattattcatttaggcacctacctgtgcttaatatttgtttggatttttacttagtaggtcactatggagtggggtttttgtttgtttggttggttggttggctgattttgtatgggatctgggtaaaaaattacagtattgaaaataaaaaagtccctggtgaaacgtaagctctgacatatttttatcctactgtgtcttcactgagtaacacttcccattaatgcatgccatttgatctcgattgccaggacaagctgtttcttagtttaattagatgacattgggtctggcagcaacctcaatcaaatttctactcttcagaaaaaatttccatttctatttctcattctgcacctcttgaaagttagctgcattctgacccctcattcttcagcatccctagctagtcttcactgtgtaaaagaaagccataaatcccagcagcccctcacatttaggatatttagacctaaggaagagtgggtttttaggtccttccctcaattccctgtacaactctggatggataaaatagattagtttctaaaggttcatcgtttatatttttaccaattacataggttttgtcttatatataaacatcttagtttgtttgcattataatagcacagcacctgagactggctaatttataaagaacagaaatttatttatttatttatttatttttattttattttattttagagacagagtctcactctgtcaccaagctggagtgcagtggtgcgatcttggttcactgcaatctctgcctcccagtttcaagcgattctcctgcctcagcctccgagcagctgggactacaggcgtgcgccaccacgcctggctaatttttgtatttttaatagagatggggtttcaccatgttggccaggataatctccagctcttgacttcatgatctgcccacctcagctcctaaagtgctgagattacaggcgtaagccacgtgcccagccagaaatttatttcttacagttctggaggctgagaagtcccagataaaggtaatagcatccagtctctggcgagggctttcttgctgtgtttccacatggtggaaaagcaaaatggcaaaaagggcctagctaattccctccagcccctttataagattcctaacgccattcattaaggctccagcctcatgacttaatcctttcctaaaggccccacctcttaatactgtggcattggagattaagtttctacatgaattttcaaggagacaaaagcctttgaaccacagcaataactaaagcactaagacacctattcctgaaatagtcaatcagtggctgggtgaacagtctccaacaagaaatgttgcaagggagtgttggcctcagatgaaggtttctgccaaactcttcttagtttatatgattctaaataacattgatatttataaaatagcatcagggactcatgtcaattattcttgttttcccattcaactactaatgtcctggttctaccccacattgattaaagaatttgctttttatacagtctgtgatatatgtgtgtatgtatgtgtacacaggtgcacacatgtttaatttacttagatgaatatcattttacacatatatatatacatatttatggagggaagtgaggatatacatgttttgtgagaccgtgtgtgtgtgtgtgtgtgtgtgtatttgtgtctgtatctatttctttaacagtgtgctttcgcaattatctcaaggtttgaattatatctaagttggtacatattatttatccagttcattcatttttcactaaaatctagtattctataattaatccattccaaaagtatttactgaatacctagtatgtggcagacactcttttagacaccaagaatgcaatcaggagcaaagaaaagtcctcactctcatgaaacttatactctagtcagggaaatcagacaaggatcattgaaaaaacaaagctcagaagagggaagggcataccatacaatgcccttaagagggaaatgggcattgctatattataaaacttctcacagataacatggaacttgaataaatctctgaaagaaaatagggagcaaagcatgcaaatattaagaagatgaaagatccaagtagagggaacaacttatgcattgaatacacatcagtgtacttgtccaatcccttctgcatggatattttggctgcctcttttttttttcctgcacattcacacaatgcttcattacttaattacttaaattgaacatttaagtaataggctctcatgcacaaatccaagatttgctctagagaagcactgttgcattgtccaataaaaagataatgtgagttgcatatatattagagtttttagtagccacattgaaagtaaaagacaggtggaattaattttaataacttattttatttaacccagtatatccaaaatattagcatttcataatgtcatcaatattcaaattattaatgagcaattgtactttttttcataagtctttttaatccactgtgtcttttacacttatggtacatctcagttctgactagccacatttcaagtgctcaacagccacctccagctaccataatgaacagctgtcttagcttgggctgctataacaaaatcctttagactgggtggcttaaacaaaaggcatttatttctcatagttctggaggctaaaaagtccatgatcaaagtgccatcatggtcaagttccagtgagggccctcttcttggcttgtagatggttatctttccattgtattctcacataataaagagaagcagcactgctgtatgtctcttcttacaaggacactcatcccaccatggggactctacctcatgacctcatctaagcctaattttcatctaaagacctcacctgctagtaccatcacattgggggttatggcttcaacatataaatgtgggggtacacaattattcaatctgtaacaacaacccagcttgagaccatacacctagaagtaggactgctgcttgtatgcatttttagctttaccagcataatagtttcctattgctgcataaaaacttaccacgaactggctaggtgcagtagctcaggcctgtaatcccagcgctttgggagactgaggtggtcagatcacttgagttcaggagttctagaccagcctgagcaacatggtgaaaccccctctctacaaaaaataaaaaaacaaacaaaaaaaattagctgggcatagtagtgcatgcctgtggtcctagctactcaagagggtgggaggatcacttgaacccgggaggcagaggttgcaaacagccatgatctcgccactgcactccagcctaggtgacagagagagaacaagagagcctgtctcaaaaacaaaaacaaaaaacaaaacaaaacaaaacaaaaacacacacacacacacaaactagggatgttaaaacaacaatcatttattatctcagtttctgtagatgagaagtctggacaaatttgctgtgttctctgctcagggtccacgaagctgagaagggtgttggctggggctgctgcagtctcattctaggttcaaggtcctcttccaagctcacgtagttgttggaagaattcactttttgcagacattattggcagcttgttcccttaagaccagaagagagcaaatctctgttttctaaatccctttttattaaagaactattttgattaggtcagccctcccctgcaggataatcgtactttttattaagtcaaagtcaattgattacagatacctaattgcatcgcaaaacattcctttccctttgccataatcaatagaatgacacccaccatattctcaggtcccactcacactcaaggggagggaattacaaagggcataggtcacagaggttcatctcagaattctgcctaccacaactatatagtgtcaaatttctccatactatatttttctgttgcttcatggagatccctggctttatgttccctccattttatttatctatctacctcctattggcttctctttcttttcaaaaccgtctagaatactaccttttcaggaatacccttaattccttttcacctcattttctgctacacccacataagaaaagtctaatgctgtgtcagtactatagtgtgccttctctttcccgatgcccaggcaaggatgtatctcaaaaaatcatccatccttgcagttccacctcatggcaaatccacggtgtccaacagtagctaggctcctagggccacctctcaatccttttacttgtgtctactcatctcttccattcccctcggcaatttattatttcactgggccacaattcaaactttactaccttcattctcaacttactgccaacttatgtgagaaaattggccaggcgcggtggctcacgcctgtaatcccagcactttgggaggccgaggcaggcagatcacaaggtcaggagatcgagaccatcctggctaacacggtgaaaccctgtctctactgaaaacacaaaaaattagccgggcgtggtggcgggcgcctctagtcccagctactccggatgctgaggcaggagaatcgcttgaacctgggaggcggagtttgcagtgagctgagatccgccactgcactccagcctgggtgacagagcaagactctgtctcaaaaaaaaaaagaaagaaagaaaattgaacttagtaggtgtgaacaccttcaatttccaacaacccatttagcaaacttttttcatgcccattctctttctccaaaatcacaggatgagacattgtgccttttcctcagtgtctacttgtgctgctgtccatcttttttcctctgctaagaatgccctttctgccactccctcttcttctatgttggactaaacccaacagctcagctcaggcatcacattttccagaaagcttttgcaaatagacacacacacacacacacacacacacacacacacacacacatttctcctttcctcatttatccaaaactacactgtgtatatcttcaccattgcatttttatcattgtactataaatacatttctatgtgtctacctctccagtacgcattgcatttcttggaaacaagaactgttaaattcattttattcacttagtacctagctctcttcctgcatatagtaggggctcaataaatcttggtgactaaataaataaatatttctttaaatataatatctcactcaaccagactaactagagcaagacatgaattcaacccatgtggaatccattgttcatcttcatagataaaccatccataaataacatattgtttacctataatgataggcatctgggcaacaaagacaattatatgattaatatgatcaaagtaatttgagtaatttgagactgactaatctgatttttgggttttattgaccacattatctagctaattagacaagagccccattcccacccacttcacctatatgaatgtctcaggtttgtgatcctgcccatttagttgatttgcatgtacagaagccaatttattccatttcagaaaacaagccaccacatgaaccagagccaaacaaaactagctttttgtaaaagaaaacccaggtgtgtattctaagataaatccttaggaaataaaaaccagtttacccagagtacatggcatagacatagttaaagtcagcagatttagagttggaaatcaaatattggcaagaaaagctattatatttttaaattatgcagtgatccatgcaagctgttattgcaagataatgggttataaacagcacacataatagttaaaataattatatattgaacagatgaacatatgataaatgcatcatttcagttcctgaaatagctgacatcctaggaagttgtgtggtctaaaggttatgtttatcatttcttcctttgcttaatgtttattttcatcaccattattgtgtatacttcagatttgtttttaaataacttttctgagaactgacttaaaattgtgggtgacctgacatggattacattgcttagatgaagggtgaatttcagatatttgtcattgtacagtactctgtggacctgagaaagacagtaattgtacagttattccatcagggctatgtttatacaatagatactgagtgagccttctttaattaaaaacaaatgaaataatgccatgatgaattgcatctaagtcttctattcaaaagtcaggactaagtataaacaaatttttgaaatccataaaatgccttctctgttctcttttccttttgctatattccccaagggtaccttggcctcttgatcttactctcagaaattctatactaaagtgttaacaaaaggaaagtttgttaaccaaatgaatgattaccttaattaatgagttattaattcatgtttaaaggtgtcactcctctcctgcacattcacaggccaatagggaattcctaaacttggaaagccttcaaaattcaaagaaaaatctcataagagttgaactgaggtgtaagaactgatttgggaatgcacaggaattgagtctgactgccccttcagttccaccaccaaagaggtgaaatcatgtgacctgctcaaggccatgtgtaccaacccaaatcttccatggagagaaaaagggacaatggggtgatggtgtggggcacgggaatctctttctcccacattgtaatcctgtcacctttcctcagtgtcattgccagcagaaagcagatcctgattccctaggtcttggtaccttccctctacttttctctcatgacttaaatgtgtgtaacttttggaagtgctgctttattcaattatgccttccacaaatattttggatatctaccaaatgctagtaatggaattcaaacgtaagtaaaatactttccaccatcaaaaagttaacaactaattgggaaagagagtgctaacatgaataactgacataatacatagttattatatataagtacataataaatgtttgcaatacaaatagttaagataatagctagcatagttactgtaatacaagaacctgataaactatgctacagaggtaacaagtagtcctctacaggaacccagagggtttatttaaaccatattttcctgtcttaaaatattttcatcacataactcaaattttttaccctttgaatttgtgtagtaagtgttggaataggccctcttacaactgcaaaactcctgaaatgtgatttgatcaccatttcaacatgcaacatttgttttcaaatactgcattgctaatggaacccattcttcaggcatccagggcaaaaaggaagactccttgccagaggttcatattgaaaatatgctgggtgattcatttagtataactgattgttcttcacaatttccaggctagaaatagtgtgctcatcaacacatacaaaaaccaatggtgctaaacattgacatccaccagtaaaattatgactggagtgcatgaatcaattagcaaaaactagagagagaattgtcaaacagtgccctattaatacaagttctatttgaaatacaaataaaaggagaagtgatgctggaagcccagcatcaaggtgtcaccaagtttggttttttctgagacctctctccctgacttgagatggccaccttcttgctgtgtcctcccctggtgttttcttcatgtgttcatctctggcaatgtttcttcttataaagacaccgttcaccctggatgttacgatttgaatgtgtcccccagagttcatgtgttggaaacttaatccccaatgcaacagcgttaagtggtgggaccttcagcaggtgattaaagcatgggactctgccctcatgaatggattactgctgttatccatacctgataaaagaatgagtttggtcccccgtctctcatgtgcatgcattctctgatgctcttttgcccttccacgttccaccatgagatgacttagcaaaaaggccctcaccagatgctggcaccttaatgttagacctcccagcctccaagcctgtgataaacaaatttctttttaaaaataaattagtctgtggtattttgttacagcaatacaaatggactaagatattggattagggccctatttttatgacctcatttaaccctaattacctctataaaggccctgtctccaaatatagtcacattctaagctgctgggggttagggcttcaacatacaaatttggggggacacaactttgcccataactttactcatattcactcttcaggggtacaaccatttaattaaaggacaaatagtcatgcataacattcactaggatgactctgaaacattcactttgcaatcaatattgagcaagatatactatgtgctggaagtgctggcaggaattgtactaataagacaagagagacatggtccctaactttgaggaagcagagttcaacatgaagagagacatgaaagcaaatatgtgcattacatatttgcatacatttggtcacattataacagatatgggggagtgcttgtcagggacaatagagttcttccacctcagtacttaagttactttaaaaccttctcagaggacatgagggttggcctcagctttggaggatgaattggagagtggcaggcagcatggtggggaagaacactccactcttgggaactggttggcggctgaatgaagtatggtaagaggttaaatggtatcagcagaggccagataatcaagggccttctatgctctactaaggatccagaacaattctgtgggccagagattctcacaattaagtgtgcaccaaatcacctgacaaaacctctgaaaatgaattacttctcacattcacttcccagaaacttagatgatcttatgcaagtttgagaaagattgcattttaggcattaagataaagttaattatgttgcccgtcctctacccctgtataattcaatataaccaatggcgtgaggtatatattacgatgtgctttatattgcattattcacaagtaaagcttcataacaatccacagtacggaagatattaatagacacatcaattaacttaaggcaaaataaacatggcctcgtgccctccacatgtcagactacataaggatctaacagagcaacacagacctgctatgagctcaccctgaggaacaggaggtagtgagaagggaagaagaaaggcctggatcaaactgttctttctccctaatttccagaacagcaggagagtcagagacgtgagctggagagtggatgggtcttgcagagaaggagggcaagccctctccactaacctcacaccattccttcttggtcctccgtaagccaaagcacaggtttagcccccagcctgggctttagtcatctacattattaaaattacaaactagtgatttaaacttcaagctaattacaacttgaaaataatacttgaatactgacttcctctatgtgcagcttaagaagaatcactcagagaaacagaggaaaacattcattgttggcttttacttaaatagatgattctaaggtttgccttggaaattcaggttttgacaaaagttataacttgagctgaccttttggttataaatgttagagattttctactcatttcttttttttattgattccatattaaatacagctttaaaatttaagtggcatgattaataagagtaaaggcaatgcctttaaaaaatgacttctaaaaaatgcctttttcctcccttctaaatatcttataccatttttaaatattctgcaatggaaaacaggctggtactaacatctaattacctaaatctagattcactcaagtagtctagtcatgatttataacccaaaaaaggttctaatcaaggaatgacagcatttgtgtttaaaattcttcagaataagaaagggaaaaataaacatttttctgcatcaatacatgtcatgagtgtagtcactgccaaatattttagaggacaatttcaataattgcaagggatttaattttaaaggaataatgaagatcttaagtgtgacaaactgttcacttaattttgaacctctactaagtttgctctgttcaatgcattacacattttcttttcattacactatttttagaaataaaatcatagcatcattatacacaaaaaacacgttcagccaaagatggcaattatccacattatgtcaacaagatttgccaacaaaacatttcaaaaataaagacaataaatgaaattctctctatgaaagattactttggcattagacaattattctgcaagtgtttagttggagaatccacactttatacttagtgaatagcatgttgactcttatatagggtcaaacacctactacattataccagtgctttctattcattctattttatttatttcagtatgaacttttgaaattaattatagcttatgaaaaactcaagctaaacaatattcattttgagagttattgaggttattcatgaaataagggtatttttaagctggatttatacattgagcaattaaagataaaaacgaagaagtaaaggaagataaaataaacacaaataacaaagtctttggaatgagacaacctaagttaagcttgggtttctcattaacttatggtgtcatcttggcctgaaattcagcttcctattgatttttttttttaaggagatttttcaaaagcctgtcttgcagggtttgggtcataactaactgatatggtttggctgtgtccccacccaaatctcgaattatagtttccataattcccatgtgtcatgggaaggaccctgtgagaggtaattgaatcatgagggtgggtctttcccatgctgttcttgtgatagtgaataagtctcatgagatctcatggttttatagagggattcccctgcacatgctctcgctcttgcctgctgccatataagatgttcctttgctctttcttcattttctgccatgattgtgaggcttccccagccatgtggaactgcgagaccattaaacctctttactttataaattacccaatctcaggtatgtttttattagcaggatgagaacagactgatacaataactgagatgatatatagtctgataggcagtcaatttgttaccttccatcatcctccttcttatgatcttatagtaagtttccacattgtcttgaagatattataattattaccatgaatagacaaagaaacagcaaatttgccagttgggaataaaattttagtaaattatggattcacatatcataagatatagtagaggtcagtttccctagagggacagcctaagatggggaatcttgtgcaagtgacctattgaggaagcgctctcaggagaaatgagtaatggagtaaggaaggttggataagacagaggaagaaactaggagaaatcaaatattagccatatcccacaggggacctttagaacataaattttcatccaaatgtgcatggtccccctaggaggctagcataccccagtagtactcattcattggctattggtcatcacccttctgggaatttgggacaggatctccctggcatctcagaaccagcaggctcttgtagaccagggataaccaacactgcctgtagctagggcatgaatgtaccaagctggtggaggagaatttgacaggacaccaatagtgactactataggtaggagaagaaacactgatttcaaccatgtagattttattctaaagcatgtcttccaacgtagagtactcccaacttaaacaagaccagaatagcaattcagcttttcaaaacaaaatacaagaacaactactttttaaaaaggtttactataggattctttgagcaagaaaatattcttagaggccgggcgtggtggctcaagcctgtaatcccagcactttgggaggctgagacgggtggatcacctgaggtcaggagtttgagaccagcctgacaaatatgatgaaaccccttctctactaaaaatacaaaaattagccaggtgtggtggcatgcacctgtaatcccagctactcaggaggctgagacaggagaatcacttgaacctgggaggcagtggttgtagtgagctaagatcgtgccattgcactccagcctgggcaacaagagcgaaactccaactcaaaaaaaaaaaagaaaaaagaagttattcttagaacacctcacatatgattttatttataaataattgatttgcctacaaatttaaggaattagagaatccatgtgaccttctccagtagtgctatgatcctgggaacctaccaagtgtaaagtggatgttgtatctatactgtggggcactatattttactgattctgaaattagtacaccctgactgatactttgaggctacttactgggaaaaaagaccatttcataccagtcttgtcctagaagtagggtaataaatgattctggttttcacctgggactgagagtatctcccctggacatgggaccttccattttaaaatctagataatactgggcaaatcagaactagatgatcacactatgtggaatttatagcaagagggttcactattactacaaagtaagaaattagcaaatttggatctttagcttgggactatatagatgcataatttgcccatctgcattttgaattgagaatgaaacaaagagttttaggttttagatcgtcttccccacacacacacacacacacccctcaggcccaatgaatatttatatcaattttctagttacatagcaggatttctgtcaggtgccacatttgagtgttcttaggaagaaactgaaaattcctaccagttcctatgtgtcatccctgacttctctcaacaggtgtatgagcaaagatttatgattcagaaatgattttttaatgtactgttattactttctgtttctgacaattgagaaactagaattttgtcttctcttaatttgaaggctggctttcttctttttaaaatttaggaaggcacattgttggctaaattaattcacaattgggtttagtcagtgtcctccaaagcttatggttatgtagtgccaagaaagaatactccaaattttaaattattttcctagagcaatataagatatatattttttttccaaattctgtatatgtagaattatataaataatatatacagagagcatatatagaatatagaattaattacatatatgatatatatcacacattgctctaggaaataatatatataactacatatgatatatattttatgactataatatattattactatatatatatatctatatatatatagatatatatatctatatatatatgactttcataccatttatgtaacttagactagagaagaaggtaaaacacatcctggttttcacttaacttcagtgtctttccccaaaacatcacctcacagctttttttttttcctttggtccaaggcaaattgctggtatctcagcctcagagaaaatcacaagtgagatttaacttcagaaaagtccagcttatcctaaagagaatgaaaataggtgacgatctctctggaagcaagtctaacgaagtgctttgccctcaaagggtacagcatgtcctctatttcaatgaagtttaaagaaaggccatggtggaaacaagccatttctttcaacaaattgcttgattggctgccaattctgattttattcttgccttgtaacctttcacatgagatgccctcatcccagtaaaactgctgtaaaccttgcatgaaatcacctagtgatttgctgcaagaaaaagtccactcaggcaagaaatacctgttacgtctcagttaatatccaacatttgaaaactgcagagctgatacttgcttttacctgctggccaattcaagatggtctgggtccctgtcaacatttaagctagtatgcatgcagttacacatcctaaattacttggcgaataacttcttaacatcataggctttatactagccttatacacgcacatctttataaggagccaagctttgcagatgacacagcatctctaaggatagaggttgaatccaatcactgcacttaatggaaatctctcaggagtaaagagaaccgtgactatctttggtcatcctttgatgcttagatatgaataatatttagctctcatcctcacaacattcctgcactgtagatttttatattcctgcttgacaaatggcaaaatagacctcagttggtttgatcaacttgtccctggtaaaggtgcaggtagatttgaatctggggctgtgggaaaccaaaatccatgctgcttctgttgctgcttctgttctaccatcatgcctccattaaagaaatatgttcagtgtgtttaactgagaaattcaccaagtggtacagtatgatcattgaatatgagtttttccttttcttaggtcctaattttattttacttttcaattttttatttccataagttttaggggaacaggtggtatttggttacataagtaagttatttagtggtgatttgtgagattttggtcacccatcactcaaatagtatacacggaacccaatttgtagtattttaccgctcacccccttcccactcttttccccctgagtcaccaaagtccgttgaatcattatttttttttcttttttgagacagtctcactgtcattcaggctggagtgcagtggcacaatctcggctcactgcagcccctgcctcttgggttcaagcaattctcctgcctcagcctcctgagtagctgggcctacaggtgcacgctgccagacccggctaatttttctatttttagcagagacgaggtttcactatgttggccaggatggtcttgatctcctgacctcgtgatctgcccgctttggcctcccaaagtgctgggactacaggcgtgaggcatcgtgcccaacccattgtatcattcttttttttttttttttttttgacggagtctcgctctgttgcccaggctggagtgcagtggcacaatctcggctcactgcaagctccgcctcctgggttcacgcttttctcctgcctcagcctcccgagtagctgggactacaagcgcccaccaccacacctggctaatttttgtatttttagtagagacggggtttcaccttgttagccaggattgtcttgatctcctgacctcgtgatctgcccacctcggcctcccaaagtgctgggattacagtcgtgagccaccgcacccggccccttgtatcattcttatggctttgcatattcagagcttagctcccatttatgagtgagaacatacattgtttggttttctattcctaagttacttcactttagaataatgagtctccagtctcatccaggttgctgtgaacgccattaattcattcctttttatggctgagtagtattccattgtgcatatatatatcacactttctttattcactcgttgattgatgggcatttgagttccttccatatttttgcaattgtgaatttgtgctgctataaacatgcatgtgcaggtatcttttttgtttcatgacttattttcctctgggtagatatacagtagtcggcttgctggatcaagtggtagttctgcttttagttctttaaggaatcgccacgctgttttccatagtggttgtactagtttacgttcccaccagcagtgtagaagtgttccctttacattgcatccacaccaccatctacttttttaaattttttttattatggccattcttgcgggagtaaggtggtatcgcattgtggtttggatttgcattcatgaagcccgaatgccctgccctcagtgaatcaaaagttaatcaggagaagcagacaagtaagcaatcgatttcatgcagccatgtgtacattaatagggataattgcaggaaactatgggaaccctaggaagaatgctaaccctgtctctgaagtttaggtaaggcttcttggaggaagaaatatcaaagatgaaaggtgaaggacaattagagattatcaaggtgacactaagggacactaggtcatcctaagcctttcagtcagggtcaatgtgataaactggaactgagagattaatgagaataagtagtatcacatgtcaaatgccacagaacaatggaaaggatatgcaaatgcaaatgagcatggagcaataaagaataaacagactttaaataaacatattctaaatcaaataagccattgcaaatcctcaacactggtctatacaatagcagcccagaaggcccttcagcatgccgtttggcctgaaatgcattaaggatgcagaggaaaatatttgaatctgatgtcacactccaggcctctgtcaatgtgacatttttaaaatactaagcaaaatattgatggcagatataaaatggtctctattccctatgctaatgaattgaccattaaatggaaataagcagcctgttttaatgtttagatgcaagcgcttctgaaaacactcctgtcttggcactgggcccgggtacctgggggatgtatggcggttgggtggaagtcctgttagaggtgacagcatcagcacataacatgcatcttttaagagcatcactttattaactttttgattgttgagctcccactacacacggtttccaaaatcatttatattcagtactgattgctcaaacttgcacacgggaacaatccatggcaagaacttaaatggcaacaagattggtgtaaaaaatgtgacacaagacaaagagactgactttctgcagcagcgttattgaaggatgaggcttaacaccgtaaaagaactaaattcacttgctgcattctctgcaccaaaaggcagcaactcttcgattgctcccaggatgtgtgtttccttctctggaaggtgttttatgtttctttttaatgccttggtaatgacactattaaaaattaaattggaaatgtattttgattaatatactttcaagggagtttgctaattagagatctgcaaagcccatcttttatcactggtttttacttattataaaatgttttatacaatgatggctgatagcaaattttgctccacaccaagagagagaatgaaactaagctggatctaaatgagaacaagcccaacctattctaattaacatgattccattgaactgtaatgttattgaaacaactgacttttaccatttcaacttaattattctacaataggcagaatgtatgttgcttcatgcttaaagcaattttgaaagcgacatctttgaagtatggcatcaagcagttttttttctcactcacagtttgtgaatattgttttaaaacatcattaagtcaaataaccatagtctaattaagtcttttgtagttttgaggcggtttcatgaaatgccacgggatttatttgactcttttcctcacttgactgaaagttcttgagaggctgagtgaattgaagccccagaatcctcagcctgaggaaataaatgctgaaaagtatttgagttgaagtagtattgcttaatgtgatgatagaaacacgaaactgaagggcttgctcagcaattctgctaaaatatcacgatattacttaggcaagccctattcctgtctttgtgctcagatgggcacagctgcaaaaggattagttaagaagttgtaagtaaatgagcacttggaatttaaatgataaaagcctgtcaaagaatgataaaggacccctagagctgaaagaaaaagtacattactattttttttaaatctaaacgtatttgcttgatggacaagagagtaccgtatccctcaagagatgggttcagtcagtctcctgtgtctgaaaatagttgagctagcagaagaggccaaaaaggagactttgttccatgttagaagagtctctaagcactacagtctaactgattcactagagaacaggacatacttctttggccatttttctgatttaactttcgaaagtgcagtgttagctttcaaagaggtccaggatgggttcccaaggctgttgggtgctggattcagcccttgttgggaattggggcaaatttccaggccaaatagaggaaagaatagaacaggtgtactgttagtgattgctttgctcaaaatctttaggttatagaagacttgggagccctgtggggtaaactgattttcccagagtcactgaagtcttgttacttgcaggaaatccaaagttacgggagactgaggttgggcaaaatgaggttatattgtgagccaggtgaaaccgcaaaagcctttgacgttggaaaatttgacagagaagggctcatgtttcaaaataatttctgattaaagtatatcatttttgcatcttctgaaattatagcagtattacatatatcttggaagatcttcggaattcagcttaattagctatattaagtatcatctattcctgttagttgtaaaaggaatagtggggccaggcgccgtggctcatgcctgtaatcccagcactttgggaggccaaagcaggtggatcacctgaggtcaggagttcaagaccagcctggccaacatggtaaaaccctgtctctacaaaaatacaaaaattagccaggcatgatggcaggtgcctgtaatcccagctacttgggaggctgaggaaggagaatcacttgaacctgggaggcagaagttacagtgagcagagattgtgccattgcactccagcctgagagagagcaagactctgtatcaaaaaaagaaagaaagaaagaaaaaaaggaatagtgggccatgaaggcaaatggtgaatgcacactacacctgctcttaaggaagccatcatcatctggaggaaaatgcacacaacaaactgtaatacaagactgctatgatgtgggttataatatgatatattaataaataaaatactagtaaaccccaaagaaaaaaactatgcattccatccaaaagggttcggaacagcttcggagaggaggtgacatttgaattgaccttgatagattctatcgctcattcaacaagaacttagttaggatgtactagttctgcgaaccgtccttatttgttgggatatattagtgtacacaagagatacccatccctgcctttgtgatgctcgctttctatcaagtaaggtttctaaaaatttactgggggagagaatttttagggagagagagtactgggaacaaattcgtgaattattatgtgcacaaagtctggggaagcatctacatagttggaacacaaagtttatgtgtagtagctattggggcagaacatggcagtagatggaggtggaaagcacagcagggaaaagtcataaatagtatattagaaaggtgggggctgggcgcggtggctcatgcctgtaatcccaacactttgggaggccgaggcaggcagatcacctgaggtcgagagtttgagaccagcctgaccaacatggagaaaccccatctctactaaaaatacaaaattagctggatgtagtgttgcatgcccgtaaccccagctacttgggaggctgagaccagagaatcgcttgaacccgggaggcagaggttgcggtgagctgagatggtgccattgcactccagcctgggcaacaagggcgaaactccgtcccaaaaaaaaaaaaaaaaaaaaaaaaaaaagagggattttattctccaggcaattaaaaattttgttccaggaaagtgctcttatgaagaatctgaaacacaaagcaagttataactactgtttattgttgccatgctgaaacactggaaaatgcacagagatcagcgtaaatgcctccaggactgacgggatgcaggaggtcctgggccatgggtacagccctggtacttacaggcctccttcagatccatattaatgtatgagctttggattgctatggttgtgccagggaatctatcaccaggctagtgctccatttaggaaacgatgggggaaaaaaacttggtttgaggccatgctaggggttgttatctaaatccccagagaatgacctatgaggatatggtgaccccaagaataattataacaactaggatctttgggggcaaacctatttttttcagggcaagcagtctttgaaaagactcagcagatctcccttgcctacaatatattaaaaaccattttcccatagcaatctgtattttgcctgaaaatcctctagattatagggttatgggatccaataagtacatgcccaaccatatgatgagagcatttcaacattccaataactatactgaaataaacaaatatgcagtttgtcagaccttgtttatcatcaatgactaactcaatgttttcatcttctcctaaaaactacattggccatactagccacagctcactttcccaattttataagacttttattagtgttactatttacctattaatttcctgtatatgggtggtggatggatagatagatagataaataccttaatcatcagagtaaacttcttcagaactgtaatcagaccccaagcttaataactggcttgaagttgtctggtgggattggtcagcaaacatgagtatcagacaaagatctatggagctgacaagctttgagcccttttccagtgattcttatggtgtagtgtgaggatcttcttttttaaagctaactaaagtacttatttaaaaacagtgttccaatgattttgtgctcatttaaaatgtaaaaaccactgcactatattattgatgacataggagggcagttggtttttcactgacaagcagcataaaagaaattcctgagatagggcagggttcattgcaaactgctctatgagtaatcacgtatctgtaagggagttgaggagatcttaagtaggtcaagatcataagggaactggatttttgttaggcttccactcggacagtcctgtgttagatgctttgaagcactatctcttttcattttcacaacgactagataaagactattaatttttgcaaatgaagcttgaggaagttaagcaacttgcaaagaggcacccagctactcaaagatagagccaagattcaagccccagtcatttgattccaaagtcattctccaaatatgtcatgctcagactttaaaacttgatagcaattaaaatgctatttaagtagcattttaaattactattgttatgctgaaagtgtcttgtttacaatgtcaggtttatgactaaaatttgtttgtaaacaatatgtgaaaatcaatgcatagcctattagcggtatttttaaaattgtaaatgcaatgtgattctttttggtgaggccaatagaaacatattaatttactgtttatattaaattatcctgttttatctcaatctttctgttttccatacagcttttcaaatcacaaagtaattctatcatggattgccgtgtgatgtgttttataaaagccaagcatcattgatatctcagaatactagaaaaggagatattttgagttggtgagaaatgaatgcactgacaatgtactgaagggaagagaatgtagggcatattcaagaagtttcaatgtggggagagttgtgtgactagaggtaaaggactttaaaacatgctttactgtctcacagttaaatctgaagtcagcaaaagtcacccacacttatggtaatgtggtaactctatgagcagaaacacacaagtaatccaaaacagaaatcctagaaggtaaaaccgtcctgggacccatttaatccagtggtcaacaaacagaatgggacaggcaatgaaggtctgtgaaaggcattgctagcaagaagattagaggtgtttcaacaaactagccaaaggtcaagggttcattttctagaaatcccttttactctaaaccctgatggcaaatagaacgctatgtgtcaattccagttggcctgagaccccttgcaaagaggactgcacaaaaaacgctgaaggcttattttgtttctactcctgcagacagcccattctagccttgtgacattgacttgcaggagaagctgctccatgctaggtgaaccagagaaactgagaaataggatcctggaagccagagcagaggctctttgtctttgtaaatggaacccagcagatccaagagggatccacttgggcaactcacacttcaaacatgccactaaatgagtgagaaatcaggattttagtgatgatagaaaatttttaaattatttctccttttattttgggcttgagaatgttttctccttatgacccatataaagtctagagttaggatgtaaaatggagaaataagcccacatgctttcatttctttcacatcatctcattgatggaaatgcagtttggtgaagaaaaagaacatgagatagactggttctgaacccctctgggtacatcttactaactttaggatctctttcctctcaataaactggggaccatcctacttaccttatctagatgctgtaaggaccaaatgtgattacatttatgccactttgcatttgtcagtatataattttataaagttatcaacacgactctcatgcaaacataatgtaagcatgtgccaaaaatacacttaactccttaatgaaggaaccatctggatggtaaatctagttcaaaaaagaatcacagaaagagtggttatatagtccaacaggagaagctaatggaaatgaatatctgagttaaagacaaaattgattattgttcaacaagcaataaaaccataacctttgaggtcatcttctgtactagacttgcatcagttaggtctctgttgaacaaaaaatatctaagtccacatgtaatttcatagtcttgaccttagacaatagaaaatagtaaaacaaacaaaagtacaatcctctagaggattaaatcatccttgggtggacctgttaggcaatgatcccatgtgactttgaaacgaaatacagtcgttgttcttttgttttatttccaagttttagataattttctcagcagttccctattgtgtcataaataatttccaaagattattcatattaccaaaagtctgatgtcattgtgcttagacctgattaatttacatgggggcagtgcaagatgttcattgaccatggaagcctctggatatgggtagcaaattcagagctgctgtttcaagcagctactaaggacagaaaattaacttctgtaagaaaatttcaaaagaaatctctcattgcattttcagaatcctttctccagaattttttttttctcttactggcttttttattccaaggtgtttgagtttcctattgctttttaggtgaattaccacaagcattgtcgttcaaagcaacacaaattaattctcctactgctttggcagtcagaactctaacacaagtctcattgggctaaagtcaagatgttggtaaggccgattctttctggatgctgtagagggaaatcagttcccttgcctttcacaaggtccagggattcctgtaatccttggcttatggaccctttcctccatcctcaaagccagcaatctttcaattgaaagtagcatctttcaatttttcagtctctttctctctgtcttctatttctgtcatcacatcatcttctgtctctctgacccttcctgggtcccttttataaggaccctgtggttacattaggcccacccagataatccgggatgatctccccactttaagatccttaacttgatcccatctgtgtagcttctgttgctaccttctaggttccagtgattagaacatggacaatggggaaaagcatgacatttattcaccctaccacacaaaggtaagaaactccattcaagaaatgcatctgcacaatattcctatagcacctagacattttggtgaatttctctgagtgcccaacatctgatagatttcctggtctactagaaaattgtcttcctttttacctgtaagtttatgatcgtataaatcatagaacaaataacagaccagtttccagagagggctttctgaatcctggttccacatttgaagtacagcactttttccttaatggtgggtttgctacacctgattaaataagatctgtattatttgtaataaaccagatacattcctggcatattagtcaggattctccagagaaacaaaaccaataggagagagagagacagagaaagagagagggaatatgatttattttgaggaattggctcattcaattatggtgacagagaagtcccatgacctgccatttgcaaactggagacccagaaaagcagatggtgtaattcagtctgagtccgaagatctaagaaccaggggagctgatggtataactcccagtatgagggtagtagaagatgagatgagatggcctagttcaacaataaagcagaaaaaaagaagcaacttcctctttccttcacctttcattcttcttagaccctcaacagattggactggatgatgcccaaccacagcggagagagcaatcttctttattgggccccccaattcaaatgctcatctcatctggaaacactctcacagacacacccagaaacaacgtttaatgtgggcccatcacccagtcaaattgacacataatgtgaaccatcacacctggtgtgaccttatttacacagccaatttattcaactatagcctggttataaaaaggacaaatttgtattgattttatacaaataaccacattgccataaaagctagtaagttgtctgtgaattctgagtggtcagggagaataaggtgccatataaagaatgtgtcatttataggttaccaaagagagagttaaagagatcaggaagagaatgaatctttttattcttttaataagatatgtaaagctatatcttattaaaagataatatattattatcttattatttaataatacctttttatcttatttattattatttaataatatcttattaaaagaccatatcttattaaaagaataaaagaaatgacccaggtatcccaagatatcttataataagatattaaagccatataaccacaattagattcccctcagcagttcacttaatcctacttgtcttataactagtggatgttggatcaacacctggttttcaaaggtcttctgctcctggactattaaaaagagtcctgaaaatcctgattccatcctctagtacagttagtcatctaagtgacaccttaatatccaaagtctataccaatgactgtttgaagtgccaataggttaagagtattttttggcaccatgtttccatgaggctctgatactgccattctctgacaaaggctatttccagactgtagtttatagcaaaaccttcagaaaaacatgagagtaaagcagaaaccacgtgttgatgatgggaatgaaagtgtctgagacgatgacatagaaggtaagtgataatttatcttcttgttaagagcaggctaaatattccattttaaaagagagaaaataaaactatagtgttacattaatgcagtatttggcagaaaaaaagattcacaaaacttaaaatatctatcttattaatgaaccaattaaagctgggtaaacttcgccaaaattttaacacatttccttgtttttattcagactcattacgtgcatatattatactccgaggtaaataaaattctgtttcctccaaccttctatactccacacacactcatgctttgccattcactatactgtttcatactttggaacatattttcttttcactttgtaaacaaaaatataccccattaccttatacacatgagcttgcataaaacaaccccctagagacacatacattctttgaacatcatcttcaaagtggcaaaaccaaaatgctcattaacatgactctaagttacagtttctctgtaacatatagaaataataagacgtatatagacatttataggtataagcagacatacacacactaatggtaatcatcatgccaatattatctcttaatgagaagcaacccagatatcccaagattatccaccagttaacttcttgattttacattagctcacgatctgaaacgtaatagaaacatggaaattccatgtcaactgataccttataaagtgtaaaaactgtttatataaaaattttgccaaaattctaactcaacataattacatataattttaaatcttcattttaaacattatgtgtcaatgctatcttgtctcattggtaaaccagtataagaagttttaaggagttcagattaactagcctcttttcaggaaaccaaaaacaaatctgtaaaacaaaaaagtacatcagaactctataattcagagtgataatattaagggagagatatgtaatgctatttaagctaatttttaaaaaaatcaattaaatgtggtcaaatatgcactttggttacatgaacttgcatttttacatacaagcaatttctgtgaactttttcaagggtagcaatacaatgtatttaaacttcagtttctctgcaacatgagaatcctgagaatattgatataagtaatcaaatctataaataataaaaacagaaaatccttatttcacaaggttttattcatacacaatgaggtgaaaaggcttttttttttttttaatttccagagataggcagctattgagggttgcagttttggttctataaccttagccatgtcttgaaaggaaacatagaacacaataactcaggaggacagaaaggttggttgtcatttccagtgaacctgagacataatcttgctcagacaaaagaaaagtgctaagaaaccaggttttcagtcatctctcaccctgcaaagagttagattacctgcatctagctgatagatcaccatatgatgagaacgaagtgccaggttcacaattattcctgccaccaaaggaaaacttaacagccacatgcagatcagatacacaagacactagtatccccgtgactgtgttcatgagacttgcctagcagtcaaatacccactacttcatatactcagctatgacccaaacgaggagacacaaaatgctcttctcagtaggcagtgaaagtggcacagtggtctgagaccaaatacaggtgcctgcacccagttgtggaggagaaatgactgaagctgtgagttaggtaaggcacttctcgactgacggacttggccaaaactcagaatcaaaacacataatcacaagacaagacaagacaagacaagaaacaacagagacagagagtcagcagaagtaaagtttgttgctacttagggtttgctctaggactggagtgttgtgttttgggtttttttgttttttttgttttgttttgttttgttttgttttgtttttaaaaaaagatgtttctgagcttaaatggcccataacattggctctggcaggtgagtgtacttgggcaccatcgtaggaccatttccaattttaagccagttatatatgtgactctagcacaaacataagaaagcaagtattgaagatgtgtctaactgagggaaccagcaggatgataaagcttgctgtaaaaagacggagaggcacggtggttctagaggccaccagggaagtcaaagcatcaggataaatagctgatgcatgtggggcttaacacctagctgatgggtggatatgtgtggcaaaccaccacacgtttacctgtgtaaaaaaccggcatatcctgcgcatgcaccccagaacttaaaataaaataaaataaaataaaaagctggccaatgtccgataggtcaatacaattataatttttcaggttatcttttctattagatggaaatcatttacatctctgccacatacaaatcctataaattaacatgtaatttcacagaatctgcatcttaaacaacagtaaatttaaaaataaagagacacctctttagagaatcaaatcacccttggatgaggctattgtactatggccaccatgacaaagaaggtcacacaatcttttttttttttttttgcttcattttcaagtttttataagttttattaaaaaatagaatagtcacttaaaaacaatttttttcttcaccttgatctagcaaggaaagttaaccttgagtttgccatgagccttccatacacaatgttctcagaagaaaacatagtttccaatatataagtgaagaataagaagtctctctcaataggaaacaatttattcagtatggcaaaggacaatggctatgtcaaggaaaattctaggaagggaggatttacattcttttacatatttaaattccttttcaacagatgctggcgaggttgccgagaaaaagggatgctttcacactgttggtgggagtgtaaattagttcatccattgtggaaaacactatggcaattcctcaaagacctaaacacagaaataccttttgacccagcaatcccatcactgggcatatacccaaaggattataaatcattctattataaagatacatgcacacttatgttcattgcagcatgattcacaatagcaaagacatggaaccaacccaattgcccatcaatgatagactgaaaaaagaaaatgtggtatatatacaccatggaatactacgcagccataaaaaggaacaagatcatgtcctttgcagggacatggatggagttggaagctgttatcctcagcaaactcatgcaggaacagaaacccaaacaccgcatgtgctcacttataagtgggagttgaatgatgagaatacatggacacatggaggggaacaaaacacactagggcctgtcagagatgcggacaggggagggagagcatcaggaagaacagctaatggatgctgggcttaatacttaggcgatgggatgatctgtgaagcaaaacaccatggcacacgtttacctgtgtaacaaacctgcatatccgcacatgtacccctgatcttaacacaaaagttgaagaaaaaaaaattccctttcagaaaaaataaataagtaaaagaaatcattttaactaatgacattaagagttgattatcataagagcccagagttaggtgctagccccttacttccctaataataaaatatgtgcatttaatttggacaataaatatcttgagaaagaatatacaaataagatattcatgaaaccttttatttttcttcttttacctcttgattcctgtctcttgattatcagataatgtgtccaataagaggaatgaggaaaactcacaatatttgatttagttgctattaagcagtggtagacatgaagatctgatgcagggtagaaaataaagctctttcctaaaatagggacaatagtttaagtattgttttctgttttaagtatactataattgtcccctctgcaaatgcttctacataaggcaagcacatggtaattatggataatataattatatatcattatctaaattgtatatgcttcagccctgtcccagaaaaatggattcctcatggatcctatttatcacatccaggaattagtcattgcatattcaccctaatcaatagtgtattgatgattaataaatgcttatcaacaatgagtttgcagaaaaacaaagaacatatacagaaatgcagctaatctaggggatgagaggcaggaagacatgggtaattgtgccagtaagggaaatttgacgttgaaggtcaaagatatttcctttcagtgaagaaccacacagggagtctatgtagatatttgaggcagagaaggaagcattgttaaaacatgaaaagggaacttttttgccacttggatgagcaggagaaaaagcgagaagtgggaattactctgcagccgtgattggaacactaagttcaagaataaaatcaatgcaagagaatccaaacaaacggacacaatagtcacacttagggaatgaaattggatttctgatctgggttttaagaccccgctataagccatatgctcccctaagagataaatgctaccaattctgtacattttcagagacccctgtaaattctggacaatgtaccaaattgactcacaacatgaaccccataaaggaaaagttgcctctagaaaaaacctttctgaaaatcctatagaatttaatgaagataactacatcctttcaaacaggtcaggaggacagttggaacagtaccttgtttagaggcatgaagaaggggcctgaaaactgacttaattcaaacccctaacacagtggagatttccactcaaccaaagcattacacaaattgttctcagctctcagacagatattgtaagcctaacacagcagcttatttcatggctctcgtttaacccatcaatccacaaagccagcctttggcttgcaaaataagaaagaatgaccagagtacaaaaactagaattgaggtgtgacggggagaaaaaggagaatgcaatgccaagaggtgtacctaaatagacacaagaggacacctcctacttgtattcattgctgatagtttttgtcccattgcagagacatgattacctggatctcagccggtgtggcaataggtgttactactgaccataaagatatgccattcaattttaaagctagtgccagtgtttggtattatggtctcccttggcaataaactctagagactaggtactaggatctgaagaagtatttctttttatgtgttacagtacttgggcaacatctagtttgccatcgagacagcttagaggaaaaagttggagccttttcttgtccacatatcattccctaccattgatttaacttccagcactatcagtggtaaagtatccttttgtcataatatccactctatctgaatggtagccagaaaatatgctttggccaattatactggttccttacatttaagctgatttcttaacatactctttatgaaattctgtctatcctgctgtggaactattttcattaatatttaaaggtgtgccagttggtgggacagggaaatggaggaattgtgctatccctgtgttcatatttgggcatatgaatatgactgtatacattttgttctatgagaactacccactaaccaacacactgcttacaatattgaccttctccaagtcattctcctcaattataaaagagatatcaaatgatctccctataatgcacatctgaccatggcaacacatgtttaaaacacccccatgattccccaaaagtctactgagcaatgtctaagcaaactagcatgcttcataacgcctttataaacagactacttgccttcctaggctcatttcgcatcatttcttactttgcattagtgtctcatggcaaacttataatttattctttatttcatgtttttacccagcacatgaatctttgcttggtggacttatcctttgtgagctcaggcattcttgccttcaggaatcttttgctgactctttccctgcagttgggataagtgcttcttctccatacttctctcctcaatattctatgcaaatctttatcctcaaacctaaagtgctttatggaaatccgttaatgtgtttgttcctactaaactgtaaacttctaggggctgtattctcagcatacttccctgcacagagaagatattcaataaatggatattttccaaatgaattaatagtgaaaacataattgaaccaaattctgtagtcttttctccccagccagatagtaatatgttttacattgaaatttgagtataacaactgtgttttatgttttatatagcccagcttccagatcataggtgcttcatgaatcactttcattaaacccctctatggtatcttgcctatgattgtagaattccagagctaaagctcgttttatgcaaaatcttcacttactgtgcatttctctgtggcctaaaaaagggacaaaatgactcaaccaaggccgcaaaacttgatagtggcttaaagactaaatttggtttcttgactcccaatcaaagatatttcgctatttttagatggaattatgagttgagaaattatgggttaaaagagagaaacgagtgacagaagacagaaaagtaaaatacacaaattaataaaattttgttttggaacaaattagagcgagaaaaaaattaaagtgcctaagggctatgccattttgttaaatactaaagagaacacaatttagtaagataattaggtttgactgacaagcttccaatccaattgaggatataaggatttccaaactgaaagtgtaaaggtaagtggtaataagtacaaaatcacatgtgaaaacacaagcaatactggtcagaggggtgtataagctgggaggcctgtgcctcaaagaggagaatagtgactgtggaccaaaatagcacaataagccaatcttgaaggctggataggagatggagaggctgagtggaggctgcaggctgggatgaatagcacagaggctggagagcccaggcctgttccagctggggctgtgcataggggagcggtggtaggaaattctggagacgtagcttaggcaaaattttcaaagacctctgtattatccagaattctccagagaaacagaacaataggatatatatacaaagaggtttactatgagaaattggcacaccaacatggaggctgagaagtcccacattctaccatctgcaaactagagaccctggaaagctggctggtgtaagtctagtctgagtctaaaggcctgagaacgaagagcatcgatgatgtaatctcctgttctcaagaacaggtgaaggccgctgtttcagctgtcagtcaggcagagagtaaatgctctcttcctctgcctttttgttcttttcaggctctacatgaattgaatggtacccactcacgtggagagggctgtctgccttgctcagtccaccatttcaaatgctaatcttttttggaaacaccctcacagacacacccagaaataatgtttgactagatatttgggcatcgtgtggcctaggcaagttgacacacaaaattaaccatcacaacctccaacgtaaagtcaaggtttagactaatttgtaggtagaatgaatccattatgtactttatgtgctggtgaaaattgcataaatacgaaaatttacttggggaccgtgaatctggtcgtgatttgtaaaatgaaatacagcacagccaagtaaaggctaaacgtgagatagtaatagccaaactctagaattatgaaagtgggaaaagtgagagacagttataaaaacaataaatgttaaaaattaaaacgcctcaagttcagtagcttgcctgaagttacactgcagatattcagccctagaggtatggaaaattcactgcattgctctgcctcttggccaaatgggtaaatacattcaacatatatacgtggcgcaaataactgcaaatacagtgtaattcttcagaatcttcccattttatgcatgtctaatgaatttggtaaagtcaagagggagaaaaacagctaagtggatacaaagatctgagttttcctttatccctatttgtaagtgaaactcaaatcaacaaggttgccaaaaatcacctaatgattgaagctgaagactctcccaagggccaccgctttttatttaataaaaccaccagagatacccaatgtgagttctgtgaaaggcagactattgtgaattttttgttatttgaaatgatgttgatatgtagggtaggaagaagaccggcaccctcaaaagttacccatgtcctcatccctggaacctgtaaatgttaatttatatagcaaaaaggcctttgcataggtgattaaggatttttgagatggggaaattatccaggtgagttctatttagattgtatttacaatcacaagtgtctttataagacagaagcagaaggagtttttttgtttttgtttttgttttagacggagtcttgctctgtcgccaggctggagtgcaatggcataatctcggctcactgcaacctctgcctctggggttcaagcgattctcctgactcagcctcccgagtagctgggattacaagcatgcgccaccacgcctggctaatattttgtatttttagtagagatggggtttcaccgtgttagccaggatggtctcgatctccgcccacctcggcatcccgaagtgctgggattacaggcgcaagccactgcgcccgaccctttttgtttgtttgtttgtttgtttgtgacagagtcttgctctgttgcccaggctcctggagcgcagtggaaggatctcggctcaccacaacctccaccttgcagagggagcttttatgcagacagcaggggaggaggaaatgtgaccactgaggcagagattggagtgatgcaaccacaagagaaggagaaatgccagaagccaccagaagcagaaggaggcaaagaatagggtcttccctcgagcctccagagagagcacggtcccgctgacacattaattccacccagttaacactgattttggatttcaggcctccataaccttgagaaaataaatttctgttgttttgagcacccacgtttgtgattacttgctacagcagccacgggaaattataatgcccaaatggtgcaaacacgctaagtcataaacagcctaaaaactgcaatacatcattggactatattagtctatattcttttcacagagaaagaaaaagcagggactcacttccactcagccatatctcaaagggaatttggattgaccttggaaaacagaatattgtgatttctcagattttgtgtattccgtgtgcagactgttttacggcaattctttccatactgtccatttaggtagccacgatgacaggtttgactgggttaggatgttagaattgacagaataaatgagtgctaataaaaagacgatgtgttctgctatcttgtcgctgaaccaatgcaatggtttataacagcatgatgaaaacaaataattggatactgtgatgaatttgaggtattataattttgatggtctcaggaattatgataaatgtttaacaataacagccacatttcttcttgtccacaggcccggtgggatggcttgactgggcatatcacctttaataaaaccaatggcttgaggaaggattttgatctggacattattagtctcaaagaggaaggaactgaaaaggtaacctccttaacaataaataaataaaataacaaatgaacattgttcaggcatttttactaaattgcaaagacaagtaggtgaatgatgaagtgattctctaagcatgttcttttacatccagttttttatctctctttcttttttctgcagatagaagttgatgtgctagattcttaaatttcatgtcttagtaatagcagtactaactagtgtttctattgtgcttcatttacatagcaagtgtgattatattattacatatataaccctagagttgggtgtcattaggcccatgtcttaaagcttttaacaaattgagtttagacttggaaaagcagaagctatcaatggtttatcgatggaatggcatccaagggttacccagaaattaattttaattgcacattttattccattttgagattggtgacagacagaataaagtaggatagaagagacttactggagcaaattaactttgcattcttaattttaggacaaatgccaaaaaactgtattttaatgttgggttctcattttaggattattttagttgtaattctgaatctctccatgtttaaagttctactttagttattatttagagtaattccaatgtaaactatttggttaaataataatgataaaagaatttggctcctcaatatattttactatgccaattttaatattcatgactatacgtcagaattaacacttacagtttgaagattttgcactgacaatcttatagaaaaacaattgaaacccccaaagcaatcacctcaacagaaaactctataatctgacattttttttcccactatagtgaataagacagtgtgcttaatgtaagagtggctttgggaacaatcgattgcttgattaattagattagttgggttgattttttaaaatgaggtaaggttttcatttccgttttcttgcttttgttaaccaggacacattttttttgcaggtgctaactacccctccccctcaaaaaaacattaatggaaacaaagatcatttaggctgaatgtattagaaggtgaccaccagtgtgaaatatttgaggaaaataatttgtttgcagttttgagagtacacattatacatgcaggttactcacttcaaaaatgtctctcccatcttctggcttcctcttcactctgatttgcccctctgttggtctgacatgccctgatagagcacagggcatccagccagtctccacgatggtgcatgggatgttggctggagggaacaaaagaaaaaaaatacttgttatgatctaaaagcctataatttttttaagaaaatgtctgcttctcgaagcatgagtctttccccaactctgttctcctcttatgtatagcactgaagggggaagaaaagctgttaaggaaacatctttttggctaggtgaatgatgaaatagatggagctattgttatgctttcacagctatctatacaccgtaatattatgcacattgcattggtgtttttccatcaaaggcaaaatcaaattagatgaaagtgttttgtgttggtttcttatctcttcattgtttgcaataacttttctttcttcaggtgtcttgggctcaattcctgagaaggctgattgggccttaaggcaatgagggaagccaacacatctctctcaggagccgagggaggaaatgcccaatctttttatgtcagcctctcttggagtcaatagggaaaattattagaaaaatcccattctcactttcactcaaatttctactgcccagaaacccataatcaaagaacaagtcatcaagcatacttcttctttatatgtgtgtgtctgtgtgtgtgtgtgtttgtgtgtgtgtgtgtgtattgattgatttgctggttggttggttaattgattgattttagttaccaatgccttaaaagggtcttcttaaggaacaatgaagacccttaatactgcagcatacctgtatacattgaaaagcactttaaggcatttcttggtgtgtgaaaggaaaagtaaaaattgagtcttaccaccaggtaacttctgtgagacccaagtcttgattcgtctctttgctgtacctattgtcaggctttatattgaattaagatgcaaattccaaacaatgggtgggaactgtaacactctaagcactcacacaccatgattccttctgggtttcacgctccattttaattaagtgctgtttttattttatttttctctctgaaaaccaaggctgctggcgaagtgtctaaacacttgtataaagtgtggaagaaggtttgtactctgacaacaactgcaggaaacctgggggtgggatggggaatgtcattggaaaggcctgtgcccttccaatgttaccagacctgtagctctccaattgcagtttagaagggaagttccatgtaaagagagaggagtgattgaatatgttatctctctcaacaacatcacctgtgaattgaaaacaggtttgcagtggattaaataattatggattaaatatttcccccaagattatttttgtttctcccaggcaggatcagtccttgttaggattgaaagcaggcaactgtaacagaaggagacactgacctatttatattccttctcaaatcactaaatattttccttaagggggataaaaatcacaatagatttgatccatgagactagtcagataggctacagcctcagaaggctaggacacctcctgtaatgtcaccaccacaaaatatgaaccattttcagaaatttccttttctcatgagctatcttttgttttgtgtgatatcttcatcagagtatactgtcttgcaatttgttttagagccacagttctaaagaggacacaaacgttagggaccttggaaaggaaatgagattatcttgtgaattataacacccactattttatagtttattatacagtgccatgttgccaatgaatgtgcatagatttatgtaagcaaatatgagacattaaaaacatttggatcagagaaatgtccccgtggtaagcaaacattttctttcatctcttctctctctttctcttcctcctctccttccttccctctctgtctctctctctctaaaactacttggtaaaaaaaatctatggactgatgaatggaccttaaattgcttcaggttgttcaacttgaacagttttgtcaggttcactttcatctttcaaattatcagctatgtcacagaaagtgtacacaagtttctccctgtagccaaaaaccttgtccccctcttagtagtactcagtgatgaattcaaaaattttttctttttaagttttcaaagcataggtttaaaagccttgttttaatcttcagtgaacaaggctactaagtgcatgtagaaggcgatctggtttcctcactaaaattttactggtaaatagatgaacctaaccggcacccagaaaaagaaaaaaaaaaaaaaaaacctattacactaatccatcttgagactctgggcactttgaattaatctaatacaaatgtcccagggaatggaatccaagctttgaaattatataaaggggaggggggatgtcctctatttgtcactaaactgcaagagccacacacactcccgagggttgtaactttctgatcttgatcctccatgccttcatgcctcttccctcctggtagcccatcatgttccacattgtaagttgtatatactgtggtgtgctgttttgtgttataactccgtcaaaaattcacggtaacctgagttctagcacaggcgacccactcagacccaacaaacacattgcactttttccagaagtctccaacttaaacaaaaattcaccttcatcatattgaaatcccaaaagctttcctcgtactctgacttattttagaatagtattattcacccaaaattctttccaaaagaggaaggtagcaatctttacaacatccctcactaaaatatttgttatataaggttcgtaatacaggaaacacatatacctttatctttgccctagatacctgattatttccctcagccactttagatgttgagtttacatgaatcactgtctaggtttagaagatagatactagtggctctctgaataccctttttattgcatcgctttttaaaaaaagtttgcttaatgtcatttgggcactcattttcaaatgcttttctcagttgtcctagataacacatggctgctcccttgtgccagcttacaaagtgaaagaaatcagggccaggtaatttagatattgagtgctcctccccacaagtaactgatccaccctccactacttctcactggtaaatgactactgtctgctttcactgtgaagcttgaaaactgaggttccgctccctggaggcactcctcctagttcgtagaacagtactgaaatgtcaaatgtccaggcatcttcttaactgtacctctgtctccagcacacatgaatcatgagatctgacttctttaaagggagacattcatttcctgagaacatattcatttacttcaagtaacagataaagccacatgactacttgggtttaaaagacacaggtacacacatgcgtgcacatacacacacacacacacacacatacacagttctgttttgctgattacaggtttggaaacagaagactgaggtcactcagcatatatatactgtacatttcccaggaatagcctgacctttactatattttgatactcttctagtctacatttaaaggaccttctgtaggtccctctgtagagacaataggggaaaaaatggtcacccttttctcattttaagaaggaaagtttaaactgaataggacttgggacttagttgattggattggcagcagcaatgatctcttagcttctgcacttttagtgcagatagcaaaggaaagaaaaaccagacatcaagctgtggggtgtatttgtctacaagttcaagttttattttacaagagagtgatattgctaggctattgaacactgtcagtttcaaatattacggtagttcctccaacactcacatacttgacattaatagaaataagatttaaagagaccacatcctatcacttaatcaagtggctaaaaacagttattttctccacccttcaatacttacttaattaaaaattagattcccttctcctcagtgtctaagtgaaggtttaattagaagtacagtcagggcccaatttacacacactcttcatggagctaggagtcaattgttcacaacctaaagcacagccttggatgaaaatcaatagacaggtatatttagccagagttacatttcctagaagcaagggtccctgcctcagaagaagggatggagattgagaagaaaaagaagaaaatgctgtccacttttcctgagtctaaagccagattaagaaacctaaagattcttcaaccattagacgtataatgtgcattctaggtgatatttatcacactagatcctggaaacgttggatggttattaagagtacagcttacaacccaatagacacttcttttcaggcaggaccacaatattttcaaatgcaaaaactatcccattcccccatttacctatacctgtctctttatttctccagtcaactaaccctcattaagtataggaaataaaactgaaattaaaatagttcacactgatgtgtgaacgtgtaatagtccttgaaactttttcaaagcattgatgtctctaaaagggatatttgtcaagctaaatgaatttccagctgctaaatataggcaataaatcagagtcaagaaatagaaaagcaaaggaggatggagcctaacactcctgtctgtcttcccattagaggaacatatttagggaccaagcatagctccaccctgtccatctcagagcgggtccaagtgttcatgttcctaaactgccacttgtcatagctcttttaccttatcagaatctgaatttttaaaaaaatgagtccagattccttcatgacagggtaaggttgaagaaatgactgaggcagccatttcaatgtcctttcttgttactatgtgtgcaggtcttaacaacatgcaccaacacttccacatacatcatctgattatttgatcttctcattattcctgtgaaatactttataggtaaagaatcaactgaagctcagaaagtttagaatctcattcaaggacacacagcaacaaggtcttcctggctctaaaacatacttgcaagccaccatgtgaggctggcagtaaatgcctacagaaagataggcatttacaaaatagctcaaaatccccaaggctcctcttctgggttcccacagaggctgaatgaatcaatacacttctacaccacctcacaacccaggagtgacttggccactggagaaaattgtggatcattatttttaaaaagagtaatgggctttactgaatgccagttgccatggttggttttgtgacagtaaaatcagtgaccagtaaaagtgagcatcctcactgaaggagttcacgatcaagtggacagacaagacaggtaaacagataaataataacagaagacgctagctgctgtgacagagatatgaacagagtcctgctagggctcacaagcactctttgcccagctttggctcctcaaagaagataggccctgaatttagtctacttctcatgcacatgacatgttttctttcatttatctttctctttttaaagaaaaaattactttattttttcagtgtctcgctctgtcacccaggctgaagtgcagtggtgcaatcacggctcactgcaatcttgacttcctgaacccaagccatcctcccatctcaacctcctgagtagctgagactgcaggcgtgcaccatcatgcctggctaattttttttaattttttgtatagatcgggtctcactctgttgcccaggctggccttgaacacctggtctcaagagatcctcccaccttggccttccaaagcactgggattacaggcatgagtctcggcaccccactatctttcccttttagatgctgggtctctccaccattcaccctgccccttcaccccattattcataaattttaaataaactagtgatactactttggcagcctaaggtttctatcagtagaatgtaagctccacaagggaagaaactcttgtatattttattcattgttatgtcctcagatgcctagagcagtgcctggcacataaatagatgctcagcaaatatatatataggaagaaaaatctgatattcatttaagaattcttatatattttttcatttataaaagaaaatgagtttactaaatgaaaaagaaaaagacctccacctaccctgcccccaatagcacagatatatcctattttgtctacacattcattcctctgttgtttcatttccccacgtttagtagcttccactgtgatgccccagtgtcccaaactgtgagcttttgtgcccattcctggtagagaaggggcctctctttggtgtaaatgccacactgacagccagcagcctctgatgtactgtgttctgtgtagattgggatttggaattccaacagtgggcttaacatgacggacagcaacaaagacaagtccagcaatatcactgattcattggccaacagaacactcattgtcaccaccattctggtaagttgacttcatggaattgagggtgtcttatccaggctcctgccttagacttcgaagcattcctcaactgtctttttcatgccaacgcttctgtctgcaaatgtctatttttaactaggacactaaaagcctgtgtttgtacatacttacaggaagattgaattagacgcttccaacgttgttctgaagatctcccacctctaatccattgccagtcctgctcagccccactctctgtcccctcccagctggtctcccttgctctctggctgctagttggtttcaaccatgtggagaccctagcaagagactagggaagtgggggaagaggtgggggaagagaggcaagagaagctcttctgttccctcccaactgctactagtagttttttcagaacctctgactttctacaaccatagcttctgcccatcagtggcactgtttttagggtccagctgcactgagcttcaggagtattctttcctccctcctgcctcagccctgggtggtgcaggtttcctgaagaggctgttgcctgtgtgtctatgacttgccaccaaatcagacccccacctcccttggctccctttgctctgctcacacttctgtacacagctcctttactaactgttcttgaaagtcctgcctcctattagtgccctggtcatgccccatccagccactgtacagctaccggttgcttattttccgctttttcctttctccagggagttgggcaggagtagccttccctgaaatccttgcttgcagacatcctgccttacaccagtccataatgtcaaatcaatttattgttgatattattaacttgtgagaattgttcatccaaaggaaaaactggtttgctcttctggttactactttctctatgactgtcttatgaaaacacagggttctctactgtgtttgaatgaccccattatcagtttgaggataaacctaaatataaagaatatgtctgtagtatagcaactattatattttataaaaccaaatgaggattcatttagtcaaatgagaattaacaaggttatagatgcatggtagtagggaagtgtccattatttataggagaggggactgatgatgcacgtatataagcagagaatgaccagatgtgagatttgaggtgatttcaaaaaagaaaatgggaaagatgataaaagaagaaatagaaatggcctttggaataggctaccctgaaggaaaccaatcaaaatatataaatcataagtgaatagtgaaattcagatgaaatttagataaagaaatgagaatagtcatagataggaaatgcaaagaatgaaaggaaatagttggtgatgtagatttctctgtcatgaggttcttagataaaagccaggtccgggcttggtggctcacaccggtagtcccagcactttgtgaggtgtgagggtggatcacgaggtcaggagatcgagaccatcctggaccaacatggtgaaaccccgtctctactaaaaaaaaatacaaaaaaatagtcaggcgtggtggcaggcgcctgtagtcccagctgctcaagaagctgagaaaggagaaaggcttgaacccgggaggtggagcttgcagtgagctgagatctccccactgcactccaggctgggtgacagagtgagattccgtcagaaaaaaaaaaaaaaagccagaagggtcatacaaaaaaaagcttaggtattggcacagcaggtggccaggcatgtgggcccccatttccctttgcgccttccttcttctcagacccaacatttaacagtgactgtgtatccatcacaccattcccgcacagccccaccctccacagcggaaggaaaagctcccatcgaaagacgcagaagggaaagaaacaataatataggaagtgttttgtatttatagaggacataggcaggcagatgagtgaatgacttcagtactctcagctcttcaaaatcattatcaaacatttcacatcttcaagctgctgatagggtaaactcttcctttcattataacagggttttcatatttggtttgtttcatttaggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacgtaagtaacaatatttctaacatatctgaaaatatgcataagagaaagtaagagaggaaaaaatgatgtcagaagaaatgtttcctttttttgaatcgtaacaatttttttaagaagcaaagtaaaacagcctggaaatggagtttgcttacttagaagggcaagtaaagataaaaattaatgataaaaatatatggtgcattagtttgtttttacactgctataaagaacttcctgagactgggaaatttataaaggagagatttaattgacacagttcctcatggctggagaggcctcaggaaacttacaatcatggcagaagacacttcatcacagggtggcaggtgagagaatgcgtgaaagcaggggagatgctagacacttataaaatcatcagctctcatgagactcactcataatcaccagatcccaataccccatgatccagttacttccacctggtcccacccttgacacatggggattattacaattcaaggtgagatttaggtggggacacagaaccaaaccatattatatggatccttctttcatactgaacataaacttgagtgattcttaaattaagaattttacactttgggagtctgaggcaggcggatcacaaggtcaggagatcgagaccatcctggttaacacagtgaaaccccgcctctactaaaaatacaaaaaattagccaggcgtggtggtgggcgcctgtagtcccagctactcggtaggctgaggcaggagaatggcatgaacctgggaggtggatcttgcagtgagccgagattgcaccactgcactctagcctgggcgacagagtgagactccgcctcacaaaaaaaaaaaaaaaaaaaaaaaaaagaattttaaagttttcagctcagagcaaaatctcatcatgtcaattaatagtacaaccaagttgctcattccttctttttctcacatgccctttttaaaggcatcttcctgcatttttgtctttagttccagaatgatggatatatatttgtgtatgtatatgtgtgttttatactttctggtttctctttgctgatactgtttcataaacataactgtataaattggcttttttttattagaaccaaccatcacaggagcttcatgaatgagaagcatttagagttgagaataagaatcaggagtacccaggaaaagtctagacatttgcaaagaaactagactaagctgacaattttggacttgcttttgcagagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtaagtttgagaatcactgaattcacaagaggtgtaggtcagtctcagatttctgtatgtcccagaggcagacaaaaattaggaactttaaagtgtacttttagttttgcctagtgttctattcttggaaggtttccatataaaagccgttctgtaaatgaatgttttctaattatttataaagttacttttaaaagagaggaagataatttttaatattagtttaactttatccctatttcaagcaacataaaatggttatttagccattttccttgatttataacaaaagtaatggctcaaatgatgtgtaaaatgtttccataggaattgtaaaatggtctcaagatatttgacccctagaatatttggataagcaaaacataaaaaagtcagcaaagaattatcatagcaaataaaaaacagtggagtaaaaagattgtgaaacccttaggaatgaagaaaaatactttaaaagttctattaaatttatttttaaaggcatgagaaagttaaagagaattctagaaataatgctgaaaggaaagattgcttacatacagagcctggaggcatgaaacctttgtgctatcattaagatgattcaattgaggttttacttttcgagatttaactctgtatttaaccattttgctctacacagttccttaaaggatttttatacctttcaatagatcatatattctgaatacttttgatgctaaatttgaaacagttattttatctttctgttggcttaaacatttgctgtccctagataaaccatgtaaaaaataattgcttttgtatgtccctacttgttttcaatctttttcacctttcaacaaaactcagtgaactttttccctaatcaatttttgttttccctccaggaatttctaagagaaatatttcttcatgctagctctttgtcattgtccactgtctggttttgattaatgccaggtaactctttccctggtgtaattataaagaaagcttgggaaaataacacaggctggaaaggttttaaagatccacaaggcagacatactcaaactgaatcaacatgtgctctcacatgtgggtatttatacattcaatatgaaatgaatgttttgatgttctctaggccttataaactgtacccttaccaaagctcagattttatacttttactgaccaaagctctctttaaatatgccttacttcagaaaataaaatattgacagtatgtatatagtgatattatcctttgtattttaatactctaaatcagtggttctcaaccaggagggattttgtcccccagggaacatttggaaatgtctacaaacatttttttagttgtcatggccggtagtagggagtgctattggtatcaagtggacggagtccagggatgctgccaaacatcttatggtgtacaggacaggtaccccccaaaagaattattcactccaaaatgtcaatagcaccaaggttgagaaaccatgctcgaaacaattaaagaagatattgctttgggtataaaatttttaaaaataaattgtttacctttggaggtatttttcattagtgactcctcagtgaagttaatattgcctcggaatggtcatttaataaatgactatcctaaggtgaagcaccttctaataagtaatcttgtgtttacttgttgcatacctctgcccggaggcccacacctgttgggtgatactaggactgatggagcaattcatgcagcccagggcaacagtagtttccatatttcgcagggcaaaagtgagtttccatattttgcagtctgaggctctgtctaggcagtgatgttgatgagtagaacaggcaaggtgaggttgatgagcaaatacattgtttattacatgacttgaccaaagccagtaggagaagaaacgccagcagcatccaaaagttctcacaagcacacaggctgaaagtaccctttacacttaactccaactgtgcgcttaaatctccttatgtatgtcatcagagtatgtcagaatggcacgccattcaatagttttcccctctttgtctattcttccataagctcttggtgacccagacctccatatttttggacttcattcagtttatttctattaagataacagtacccccactaccaccatcaatgcaatccattcagtagttctactcaccgagagtatcatttataagccagtcctcccttatttagcttattcttcttgtctcctcttccactgccttcttgcccttgtcttggttcacacgtggaggtgttatacatccagtgcaaacttggaaacagtatagtgacgaaatacagaaaataactccctccagggcacaagtgtactgtcatgaagattctactttcaactacatttaccttctctacaccttagaatccatccctgcttctgcttcataaagccactaaatatatatttagacttgattcccaaaaacaaaattctggttgagtagatgtaccaagtcacctttacttcctaccatcatagtttgagaccatgaactccgtcactctgtaccctcagttaccaccttagtggtttgcattccaagttagggaagtggacatgaaaaacagtaaatttcataattatctatagctctagagagactttggaatttatgttgtgaattgtattctcttatgttcttttaaaggggaaaaataaagccccatcactgcatttaagcaaatgccttcactagatagatgcctaaaaattatttgttgaactgaattaaatttataaagatgtagacatcggtgggacaaactaaggaaaacaatatttaattactatgacttttaattaagtgtgtatgtcagggtttttgttttgtggttgacaatgtttccactttttgaaaaatatttaacttcaataaattatgtccatcataaacaatttaaatagatcaaatatccagatagaatgtctgcttacattttatcatttatgttcgtcttcttaaaaatggacatttttaaagttggcatttggcaaaaaaaaatctagaaaacccttgaaagtaaattctatggttacaatacaaaccccaccattatattacaagttcaatagagcattctcccttgaaagatgaatggatttttctctcctcaatgcagcctactgtgcattctcagccacaaaaattagtcccttaattagaaaacttcagtgtgagcttgttttatatcttcaagtgtaagccaggcagaaacaaacataaacccaaagtgaactttcacatttcaacataaggctactcttctatatgcaagttttgtcacaggttttaagcatgtttcttcccttctctatcatattagtaaagatgagtattgatttcttgagagtcatttggggatagcagtttcggattatctttggtgtaggtcatatattaatcttttcaccagacttcctaatactgacactgctgtcacactggctatctttaagcaggtgttaggaattctaagctgaaatgtctacatccaggcaacaggtaggtctattgccttataaaaagccagtgtcttacagcacagcatcatgtcactgtttaatattcaccagaccacatgctccacaaatcactcagaatcccagagagaaagacctaaaatatctctgcagagcaggcagaatcacattgctgtttagacagtttttctttttgccacacaaaaattagattaattgctctcttataagtgcaaagtatgaaacaagaccaagttaaaagcagcattccaaagagggaagtgatgagctcatcgatgggagcatatctgggagagaaatgtcagaatattgaagggggctggtggttgccaagtcttacggtctgtttgaaaaaataaaaccccttctcttgaatacattaggctcttaatttatttcaattaatatttttaaattattgtacaagtgacaatgatagtgtttaagtaacgggatctttactctgcatgctgtttccattaataggttcattaatattggtattcatttcttcagctcagcaaactactatggctataagagtgtgcaaattcaaaacttaattatattgttgaaacattaattaaaatgtgttggcatggcattgtcaattaaagctatattcatcagcttcataggaacctgcatggtgtaccctgcagctgtggagaagctgcagtaatgagtcggattccattatgctggcataaactacgagactgttatcccagtccccctaagactcaatgaggaggcactgaacactttccggaaggtgtctggaggtttagaaaatggtttttcatgaggaggaattgtctgctcatttccttgtgctggattcacagcatgccctgcttttcatatagataatgtattcacctcaagcccggttctccccagtgtgtcagcaacccgccattgtttactgctgaaactgtatggctggagagcattctctgtgttctcatgggctttatggtgtttttaacattactctaacactcctgcttgcattgaaaagacccaatggcaaatggctaatcttccagtgctaaaaattactgcattttaaattatttgcagatcacttcgttgagcttctgctaatgtctttttggaaaaataagtaccacttggcaagatagtcctcaaaagtaaccacagagcagagacctcctttgggctacataggtcagacagatgcttaaaaaaatagagaaagaacaaaaaatatatttggttccacagatttttattttaagtacaccctcagagatatctggattccctcctcttcacaaataaggaaattgaggcaatagaggttgagtgaatttttcaaagtcgacttcccacactactatactagttgtttttccagaaacgtttactgcccatagcgcaccaccttgcaggtagacctataataatgctatagaaaacataccacttaccgaaccagggttgctgattaagtgaccacaggccatggttctgaaaacaaatttaaaacaaatcaaaaggaaattatgaatttgaaattctgcagtgaggcatgctatgtagttaatactaatgtgtaccactaggcctggaccagtataattccaaatgtatgccttgtctcttcctttaggatcatgatttttccccgtggactattcgaaaaacatctaatacactccaaattcagctctacattttgttcactaatttgttcagccttgcaatccctttcatgcattacaaaatcgctagaccaccacttagactccttctaaccatctgtccatacaaaccccttgaaggcaagtcacccctcttttttgtgtctcccacaggacctaacgacacaatatcttgacattgtagttactatgcaacaagtgtgtgtcacattcgtcgctacttggtggggtaaatacttgggatgagtgaacctttctttacagttcatctagttgttcagtaatatggaaatgaatgaaaactcagaagaattcagtagacatagagctgaggagtacaattccagctgaccaatttgcctataaataagaagtctggtaaatattaacgtctcaaggctctttgcactttgcccaccaaagctgtaagtttatgactatggcctttactcttttggtttgaagcttttgtgattaattgttgggttttctgcattgctcagcaggttttggttttgctggtgtcctgtgtgtttctctgatatttacagactgtttctgttaactaccacaggtttacaccctacgagtggtataacccccacccatgcaaccctgactcagacgtggtggaaaacaattttactttactaaatagtttctggtttggagttggagctctcatgcagcaaggtacaccggttgcctatctttgtcacacgcatcccacagtgtgctgacaggctttcatgctggtaaactccaccatgaagctagagggtaggatgaaacaccatctcaggaacttaagaaaatagcaacggactttctagccggttttgaagatgaagcaaaaccaatgacctatatggaactcccttgctatatatctaaaatagcacttctatcaagcaataaatacaaattttcctgtgggtagcaaaagataaggtaccttagaaatcgtttacaaatttgcatagatggagatgttggtcttctccttctcagccataactccacgagtcagcagtttaaaggagcgggatctaaatcctttggagattaaattcactgagattcttccaattgccaaccttacctaggacttccacctaattactactctggcaaaccctactgagattcatttcagcctcccagtaacttttcacaatctccctcaattggtaaccatagcaacaataaactgtaggagttggggaaataaaatttggccatagaaatgtaatatattttatacatttcctatgaattcggggattctgcttttgtagtgggggaagggggagctattttaacctttggaagaactccatttcttttgtgattttttttttcagcttcaatgtcaggcatatggtatagaaaatttttccaggattaaatgcactaatataagaaaatcataagtcacagaaactgttgtgttcggaatatatgttcatttgacaataagctgcaaaatacattggcaaaggaaaattccactgggatatacattaaacatgtttgctacttgggggtgaaccctaaggtttctcattagggaattgctataacacttgaaatatttatcttttggatcttcaaattagagagagagagactgtggaaataccaaattataatactgaaatagtaaatagttgaagaaagtgggaaaatcctagttacgcaattaagtatggtttgtgtgggcactgctaaataagtatagatgccatctgatttactagaagtaatttgcataaatttagagcatagcacagaggtataaatcctgcaggaaaccccatatactactttacccatgtatttaatttttaggatatttatcttgtgagcaattactttcagagtgaaggagacccctgctccttccctatagcttgtcttctctgacattagaaaatatatacatatatatatatatgtatgtgtatatatatatgtatatatatgtgtgtatatgtgtatatatgtatatatacacacatatatatacacacacatatacatatatatacacatatatatatacatatatacatatatacacatatatacatatatacacatatatatacatatatatacatatatatacacacatatatatatatatatacacacacacatatatatacttttaggtttcacagagcatgcatgcagctggcctgtgcaggtatatgactgtgactgccttctgtcattgagtgcacccacccccggaatttatctttcatcttttacctgtttggagtttaccatcatccacagcacactgtgggatgcagtgtctgttagttaccactaccttgggtacatgacagtcagccccaaccagactctgcttgtcattcaagaagtttacaaacatttgtcaggtgcaacaaatctttccagatacaaacttgaggtacttgtgactgttagtgcatctgtctctagcacgtggcgttgaaccaggtagttatcctctgttgctctctcttgttagcagaagcttgtcactgtactcaattggaaaacattttgttgaattttttttaaatgtgatgatcagactttctcttttctacagagcgtgagcaaagtctggatcaggattggctgtcatgtctgccgtaaaaggcactaaagagacttcagcaagtattgtctctcatcccaaatattttctagtaatgttttactcaacttttaatgtttgtataatttcatcctctagagtactaaacttacacaaatcatctctacttgaaagaagccatttctaaataattctaactaacatggagaattacaaaattcacaaaaattagataaaaatagaaaacatgaagaaacattgagaagtctaattgatgccatctaacaagggtttaaaatgtaatctcaatacgtttctattaacatttttattaagtttctaaggtaactttatccaaaagtttaaatatgcattctaaagtgtgaaagatgtgaattagtattattacatgtcaacagcctgttgttcacctgtctgtccactcttaatgccatataatacataattatacaaatatacaaataagtgaaaaccttatgttttcatatgcaaccaaataatgaaagaataaatttacagcagaaaatctgcacccataagctaagaaaaatatatctattaattgttatttatttcctatggctattttatgaaataaatggtattttaatgataaccaactaaagagctaaaataatattacattgccacaagactgctagatcaattaagtacaaagatatgaaacaaccttgggcattaaacacacacacacccacaggcatataaatcccattaaaccacaatattaaaacaacagcagcaaaccattccactaaatccttggaggcaatttaatggaaaactattataagtctgtgtaatattacccactcaaattcaaacaaacgacagaaggaaacacaaatcgctgtcaaaccatttccctcattaaaagggaataaaacacaaagatacgtaatagcattaggagaatatatccgttaattcaaagcccagaaactctggcgaccttgatctgattatcactggccttgagctggctgtgatttcctgagccgtatttgcatctgtttatagattaaaccttagcacaaattcatttattggtagactggtgaactccaattttcctttccatcttaagccattattaacgacagagcttcaacacaccctatcagtatagtaaagggatcctatagaccagacagctgacctactgtacttcactcttcgggatttttaatttagggtgtttttctttcactttttatctggtcagataaactctgtcatgccttcaggttcatggaggatatgctaagtacagaaccaatggcaaatttcaggcagatgaacaagccaaaatccacttgtgaatcagtacaactggagtgaactctaattgtacttctcatttattctaattctgctgctgagtttgagcaaaattgaactagaccgttttcaagatgtttgtcttttatgacagtaaacttagctcataaaccctttcttttagagaggaaggtttccttggaaaacacattaagtgcctctattttatcatttaaacataatttcaaatcatctgaatgacatctaaaatgtatattcttaccaggaaagtcttctttcacctaaggaacagcctgtctttgaagtgtagttaagaaacagcattttattgaagtacaaaattatgcgttgcagagaatgtgtttttttagccaaataaaaatctacagtagaaaaaagaattgtagcttttaaggtaacataagacaataaaaactaattcatccactgtcaagtatggctgcatcttattttatttgtaaaatcccaatgttttattaaagtatatgtgataaatggcatgttaatattttacaagtagctctcattctttaaccttaaataaaaatgttagcatttcaaatattttcatagttatacaaagacgcagaatattttacttcacactataagatgcatttagacagtaataaaaggcaaaaagtcttggggttgacttttcaattctaagcaactaaactaactaaattttagacatggaatgcctccaggttaaaactgttttaataccatcagctactgataaattatagttaaagcaatagtagtgattaatgatttgaaaataatccttaagattttgctccattttctataaaatgcatttatttcatctacctacaagacggtaagtcttttacaggttgatcttcctagaatagtgtcgaactgtacatcttccctttccttctgactgtgtttaacacccttactctgatgataccatcacaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaaggtaagaagctgacaaagtgttctcagtgattatctgatacttgtggtagagtataaaagaatctgtcgaaaaaaaaaagaaaaagaaaaaagaaaaaaagatgttgggtaatttttttaatgaaataaaatttataattacataatcccattataaggaatccttgaagccccagtcagcataaagcagtttctttggtccccaactaggtgtcatttactccaccccaatttagtgtactcagatccatagatcaatatcttcaatatcctctcttgcctttacaccagaaaaaaaaaatctgaatacaatctaaccactcattaattaatcactcatttatagaacccataaaataaaggttccttaatcaagaattctggtaaccagaatacttgaatatcattattttgttctttcggtcctgtacttgatgagatagaaacagatgacaagaaaacgtgttgatattggaatttagttagagaattaagaacaaaaaaatcccaggagactctggtctaatactgagtccgcattgatgaaggacagtgttcccagccatgcctgaagcttttcaaaatgtcttcggaggcaccgcaggagaattaagttggatgagtttagttttagtgtcaagggcatttcattgttgaggtctttttaattacttacccatagtaatgaaactgatttctgcctcgcttttggaggaagccttagtacttttattatcaaatctcaaatactctaattccagtgaaaaatagattttaatagatccaataggtgtaaagatcatgaagttcaactcttcactctacttatgaaaagaacaaaaccttcagaagctaaattacctgctccaagtcaaatacctagtctataacagagaaggggctaaagttttttttgggaaaaaaaaaagtattaatggtggtaaatgtgcatgtgaataaaaggaaaacaacagttgtaaacaaaataatctctaaaaacacccttgtcaaagattcatattcagattaccaaaaatggagttgtcacctcagcattgagtggactgtttggggttttttgtttgtttgtttcttttggggggcagctgtttttttgttttgttttttgttttgagatggagtctcgctctgtcgcccaggctggagtccagtggcgcgatcttggctcgctgcaacctccaccctccgggttcaaatgattctcctgcctcagcctcccaagtagctgggacgacaggtgcctgccaccacacctggctaatttttgtatttttagtagagacagggtttcaccatattggccaggctggtcttgaactcctgaccttgtgatctgcctgcctcagcctcccaaagtcctggaattgcaagcgtgagccactacgctcagccaggggtatttttttttaaataatcttttcctttctattatttccattgagttcaaaatgaactctttttcttctttcattcttatttcctttttaaacattgtttatagatttaggaggtataagttgcattttgttagatggatatagggcttttagggtttccatcacccaaataacatacgttgtaccaattaagtaatttctcatctgtcagccctgccaccctcccacccttctgagtctccaatgtctattattttttgagtggactgtttgacttgtgaaaaataccagcttagaaacaaaaactaaggttaggaaaaaaaagtacacatttctttgtataacactattggttcacaaaaataggaattaactatacaataagttataatgtttaataacaataataaataaaaaggtattgttttaaaagttaactatatctagagttttatcaagaagcaaagtaatggaaaaagtaggacttacttttcttctgtgttaaaaaagatttttaaacactttttattttaagaagtgtatcatttatttaggccgggcgcggtggctcacgcttgtaatcccagcactttgggaggccgaggcgggcggatcacgaggtcaggagatcgagaccatcctggctaacacggtgaaaccccgtctctactaaaaaaaaaaatacaaaaatattagccgggcgtgatggcgggcgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaaaaaaaaaaaagaagtgtatcatttatttaatgtatgtgtaaagcatggtgattgtttcttctttggacagtgatgttctaaagacaaatgacattacggctttgcaagctgcagaaagtattttcctaaaatcaatagtgtgaagagacacaagataccccaagctagtgattcatcatggtccttgtcagaaacaaggaaggtcacttgcaaggctcacaggacagaggggcactggcaagatagaatttggtatatctgaaaaaatatctgaaatgatttatctcattcagcaatatcaaagagttttaaagtactgggaaatgggctagcagaaggcagagaagattctacttccttcaagatgttcagcacaaatgtaagggaaagaggctgtgccgttctttgaaaaagcaatagacctgactttgccactgtacacaggatctatgcacaggctgtggatcccttatctgaaatgtttcagaccagatgtttttagaattttggatattttcaggttttagaatgtttgcacatacataatgagaaaacctggggatgggacccaagtctaaacaaaatttatttattcatcatatataccttatgcatatagcctaaaggtaagtttatacagtattttaaataatttcgtacatgaaaaaagttttgactgcaacccatgccatgaggtcaagtgtggaactttccacatgggacaacatgtcagtgctcaaaaagtttcagatttgggatttttcagaatagagatgctcaacccagatttacaaagtgtcctttaaatgacaaagtgtcactttttttttttttttttttccagacggagtcttgctctgtcgcccaggctgggtggagtgcagtggcgcagtcttggctcactgcaacctcctcctcccgggttcaagcgattctcctgcctcagccccccgagtagctgggattacaggtgcatgctaccatgcctggctaatttttttattttaatagagttggggtttcaccatgttggccaggctggtctcaaactcctgacctcaagtgatccacctgtctcggcctcccaaagtgctggaattacaggcgtgagccactgcgcccggccccttaagttcactttgatcttttctgtctcaaactcctgacctcaagtgatccacctgtctcggcctcccaaagtgctggaattacaggtgtgagccactgcgcccagccccttaagctcactttgatcttttctttctcatgcccctctttaagtataaaaagagcgggttctcctttttcctggcaggaccctgaatgactacattacgacatgtttggataatgcacttccactgaacaggtacatgctatgttcacaactgctgctccctgagcattttctgagaaggctcctgctttctccctggtcctgaaaatgaggcatcaatgcaagcattctctcaggtcaccaggaaaatgatgaaacaataagcacctcagagaggaagaatgtgatgatagtacaaacagcatcaataaaaatagcagtacgccctgtgcactagcccttacctgtgttacctcattttatctttaaaaaagaccagttgagcaccaggcgctgtggctcacacctgcaatcccagcactttgggaggccgaggctggtggatcacctgaggtcaggagttcaagaccagcctgaccaacatggagaaaccccgtccctactaaaaatacaaaaatattagcccggcgtggtggcacatgcctgtaatcccagctactcgggaggctgaggcaggggaattgcttgaaccagggaggctgaggttgcagtgagccgagatcgcaccattgcattccagcctgggcaacaagagcaaaactccgtctcaaaaaagaagaagaaaaaaaaaagaccaattgagctaaataccaatattatccctattaatgaggaaaatgaggcacagacaggctagataatttaccccaaagttacaaagctagcaatggaagagccaagattcagcaaaattcagagagttctagaaagtcagttccatgagagtagaaactcggtcttctttgtatgacattaagtcaccagaatctaaaagagtgcccagccgtatagtaggcattcagaaaactatgttttcaataagtgaaaaagtaaactctgggagaggtggatttctatcagagagagggagggagagtgaatgaaggagcaaaggaaggaagccgagagggaaagagggagggagagaggtggatggatacatagggacccacacaagaagagacactgttgccaagttcctcattttacaagctagcttgtggcccagcaacccagtttaccgagaagaaatgtatttgcagaaggagaacaaggactaaatccgatttagttttcccctcgaggatggtaagctgtcagaaagcgtcagagggatgtacactcaggttcttaagctggattattccacaagggaaagaaaagtttcggcttttttgctctcggggtagttccgccctaaatcactgagtgacagcaggtacagtcacaaggactcagtcctgacctggctccacatgaacatgtttcacctctgctgtgccatcagggtctccctcctccagccctttctctgtcagttaaagacaataacctctcttgagctgtagaatgaataaggaaactacctttgcctaatctaacctggagcatcctgatcagtttttggagcacaagtcatttgctaagatgggtcctgtctccactcaatcacaaggaaacttctaatgagaaacgttttctcatcacaaacagtgtaatttcaagtgtttttcttctcagaaaagcagtattcctctggcagtacccaaatgataaaaactggtctttttactttcaagttgatttaaaatcattttatagccaaagaatggccagttgcagggaggaaagggattcagacattttcaagatccatgatcaaacaaaatactcgaatgcctcacatttggtcgctaggccacaagcaagggatgtgcttagtgaagtttgtccttgaaatgtgtgcccagaagttgctcgctaaaatttcattcaaaatccgttgactttttctcctagacttggctattcttgcagacagcatgacactctacattttagatctgatgtatttggttctcaacaagaagaaaaccaaaatttagttttttaaaatagctcaggtgagattccactatctaccacctgagctcatataaggctgagggaactaagtggaattttttttttcttttttttttaatggagtcttgctctgtcgcccaggctgtagtacaatggcgtgatcttggctcactgcaacctctgcctcctgagttcaagcaattctctgcctcagcctcctgagtagctgggataacaggcacccgccaccatgcccagttaatattttgtgtgtgtgtgtttttagtagagacagggtgtttcaccatctcagccaggctggtcttgaactgacctcgtgatccacccgcctcagcctcccaaagcgctggtattactggcatgagccactgcgcccagtggaaattttttaaacaaatgctagctcaagctaagacgtgactgagacggggaggcagtggcagttttccttcagggtcattcatatatggagcaacattgctcatcaaggactgtatttacacaagagaataggattaaatcataaattcaattccacatattcttgtgaaactttaatggacatcctgagattctacctcactttgtccatcaaaaaaaaaaaaagcaactctaagtttcgatcactcagctaatgatgcttattaaggcttatgttgtcacaagatcatcaacactctggaacttacagttcaatcactatgggaaatacaatagcctatttggtcaaagggtctcaggcaccccaagaccaattagctggccaaggttaaagggaggcagaacatttatcaagtgttcaggtactgttggagatgttttgggaaattcttctctgaatatgaggcgatcggcatcaaattaattaatggcctatgtttatgggtcagtgtattaataattcagaacttcaacagactctatttaagagaatttttttttttttttgagatggagtctcaccctgtcgcccatgctggagtgcaatggtgcgatcttggctcactgtgacctccgcctcccaggttcaaatgattctcctgcctcagcctcctgagtagctgggattacaggcgcctgccaccacgcccagctatatttttttatttttagtagagacagggtttcaccatgttgaacaggcttgtcttgaactcctgaccttgtaatccaccggcttcggcctccaaaagtactgggattacaggcgtgagccaccatgcccagactatttaagagaatttttaataaaatccctctcatttctgcttgacataatactaattaataatccagatttaactctattggtttctctgttctctgctgatgaaattatttggtcctttcaattgtttctcaagtctgaacagtacaggatttccttcgctcccaactccctgggaccaccaccagcatcttaggagatgcaaagatcagtcagttcatagccaagctctatggacacaacttgcattcagctttcctaggggctacatgacctatttccatcttttatatccaagacaactgacaagatgacatcaatgacagccaattccaacttttcctttcagaaatagtatgctaagattctggttttctctcccacaggaagtcagaaatgtacaacggctctgttcttcttgttggaattctattaattaccttatgaaacaataagatagtccaaactgtggtctcacagtgatagtgtagaaagtcacattttttttccccagatgaagaaagaatagtcatgataatgtctaagaaccgtatgcagcctaaaagaatggatttcccaatgatccttgtgaaccatcatccaaggaggataatgcttttagcccatggatcagagaatgggaataccagctagtcttcttctcaagaaatatgaccaacatcttatgctgggatataaagtaaaacctacaggaaagtgtttttgttggagatctggacccagagagcctgggttctactacatataagttatgtagaccttggcaagtaacttaaactctctgtaccttgatttcccagtctataaattgaggatgacttctaactcaaaattattttgaggatttaatgacttagtagaggtaatatgtttatactaccacttagtacactgtaagcaataaaaacattagatattattgtaactatcacttataacatcatcaccataattattcaacccttacctctagctattagtcctattttttcagtctctctagatttataaatattttggtttggtctctgttcagcttccttactgtcagtcatctctgcagtgtctgccttctgctaaaggacagaaaagtccagaagaagtgtcagtgcccaagatctcaaagatttttggaggcctggccagacagcaaccctaggccttggaggcccttcttgagcacatacattgcatatgccgaagcacttaccagatggtaggtaggcaaaagatggtaaggctgcccttagaatgcagacaagaaacagagtgaggcaattcagtttaattcagtttaattcagctcaattgatatttttgcagggtcctcaatatggtcagtactgaggttagcacttaagagggaaaaaggtataaaatcatgagcaagacatgaagatctgaatagcaatacagagacaagaggtatgaatacctgttaaatacaacacaacatgtggttgcattgtgcagacaggaagtagtggcagaatttcttgtgagccaaattagctatgaagtattcatgtaagaaatacttctcagtagaagcttgccttgtaacaaatcactatcctcccagactcaagccagaggattacacagattaaattgtgattcagtctaaaatgacttggataaaataggttttaaaacatcataaaagacttgtcatttctggctttcatggtctagggactttggaccagctgtgggaacaagggattctctaacctttatcatctctttccagggagtggttaggtgctgtcaccaacccaaaagacatttcagagaagttactgggcactgcaccagtggaaatgaagcaatgagccattgtagggagacagatttcagacagttataaccatttcaggaagcagaagatgaaagccatttctcaaatactctgcataggaaggcactcttcacataagagttcctagcttatgttggaaaaatccagctaattttaccatcagtgtcagaaatgttaggtctctgtaggttaaaagtgtatttgtttgggaagaaatctatgaggtcaattcaacctttttcaaaggctggaagattgcctgtaatagaccaatctttaactctagacaggagaaaaacatgaaaaatattttagcaaatctgtttaaatcccgctgagggaattttctaaagggaatccataaattttttaaatgttggagagtctgcaaatgtcataacttttcatcaaatcaagataaagacataatcaactgcagtgttcatattatacacatttggaaggcagaggtcctaactatactataaatattttcttctgatcatcttccttcaaagcgatttttgtaaattaaatcatattttcaaaatagcatgagaatttattatttaatgaaataatatattaatcatgtctaaaagaaatggttgtttttaaggcaactattcacctctgatgtacctatttcgcaagtatgaagttctacatagccaatgtctatgtctttggttaatttttaagggttgtcttaaatcaggatttgcctaaagtaaaattaaattggagatcttaaaatataattgtttgtgatatttcatttgttctatatgcatatatttacatttataagatcacttttgataagataaaaagatcaaatatcaataacttatttctaatgtatatttcagtgtgtagagtaaaaacatacataaacacagatcgatatataaaatcatcagccatattagtgtgaagtagaattgcatgattactgattctactgaaaaatgagattatacatcctaactgtgaaagtcttataaaaactggtggaagaaataatgtgataaataatagttatctcaataaaaaagaaacattagagggatattttataaaatggagtccatcaggcttaagaccacactacaccctagaatttgcacatattttatttacattgtgtgatggaaatcctgtaactaaaaacagtgaaactatatgaaaagcaaaatactgttaaaggaaaggaaacaatataaacaagtcacattttttccaggttctaactgttgcacttcctaaaacactgtctaaattcttgtctaaacaagtgtaagctattaaaagtcaggtaaatagtttctgtacattatatgatgagtacaacagctctggctataatagaaagatcccacagctacttgtttcgattatttctttagaaaatttgttaattctgtggaaacattagctgtggaaacattagccaagccttgagtttgctgctctgtgtattaagagatagttcattccctgttgtttaagaacacagaccctggaaccagattactgggatcaaatcctggtttcctcatttcttcatgtgctgttctatttcctcatctataaaagagaaataataatggtacgtctttcatatgattaccgtgaagattcgattaatcaatatatgcaaagttcttaaaatagtgcttgctacacagtaaataaacactgcatatgttggttgctgttactattttcaataagtaatttttaatgcctgcaaacattataaactatttcccagtgagtgtttaacttgaatgtattatagggggaaaaaagaaataaataatgttcatcaaacattgatgcagtaacactcccttataacagatttgagatgaaaaatgctattctttgccaacaatgtttcatcagcatgaggatagccacataatcagatttaaacagataaaatgcatttatctaaacagatgcctctcaggattaaaaagaaaaaatcctgggtgatttcagatttaataaatgaggctttttcagttttagcaacttttgctaagaagctcagaagacattccaaatattctaattaacttttgacatatctagtgaaataagaggcaaccactatttctgtttttggaacatatattatttagagtgatttaggagactggttgacattatatgtgatttagaagtacaaaaacacccaggctgtcattttaacactttgcctggtcttttaatatgtatgataatttttcatgaagtataatcctatttttaagaattactaagatttgagactcaaccatgaaaaaaagtctgctgaaaggaatacatgtaatttactcccaacattctacttttttatctaacaaaaaataaacattactgagcgtggcatgcagcggacagaactctgcagtaaagaagaaagagccctcaattctgtgctgtctcttccactaaccctctgccaccttctgtgtgtcatttgctgtccctgacctcaggacctgcatatgtgataggaaggggttggtctagagagtagaacgtggtggttgaagcatctccttatgtgaaactcgtctaagcatgacatactccttgcagttgcctagtgatagaaaactcactataccggctgggcatggtggctcatgcctataatcccagcactttgggaggccgaggcaggtggatcacatgaggtcagcagttcgagaccagcctggccaacatggtgaaaccctgtctttactaaaaatacaaaaaattagctgggcatggtagcaggtgcctgtaatcccagctactcaggaggctgaggccggagaatcatttgaacccacgagtcagaggttgtagtgagccgagatcgtgccattgcactctaacctggggaacaagagtgaaacaacgtctcaaaaaataaaaaagaaagctcactacacctttaaggtgctgaagctgtctgcagatatttctacctattaaaaaaagttattccttagccacattttgggtcttcctgcaaactctaatttccctagcatcccaagtagcctagaactctaactgtgaaacacaataaagccccacaacagcaaactttttaaacgacgaaagagagctctaaataacagcaaaatgctgctcttcttgctcccattatgtttactattactgtgctctagtgagaatagcaaggggtcaaaggaatttataacacttcctataccttcaacttaccaagtcccctaccaagtaacagttttctgtcagagagaaagttctgccctccctgctcaaaggtgtccatgccaactagacttcccctgtagctccctgggagaggtcaggcctagaacaaccttctactccaagaaggaagatgtggatgttgttgaatttaaatccattatctctgttccatagagccatgctactcaaagtgtagtgtgaagagtgtgctggctcaggaaacattttgttactaagctgtgacaaggagaagaatactgagagtaagcgtttagaaatgttgcagctgttgaatactgaggttgcactaaactcatgacctctcttacccgtggattagaccacctgcatactgttgaatactcacagagtgagtcacaggtggtatgacctacatattcgtcccatgcaggaggaccaaagctaggtctgccatagattgaaaataatgaagtccttcacttcagatagtttaggtttagagttgaatcgtgtcatcctttcccatatccttcaattccccagatgaaatgaaggactccccacactttctccatttaccgtggatgaactaaacattgactttgtttttgacttccataaaccacaaattcagttttctaacaatttacaacactcgttttaataaaatataaatgtggtgcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaataaataaataaataaatgtggtgaaaaaatttaatgtttcataaaatttttctatgtgaaggttgattcctatttcatattaatatgtaactaactagcaacccacctcagggaataatgagtccatgaataaaagctatattttcacatgtagatcaaatgagattaaaatcattctcaaaagcattttggcaatatagacatccacctcccccaaatcagcatggtacagtggaaagagcattgaattagatattaggtgtgctggagtccagaattagctctggtattaacttgctttgtgactttttgaagtctcaaagccttccgtactaaaacttcctcctctgtgacagtagcagtttgtatgagccgatctctaaagtctctgacaactttaaattttatacttcaaagaaaattattttcccttaaggtagtttcctgatggaagaataattttcgcagctgtgcatttactgccacaagatagactgacctttctgcgcttgtatgagtagctcttttactataagtttagcattatcagactttgcaaggctgaaatcacacaacaaatgaagcagtaaacctgacccccaaaacacgcctttgttatggggacatgagctgcagcttgcagatatctccggggctgtggcataactcacaggggcccaatatgacacaatgggttccacaaaataccaatatctataaggtactgtttattgaattgttatttgtctcacaagacctttctcagggggattttcaatgcctaacaatctgaaataaagccatctgtcctcccctaactcataaaccctacagtattaacccaggtcctaaatagaggttggaattgagtggcccccaggaacacctgggcatgaataaccgtgatagagttgactccgcagtattccattttttgcttatggcccaaaaccatgttttaagctttcctgaactacggagatggtgcatcctgtgcctgccaagggatttgtctaatgtgtgcgagcactatatataactgtgataactggggttagcttaaaaataccaataattcccataatgtttttcatctctgaaataagtggagaatgctgatgcaaatgaagaaaaattaaaaaaaaaaattggaactgtatggaaattacagagtaaaatgcaaaatgtctaatcatagatcactattcaaaagaatggaaaattcatatttaagtaatatgaaaatttaggcagtatactttagcaaaaaaagataatgaagcagtggtacatatgtatatgtgcatatattacataacatatataatttattactgaatctatcaaaaagctgaagaatatgagaaaagacaaatatattaatagaacactttgaaatgagatattcagtccccattatctaaaatatgattacaattaaaattatacacataaaaaggcatataaatacagtatgaagatttttcttctttttttttttgagacagagtctcgctgtttttgcccaagctgaagtgcaatggcacgatcttggctcactgcaacctccacctcccgggttcaagcgattctcctgcctcagcctcctgagtagctgggattacaggcacatgccacgacacctggctaattgtattttttcagtagagacagggtttcaccatgttggtcaagctggtctcgaactcctaacctttatgtgatctgcccacctcggcctcccaaagtgctgggattacaggtgtgagccaccaggcctggctgaagatttttcttatctaaattttaatttgaaaagagcatttacattctgggttttctagaaaagagaagagtgaatgacagttctctcacaaataaagcagaggaagtcagtggtttactccagggctctccccagcagaagaatgctagatcaaggattgaaacttatacacctggaaacagcaaaacaatacctgctggagttgagtgattgaaaggaaaatgcatgaaatgaacagagtcctggagtgagctagtcaccccttagcccagtgggccacaatggcttatagatcaaggtctccatgtaatagctgcctccgtgcaaatgctgtccaatagtgagtgaactgggctcttctcagctacaaaagtgaagccttgagatcatcaatcttgactcccccacctgtggagaaagtatcctccctatcattatttgaaccattgggactttgaatacctttaggtcgtatttttccagccctcttctgctggtgagtgtgttttctttccctccagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggtaagacgggtagacatgaaccaagactgagatacagaatgtcagttaccagtatagaaggcaatgggctcagagttctttattccaaattctgagaaggcctacaatgccattagtgaactaataatgtaaacatccatatagatcagagacatagtctgaattacagattcccagatatttaacttaatatacttttaaccagtgtgtctttcaagttttaccaacacatgtttaagaatatatagattttattatttcaccccaaatatcttaaagagaatatatttctaattaatcctcttcacattgtttccttcaatacccatatatgcctatataatgtatctgccttaaattagaatagaagaaagttgattctgcatatggacagcaaaagtgagagggctagtgttccataatgatagatgaaaaagcaaggctatatcagtcaaaagaaaaaggataaagattaaattataagtctgatgtgctcaggcaatgttacattcaatcaatgccaactatgtaaaatcttcaaattccttagttccatgctattgctctcctaggaatattattgcctaggtatatagacccatatagcaatgcattcttgtacgtctataggagacatgaatagaatttaaggggtaattagtgatttcctttccatagaaaactccctctctattttttccctctctatagaaaactgtatcatggccaggcgcgatggctcacgcctgtaatcccagcactttggcagaccaaggcaggcagatcacgaggtcaggagatcgagactatcctggccaacatggtgaaaccccgtctctactaaaaatacaaaaattagctggctgtggtgccatgtgcctatagtcccagctactcaggaggctgaggcaggagaatcatttgaacccgggaggtggaggttgcagtgagctgagatggtgccactgtactccagcctgggcaacagagcgagactccatctcaaaaaaagaaagaaggaaggaaggagagaaagaaagaaagagagaaagaaagaaagaaagaaagaaagaaagaaagaaagaaagaaagaaagaaagaaaggaaggaaggaaggaaggaaggaaagaaagaaagaaagggagagagagaaaggaaaggaaggaaagaaagggagaaagaaaaagaaagaaagaaagaaagaaagaaagaaagaaagaaaggaaggaaggaaggaaggaaggaaggaaggaaggaagaaagaaaaagaaagaaagaaagaaagaaagaaagaaagaaagaaagaaagaaagaaagaaagaaagaaagaaagaaagaaagaaaactgtatcatataaggtcctggtatagtgggaacctgctcttcccaagtgagcccttggtaatttgttagtaagcattccaaaggagaagaatcagggactgtctagactactgggcaagtccagaaatcatagctaacagtcaagccatatcgttaaggaccccaggtaggtttgatttgcttgttggtattagtatttttgtcatttgaaagggatgatccaatatgactctccacatcatgcagggatcacaaactaaaatgcttacagaggccaagcagataccataagtgagcaaagcatgcttgtgccaggaggtagtagggaacggtggcaattatggaaaattacagaccacatgacatacctaaaagagacagctgcctttcaagtcagagagttgtagacatgtaggaatttgagaacaagattgtggaatattccattttctaagaaaataaaaaaaatccagattttaggtgaattgtcctaatgtttttatttagcaacaaattcattaaaaaagaaaaagctgcattttatatattcaacttttaattaatatgaatataactaatcagataaagttcaactatcttccatatttaccatgaatacacagccaatgtgacttcctgctaactacctggtgttagaaatatgtgctatggagaaattaactttattattattgttatcatttatgtcctccaaataactttcctgcagaatgattgggctagaagatttacagctaccttcttgcttctttatttccaataacttctactgatgaaaatactaatatcgctagtgaagtgtatattttgccccaagtggtaagctctcctataatttagtcaacatgttttccaagaggctcagggaatcatttggcactggctaacaggatattatacctctttttgactttcaaaacaatgtcctattgccccaagcaagcttcaccacctcattttagataataaaagtgggagaagttagatgctattttttatatctcatcactgctgattttagttaaacgggccatagatcagatgagaacaccaagagtaggtacctttgcctgaatttttgcagaatcaagaccctcgtagaggagtaactatagttccttaatagaaccatctctagactaaattataaagtcaaaaactgtgcttttatcattctatctcccacctcataaccctaccccaccacatttcaacacccctttttggcaccaaaattcctgtctgttaacaatgatttaaaataacaatgtgtatcatctctcctaagaacgtttgaactttaacatgagacttttaattgacattccttctacagcatggaatataacttgaaagctaaaatttctgatagtacagtgagtgacgcagggctggaggtaggagggaacaatgcatttcttcctaccactttcctaaatgaatgcagcactttgaaaatcgctacctgctttcctgcgaatgaagctgacctagtgttgagtaccattaatattaaatatacatataatacaaaaatatatatatataaatatacatataatacagagagatccaaaggtacccattcagtctccttttggccaacctcacccaagttccaaagttgaaaagccttccccacttcctagatgaaaagaaatacactccaggaatttttcacagttgttgtaaacctgtcatgcttttaaaccaaaaacaatgaaggaataattggaacagatggcagacctcatggagaatacatccattgagaatacagctgttggaaaaatttgtgagatgtttcttttatgatgaattgactctttacaaaagattagttgctattcaggaagatatgtgtgtgtgtgtgtgtgtgtgtgaaatatatatatgaaatatatatatatatttcaagtgacataataacttccaatgtcatttacttcatttaagcaacaacaacaaaaacttaagttaaaatatattcagatattaaaaattatctgtacacttctagtcttgccctgactaactcccttatggctgcaagctctgtcccataatcaaagattggcagagtcacaacacaaaattgaagactttgcttcttagagacactcaggacaacagctctggaaatgtacctcctgagagatttaaagtaaaactctgagagaataagagcatttaaggtttgaacagcttaccaggaggctgaaaattatctttctcagagaccaactttaaacagagatcagattttcatctgtctgaaatgttttaggtattgcgcagcctggaggcagaaggaaagcatcagtcaacatttactgagcacccactgtgtatgctcctaggattattactgcaacaactaacataagaatcattcttacactcttcaaagcactttcatgtacattaaagcaaagtgctcttggttcacttaattgctcacctgctatgggtatatcaatggtgctaatttttacactagccattattctgaggatatttaagcaaacagccaatatcttttaattttgttttcaatatccatttttttcaccaaaaattcatactcttgataagccataatttcactccaaagcattttgctcttcttttaaacttgcttttgaatgctgacgattatttcaggaagtcttacaaggaaaactgataacaaatgacacaaatgttaaccttctgtttttctaacttaaccatgccataggacataaggcttatgtaggggtgggagtaatggttgggaacactgtcgtgaaaacaacactgaaaagtaagaagtcaggaaacttgagtttgattcttggctgtgccagcaactatcagtttcactcatactttcagttcctaaatttcttccattctaaaatggaatgtgtactgaactgtaagtggactggactgtatcattcctaagatttcttctagtcctaagatgcctcatttatcaatgtgcttccaccaagaaaaactttaacatttgcaaatagagaaaaccagggtgtactacttttctactgagtagaagaaatgctaacaagagttcttcacattcaaggacagattaattgaaagaatcttactttgcctcttcctttgcattgattaaccaaaatccagtattgagaagctatgtctacaggtagatgttggcactttccaacccttacataattaaaagttcagtggcattactaggagatagagaataaataatattaataaagtccttgcaaattttccaaacctacctgaattttgtaggatatttgaattattcaaaacctactcttaagtttatcttaataggtgcattaatcagtatgtactaaccaacatctgcaaattttcagtggcttacacattcaatgttaatttcttgatcttgccacagtccagtgcggattgaaagagaggctctgctttctttcaatccttctattcaaagttccttctattcaagttccttctattttgtggttccatcattcctagtgacttgaaatcctttccttcttgctatatatttggaaaaagagagagagccaaagatcatgttgggaagacatcgtcttagttcctattggctagaaaccagtcacataaccacactgaactgtaagggaggtgggaaatgtctagttactccccctcagaagaagaaatggcactgctggtcatccagccaagcccagtcacaatatgagacaacaaagagcctagaaaaaagtaaggtctaaataactgctaacttaaaaaatgtaaccacaatatcgataaatttggaaagtagaaatggagacttcatttcttcataattaaagggtgacaatctgcaaggtggtcatcccgtaggctggaaaacatgtgtccaaccaagatcaaagacaggcactttgaaaaaagaggggttggggcaagagctttatgccgaatgggttggctaaacatacatattaaactggttacaggcggagctatgaatatttatgaagatgatcctgacacatgcatattgaacaaaaatgcatgtaacatacaatccttgtccacttcggggtagagacttaacatttaatggttttataattaggttctatacgtcaaaatgtcttgcaggacacaatggcatgcaagggtacactctctttaatccaaccagaaccagtctaaggtcggtggtcttcttctctggagaaagttactgaaatcaggatcttgtttaatgaaaggtatatctggtggaacaggggctggaagtcagtgtctaagagttggatgagctgtagttgttttaatattgcttatcttgaggccagtgcttgtttacctccttgagaaaaagaaaagccttgtagcagttggagcatagtttattttttaagtccaaggctgtgtgacttaacccttgtctggcatggccttcagttctgtttataatttgatatcttattgccacaaatagactgctctgtctgacctcccattccggtatggctgcaaactaagttcttaagctttttctggggtccctttggttacaaaagagggtcgttcagtcaatgggggcttagaattttatttttagcttacacagtgaaatctcttgacatgtgaaaagactcataatgatctcaccagaaacaaagacatgtcatagaattcctagctttgcttctccttatttaaaaggagcaaacaatcggggccaaagttaatctcaacatgtcagctatcttctttccaattatatagtgccttcaaaatataggagtgaactttcctgtcctttgcaagtcaatttgtggattggggtctcacaacagccgtaacatagttatgacaaagatgataattaagaatacttctggatgtcttcttcaacattttggtgaccaatatccagatggttttacttccaggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggtgagtcatctctttctaggactggttagtttatagtttgcattatctgtcttaagtttgggggtttttaaggatgtttgctctttttcagtctattgaattagatgcccagaagagccatttttgagttagagcagagagctattgaatccctgccaggtgctgtgggcactgcaggtccatcatttattaacgacaaggaaggggcttatacactaaatccaattagcattatttggaaagacagtgcagaaattccaaactcagttaatttttgaactgttgtttgctcgtaagatagaaaccctagatggaaaaaggcaaaaataaatccaaaattggaaaagatataaaaagatatttaacagaaatgttaccagcccttaagtatagattctgagcacatgtactaatgcaaaacaatttatataaatatgtaaaagtcatactacgaaattgaacacttctatcaaagtaagatttgtaaaaggatatatcacctcaaatttttttttgccaggaatgtcataaacaatacaaaatgaaaatgcaatgtatatgagactttatttttctaaattgtgtttgggattataggacaactttagtagttgaccatttttgcctactacttttatttctgaaggaaatcacaccatttttgaaggaaatcaacttacactcttttgaaaaggctgattgtgatttaagataattccttcataaccatgctagaataaacaaaatataaagtttatggtcatcatagtgaatcaggctctgctttgaatttttaaatattgttagaattttaagactatgactattaatgacagagccagtttaatgctctcctgtcatcttgaaattctaaataatttttgaacaaagtgtcccatattttcatttcgcactggaccctgcaaattatgtggctggttctgattaataatctgataatagatccactttctttaagtggaagccctccttaagggcccaaaactggggatgattcattataacctggtttcacatgaaaatcttccccagaattacaaggcaactatgacaacaatgaacacccctttccaaagctcttgttataagaagctgtttctttaattcaaagggagaatgaactgatctgctttaactttcaatttgctcttgaggtgtcttgttttatgcaactaatttggaaaataaaagcttgtatatatgatgctttaatgtgcttttcatagttgccagcttcatgtgatgtaaattttcatttaaacattcattcttgcttctgatttattcatttttctatatttttttctcatttcttttgcatgcaaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcatgaaaaaggagattcagactttcaacagggcaaagcatggaaacacgatgctaattctatggacttcttttcatctttgtgaactttgttccctcctcttttcttctccctgtctcatatattgtgtagatctgcgtattttcaaactacccaaaacccttaccttttcaacagtacacacataactccataacaatgttaatttttaattgaaactgattccacgatttaaaatgtattatttacacaaagactcaaaagtgtcttagcatttaaagatttaaaaaccgtgatccacagaaagaaaactaaacttgaaacctctggtgtcacagaagagcactagctatgttgaacatcactcatggaaacagaacacagtcaagaataattcctgggcagaaattcattaacctcaaactctcaaataacatttacttgtagaatttaacagtcttctgtaggttctgagtctctaaggaatggtgatatttttcaagctatatagtacttctttgaagatcccagcaaagtcctaagctatgtactaattcatttctatttaccactcactttgcattgatgaacatctttctacgagatgttatttcacttccttcccacttaccctagatagaggggttgttcttggaacaatcttttctgaacatcaccattttcacagttatttctttggatccatcattattattaattcatttaaagtattctggggaaacgggcaagaaggaaaaaataaaggaaagaatgtccatacacattagttacagatctctgtagattcattttccatctgcattcaaagtgctgtaaataatttccatgctaactcaaccaggtgacataaaaaacctcttgcacatttaatttgttgtgacagagaatatctgatgattcctcactagtgaataagagagttgaaggtgtgtttcatcttttctaaatatgggatcagttggtctttattcttttcttaatgggattatcttttgacatatcaagaaatcccctaaagcacttccttgaagtagagatatgccatctgtgcaatcatacagcattttaccttctctttgcttagctttaaatggctcccagttttggaagccacaggcttctccaatcaactgtatatttctccagtaaagcatattcaggaaagttgactagttgattcttatcctgattgtttctcagctttgcttccttctttaaagaaatgtactcagaagaaaatatcataaattacactaacattgttttattattattaaactagaagcaacatactatttgtcccaggtcagagttcacattttcataatcaatagaatcagatgttgggatgaatatgacattattcttagtttcatatttcatggattcagtatatagaaaccacaaatttcctaagtttactctcccaaagacaatttaataaaccaaaaatgctaccaaaagagttcaagtgtgattgatgaagtattgacaatcaaaattaacaataactgacaaaacttaactttctgcagagactattacttaaaagtgtaattcagagatttggataaagaaatgatctctttcaaaagttaatatttctatactactttagactgtatactacctaattctgacatttatgtattattttatagttttcaaaatgttttcacatacattacat

SEQ ID NO: 16924 - DNA, 101357 bp, Human
aaaggggtgatctcttaattctttcgttatgtcctattgtacatagcatataatggtaattcagaaaaattacttctaattacataaattttcacaatggtatagtgactaatacgctgaaatagaaaagtaaggcattgttatcatggtctagttcagtctttattgcgactatatctgataatatacggtaagcatctaaccacttgccaggggccacagagccacagggagactatgtctcgcttaaattcccaaaagtgggcccctgtgcttcaaaacgtccccgcatgggaaccacaaaaacgttgcctccccagttatcaccccaagggcccaagagccgaggactctgcccggcgtccttcagctggcaccagctgtcagaaaagcggaactggggacgaggactttgcccctaaccaacatggccgccctgaggcttcgggcttcgggcggcagaaggaaggtcacgtgaagagaattccgttcctttattggccccgtctcctggaagggcggggtacaataacccaaccggcgccggccttaaaggggccaccgttggatctgccggtggccggccctaggggctgggggggcggtcgccgcgccgggcttctgcccctcccgcgcggaacggtgacgggcggggctggcgctgggaggccgtgtcgctgggagactgctgacagcccgccgcctgccgccgcgcgattccgagggggttaacggcggagccgccggccgggcgcggaccggagcgcgtgaggctccggcgcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggtgaggaccgcgccgggcgggccgtcggggcggagggcggacacttgttgcccgaggaggcggcgcgggtcgcagcgcccagtcccggccgcgcgcggggcggggaggcagcgacgtcccccgggctgctcggccgcggacccgtcagggctggggcgtggggacggcgccccgagggtcccggtcccctagcacccccggggcgcgcggagctcactgcagagtcccacaggctcgccccggcccccgtgtgcgcccaggctggtgcgactaggggggtgaattcgctccccaaggtggggcagcgccgccgccccctgcgctctcgccatcgccccgcatttactcgctggaggagggggtcacctcattcctagggaggaggaaacagacattgagcggcgacgtgactcagtgttcataaataggacgacgtccctgcattcccaatctgcactattggaagaaaagccaatgtttgggtgaggatccgtggttgctcattagccagcggctggccagttttggtggaattgtgttggggggaaggggaccatctttcagacctttaggatatttagtcaagaaccttgcccccttgtgtgaaggtgtggcttgccgccatcggggacacccagtacatggggagtcgactccttcccccgcctccccccacccccgcaaaatccacacaatttagacactttggagggtgaggggcaggtatgagtaatcaataatggtggtggggaggaagaatttatttcaaatctgcagttattgtgcagaataaaatgtggacaacgtgggcgtcacagaatgaaaccggtctttgagagatgccccattaggagagcagctgtcaaaaaaagcagtgctttcagcgcttggctgtgggtccacaaatgctgtcaatgaactatagttgaaggctgctgccaatacaacaccactgtgaaacagaatggtgtatgtaagtgtcatttatttataatttatatgttcacttactttctgaaaggaattacaatggccgtgtgcttaggtaagcttccaggcatgctttctagagcagcaattgtcaggaactcagggtcttactgattgatcttactctaaaaccttttcctctccatataaactaagcgctagccagcatttcagaccttttccttaggagttctaggctgtctttctgctagaacaaggtcaagtcacgtaagacggcacttacttgtagtgttggagacaattttttccagtgttggatacaatcctgaaattgtgttgtatgaaagtttgcccacttcgctagctattcattttaacaaatatttattgagacttcgctacgggataggtactgtcctaggctctgaggctgcatcagtaaataaaatagcatttctgcctccagggttgacattttttggaagggaaacaagcaataaagaaatatcaaatgtatcagaaagtaatgatgctataggaaaaaataagacttggagggcaggaggagggagtggagatctgggagtggaggggagattgctattttccataagatgatcagggaaggtcttactgatatggtgatattttgagcagagacaatgtagcattggttcattcaggctttgctgtctattgagtgcttactgtgttccagccactggtttaggcccagaggataaagcagggaacatttcaagctccttgctttcatggagcttaggatccagtggttgagggggagatagacaataggaaaaaggcaagtgaacaagatcatttcggatagtgataaatgcgatgaagagactgaaacagggatagagagcaaggggagggggcttggtcagagtggtcaggtcctaacactgtgggggttttgttgaagagctggtgaattggggcagtcctgagggaactaacaagggatgtccaggcctgcagccatgagcaacagctggaagctggagctgggggaggaagtcacgtggctggaaacctaggggaggagctgcctgccaggagctgtagacttgaaggtgtggagttgagatgctaaggcagggtacaggcagggaagaaattctcaggcttctgatttcattggcagaactcaaaggacagctaggaggcaagggagcccctgcagtggagtccataggttgggtcatcctttcagggcccacagaagggtagataatggctctggggacagtgtggataaaggggacttacacagaggagttagtagggagccactttagatggagtggcccagggaggcctctgcacagcctggaccaggttgacaggaagaagctccctggggaggtgtttgtgtggccggcatcccggcagagggactagcaggtgcagaagctccagtgcagggtgaactccatttttaaaggacttgaagggttgcatgagagacagagaggcgattggtagctgaggttggataagcaaccagaaaacatccccctggggccatggtaaggattcaggtgtgattctaattgcacatcttggtggagaatggctttcaggagggaaactgggtaggctagagaggaagcaaggagacctggtaggaggctgttgccatcatccaggggagataggaagggagtgggactaggatggtggtattggagatggagaaaggggcagagcctccatctgagcctcttctctccatttggagaatctggagcttcagaatggggatgagggagggttgtgcactgatgtccaattctagggtcctgtgagatatacagcaatcagtgaaaacccaaaaaccaggtgggctaagggagtcccagtctctgagggcaaatagctctatgcagtgggcaacctgagagctaaagtcacagcgggtccttggtaagccttgcagcaagtggaccatttctcatttagctgaaaccatccttctaggtgggaatatgtagtttctgcggtttcaatgtggcagtcttactgttaagactggggtgtcacctttggatgatgtaatgtaaatgtaaatctactttaggttggtggtatctccccttgtgtaaacagatcattaactgcaatgctgacaaaagtccctgggggtctggccgtcccctccttagccagtctgttggatctggagagtgatggtgtgaggaaaaaagactggatcaaacttctttatatatagtcacatgattctgtaagcttagtcttcaaggaaagaaaaaaaattaacctgaactagaattcttttgaaaatttacatcagaagctgttttgtaactataattgcttggccagatatgtaagatttgttttcattggctggctcaggatcaatattgtaaatactgtataatgagtttgttaattaaatgtattagattcacactgttacagatgaatgaaaacttttattaaaatatgattattttctgtttgtacaaatatttgatgaacatattccattatagtactctttttgtgagtctttttttcttttctatttagaaaagcaaaacaattcaaaatgctttgaaccagtaattacatgtgctttgaattgctgaaaatggttagttggttccctggaataagagtttattcagtcatcatcaagctgaccaggaatttaagagttctcagataatattccgttcatttccaagcagtgaatatagttccgtatagtaatggaaacaaatacccttttttcagttgtctgaaatatgaatgtatatttgattcatagagctttgctggaaggctaagtcagaaaattatagaaaaatttactcttttcgcttgagtaaacttacctaaaaaaaacaaaaacaactcacctaagatttgtgatagatgtagtgctatcatgactttcttttaataacaaaatattcggatcagcatgaaagaagtagaagtgacatccttccattctttatgtgagtagagacctttgagcagtgctcccaaccttagctgcacgtcagagtctctagggagctttgaaaaattcccatttccaggccactccaaacccattccaatctctggggctgggaatcgcctggaaagctccccaggtgattctaattgttagctgaggttgggaaccattgtctgaagccggggtttggcctgaccagaggcatcgttatatcttaaaaagatcactgaaaatttgatgaagctccacttctagctagatgacttaccctttctgtgccttgatttcctgaaccgggagccaggcccttggtctgcaggcttccttctcctgattgttgtttgaccctgtggcctacaggcggggtcactggtgcccacagaccaggagatggggcatttggtttaaccttaggttacctccgttcgccttaatgggtgctgctcactctccacccaaacggcagatcatgcacttggcctcccaaaacttgttttctggtcgcaggacatcattcgaaagcaatttgatgattgaagtgttttgaggacctaaggtggccctgctgatgtacatagtttccactcctgaggttgtatatacttggctgcgtttctgcctgttcctcttccaagccagtctgttgtagcatattgtaaaatgtgacatcctagcaggagagtaacagttgggttctattgcactggaaaatccaggcagttttaggccattttcacttttcaccctagtgtgagggtgaggcatgcggtttctcagatttaaattctgaataaaatttccccttaaatgatcttatctccaatatggtatagagtttaatttatttgggaaggttcagaatgttgtacatttttgaaagctacatgttacatatgtgcgaagtttattttcagttttccactatttctctaattttagggtttctgactctaaaatcagatgtttttcacatccagagctgctttaaatcctcctcaccactccaccccctaacaactgcttggttcccctctcagctcaatctgctgtcaccttcattacttaaagcattttttcttccatagcagtagctttaaatgttactgcctgcaacttcaggcttttccagcctcaggacaattacataaaggaacaaaaaataggctttgtgctagagcagaatagctaaggcaggagctgttggttccaatgtttatatttcaggctatattctttgtctctttgtttctctccttttaaaaaaatgtgatccactcattttcatacatatcaccgcagggcctgtttgcgcaggtctgagaacgcatcactcctggtacagtaatagtgactgtgcacacatcagcatgtgtgggatgggtagaccctgggtgtacattgtctatgcagaatcattaggactcatctcaaggatgctgaggaagtgccagtcatttcacatacagttcagttgtgagagacaattttttcctttgtaaatactaatcaccatcaaagcataagaatgctgatgagacacagccgatcactctgccatgatctctgagcattaggaggctataccatggcagtagaaagtaaaaatgtctcttcttgggaaaaacagaaacattttcaaagtgtaacctcaggagaatattaattaccttaactcaaactttgacgttggggaaagggttggcttcatgttgtgtaaatttcaatcatcatagaaattctttaccatatttgatatagttggggtaggttttttatttattttcacctctgaagatttagctgggtttaatatgctcacattccccagtgaagtctacatgaggaggctgggaagcatactggttaaggctatgggtcttaagcatacctttcccacttatgcagtgtgactctgggaagctatttatcctaccgatgccttggtttccctgcctgtaaatggagctgttgatagtactcacattttatgatacacataaaatgcctgtcagagtgattgggtctgtatatacaatataggtttgtgtattagttatctactgccatgtaacaaacccaacacttagtggcttaaataataaatgttaattatgtcacagtgtctgtgggtcagaaattcagggatggcttagcctggtgcccctgcctcagagtctctcccaaggctgcaataaaatatcagctgtggtttcatctgaaggctgaactgaaggagtggtatctactgccaggctcacttgtgtgggggctgctgcaccctctccatagggtggcttgcagcatggcagcaggcttccctcagagcaagccagatggaatgggatccaccatctttttgtagcctaatctcagtgatatcccatcactttcgctgtattctattcctgagaagcgagtcggtaagtgcaaatctcactcagggagagggaattacaaaagggtgtaaataccaggacgtggggatccctgggggccatcctataggccagtggtccccaacatttttggtaccagggaccagtttcatggaagacagtttttctacagaccagggggcagggagctagtttcaggataattcaagtgcattacatttactgtgtactttagttctattattatataataaaataattatacaactcaccataatgtagaattagtagaagccctaagcttgttttcctgcaattagatggtcccatctggggctgatgggagacagtgacagatcatcaggcattagattctcataaggagtgggcaacccagatccctcacatgcacagttcacaatagggttcatgctcctatgggactctgctgccgctggaactcaggcagtaatgtgagcaatgggcagcagctgtaaatacagatgaagctttgctggctcacccgctgctcacctcctgctgtgtggcccgcttcctaacaggccatggactggcactggtctgtggtccggaggttggcgatccctgctataggctgcctaccacagttagatattcattagtacattttttaatttggaaacttttttgacttctgtggagcaatcagtgtttagaaatgcatattaagatttctttctaaggctgggtgtggtgactaatgcctataattccaacactttgggaggccaggagttccagaccagcatggccaacatggtgaaaccccatctctactagaaaatacaaaaattagctcagtgtggtggcacgcgcctgtagtcccagctattcaggaggctgaggcatgagaatcgcttgaaccctggaggcagaggttgcagtaagctgagattgcgccactgcactacagcctggaatacagagcaagactctgtctcaaaaaaaaaaagggagcaaatccaaacggatccctgacattattaaaaagacttatttggaggaaaaaaagaggatttttttctaatctgatttttttctttttagcttcagctccataaaagaatagttttagccactatagtttaacatggaacacttcattgagaggactatagctaggttactaagtttctgagtatcaagagcagttaccccaccatatttctgaacaaagaactcgggaagctaaaccttttataacttggaaaggtccagtacttttccttttgttactaatttcagcaggtgccgcatgaaattcccatgtgcaatcataattaatgccaaagagagaggtatctgaggtcggcctgaattcacgattaagagacaaaaatattatttaattcagaaagttcctcaacataacaatagcatgtcttattttatcactgtattattaatcttctcaggctgccataacaaaaaacacagattaggaggcttgagcaatagacatgtatttcccacagttctggagcctgcaagtctgaggtcgaggtcccagcatggtctctttctggtgaggcctctcctctgggctgcagatggcccccttctccctgtgtccctacgtggtctttcctcagtgtgtggagagaggagcaagctctctggtgtctcttcttataagagcactaatcctattatattagggccccacccttctgacctcctttagcctaattacttccttagaggcctcatctccaaataaagccacactggggattagggcttctgcatttggacttgggggatgcaagcatttaatccatgataatcacctttaatttttgttaatctttgtgctttattttaaagataataaaatagtttctattcattaatatgaagtgctttattttgtatattaagtaccctatttatgtaatacatgtcacgggtgcacctagccggggtcagtgtcacaggcagtaaaggaatttaccaagacagttgcaggtaaagaaagccagatttattagagaaagtataaaaatatgttgcaagggtgcagcaggcagcacagcagagaaggggccgtctgccaagcggcagaggctggaaggaagttttatagggttgcgctggaggggcctatgtgctgaaaaaggtcactgtgcccggggttgtttgtgattggccatttctcagaatcactgttcattgttctctcccatctggggcccctttctcattgttgtttacttatcaggactccacaagacgtatcattttatctttacaagaactctgtggcataggtactgttatcatccccattctatagaggaggaatctgaggccaagtaaacctgtctgaggtcacacaggtgaggaactgttgatccctagactcaaacccagtttcagctaactctaaagcctgtgctgctcatcatctttttttttttttttttttctgagaccgagtcttgctctgttgcccaggctggagtacaatggcacgatctcagctcactgcaacctctgcttcccgggttcaagtgattgtcctgcctcggcctcctgaatagctgggattacaggtgcctgccaccacgcccggctaatttttgtatttttagtagagacagggtttcaccatgttggccaggttggtctcaaactcctgaccttgtgatccacccgcctcggcctcccaaagtgctgggattacaggtgtgagccactccacctggctgctgcttatcatcttaaagcatggcattaatgcgagtgaatttttcatatatctttcacatctcatttcaatcctaggatagctctgtgaagagagtgtttttacctacgggaaacagagattcacatgagttacgactcttcattctttcagtcatgtatttatattatattagggttctctagatggacagaactaataggatagatcgatatatataaagaggagttaaaagggagtttgttaaggagtattgacgcacacaatcccaaggtgaggtccgacaataggctgtctacaagctgaggagcaaggaagccagtctgagtcccaaagctgaagaacctggagtctaatgtttgagagcaggaagcatccagcgcaggagaaagatggaggctgagaggctaagccagtctagtcttttcacattcttctgcctgcttttattctgacagctgattagatggtgcccacgcagatagagggtgggtccgcctttcccagtccactgactcaaatgttaatctcctctggcaacaccctcacagacacattcaggaacaatactttgcatctttcaatccaatcaagttgacacttaatattaactatcacatatatgtaatggatgtttatgcatgccgatggcgtgccaggcaggtggcaccctgctgctcaggtggaaggcagtgcctggacactggcaccaggcagacccagatttgaatcctggctccatcaatccattcattcattcatttattcaacaaataccttttgggtgccatctctgttctgagcactgtgctggttgcaaaaccagctgtggggccccaggctggcagcccacttccccagtgtaaggagggcacagctctagacagatcttggtgaatgacaaacaccacctctcccttcacggaactcacagcccacttgcctgtcattccccacaccctcataaggtaaatcagagttttccatgtaggaatctgctcaaaaagagcatttcttcaatgtgattctagttctcttccacacagcttctctggcttacacccgtaccctgttttgtccagcatgtggctagagaggaggtacatttcagtcacttaaactttgtgtctttaattggtcttggaaacatatacagtactgatctgagatgacccctgtgtcagggatgatttaaatgaccccaagatggccgggtgctgtggcttatccctgtaatttcagcactttgggaggctgaggcgggcagatcacctgaggtcaggagttgaagaccagcctggccaacgtggcaaaaccccatctctattaaaaaatacaaaaattagccgggcgtagtggtgggcgcctgtaatcctagctactcgggaggctgaggcaggagaatcgcttgaacccgggaggcggaggttgcaatgagccaaggttgtgccactgtacttcagtctgggcaacagagctgtgtctcaaaaagaaaaaagaagtgaccccaagacggattctgtccagttactgcttgaagatttgccaaaaatagcctcacaaggccagatcacttgagtaaaatgtttctcaaaacatctgccaacattgaagacttttccaaatgtcatgatggcaattattgattgataaggtgacatgtctcatccactttgtccatcctggcttatgcctgtcatccaagtgaaatcattagtagcaccctctcccactctgaagcttgagtgataaattataattataggtcctctattcacttagcacttacaatcaattatacttacaatcaattataggtctcctatttacttagcacttaccacttgtgccagatattttaggtacatcatctctttgaatccttcttacagccttctaagatatatactattatttccccatttcatagatgaaggagacttcttcaccctttataaaaataataagcactgtggaatcccggggtaactggatatccgactctggggttctcgaagtcctgggaccagaaggttcttccaaggctgtgcctttcatctcttcagtgagaaattcgtgctgagaagggtgacgaaatttcctcaagggtgctcaatagatactagcaaaactcaaaagcaggtctttttttcttgcagcctgctggttttactctgcccacttaattctccaacgaataatgttctcccctttcccagcgccatccaaaagaacccggagcatacaaaccgggggacttcgggagtccaagccagctggaacccggtaatattgccagggaaggctgtccccaggccgcaggtagggagaagcagtctccagcttgtggaggggccggagagctttgcaccgagggcctgtccaatgctgttcaaagaccagcggtcgccgccggggggcagtaacttcatgtgtgtgctgcagtggagcttgctggttgacttacactttatttcaggcatcaaaggcaaagtgcactttcagaagggagaagtcatgccttgtgctgcagagaagctattattataaagataagtgtgtaattgaacctttcaagtggagagacacccctctccctccagcagaaactgtgcaggtgagaaagccgcttcctgagtggacctattccctgctgctgggagatgctgcccgctttgtttagaatacaaataggggaacgtgctcacctgaaggggagacttttgaaaggaatgaccctcctcctgaagatgactgaaattatcagcattattatgaaaagaatatgaaatatgaaaatatcagcataaagaaatacagagagagaactcagatgaaaacattttatttcagagataatgggaattttctgagctggcttcaggtattaggttactcagtagattaagaaggaaaagcttttgctggtaggcaggtcacccggatgattccagaattaccaccactctagtcaagtagtgacagtgttctgggctggagtcacgattctggggaatttgtacagcttccctcacatgcatcccaacctgtagatctcaggtggtctggtccgcaatcagtaaaactgctgtgcagcccctcaaaacagaccacccttcagaaaaattcactgtgttacagttcatgaactgcctggaaacacctgcaggtgtttggaaagtgattcagggttcatttgtattggtatctctttctagaatagctaaattcaagatgtatctttcaaactagacacagggtgaaatggggtgcgggtatagagcttgttggttgtgggggtgacttcctgcatttagtgaaaggggtggttatgcagaggcagcacagagcattctgtgttgcatttgtggcttggaatgaagtggacccagctggctgccttcggggctgtgcctgagattctgagcatcttcagctttgtgtctgtaaagaggtctagatggtggcttactaggatgctgtgagaattgcatgtagcatggtaacgtttgtgatcgtatcaaggacaggagatactcagaaaatatttatttagtctttatgaaggatcttgttttaatgtcaatgaatatgttgttaccagttttatattaggtcaatgtttaattttttgcttatttttctgtgcatctattttctttaggtgcaggttttgttgctgcttattaatcttagtaattttcatggctcagctgagagtgcagtgagtgtgaaggtgtctatacctacacatgtgatcactgttatctctgaatcctgaatgtggacagcattcaccttcttttttttttttttttttttgagacagagtctcactctgttgcccaggctggagtgcagtggcacgatctcggctcactgcaagctccgcctcccaggttcacgccattctcctgcctcagcctcccaagtagctgggactacaggcgcccaccaccacgcctggctaattttttgtatttttagtagagatggggtttcaccgtgttagccaagatgatctcgatctcctgacctcgtgatccgcccaccttggcctcccaaagtgctgggattacaggtgtgagccaccgtgcccagcctagcattcaccttctttatagatggacacccaccttagtttagagttgttcttgttaaactacatcaatgtacagcagtaaggagggttggtctggattcaaatcccagttctgccagtaaccagctgtgtgaccttgggcaagtaacttaacttctctgcacttaggtctcctggtttatcaagtgggattataaaagctcctacctcctggggttgtgttgtgaggatgaaaagacataatacaaatagagggcttacaataatatcaggctcatagtaagtatttagtatgagttagcaattttattaaaatgcagaaattacagtgtctacattgcttgcagctgcttaacctgttcctgggacagtgcctgccacatagtaggcacttaataaatatttgtgtatcagtggaagtaaaacatcatcatgaacaagaaaatattgttaagtccattaaataataagctttattttcccatgagtaacttaggcactttcagaagctgtgtgcattttttcaggccagggggtcctgcagcttaaaaattttgcagtggtgtgtgcctgcatgcatgtgtgtttgtgaacacacgtgcatgtgtgtatgaaatgaacagatttagatactgaatattcagaataccgcagcaccatatatgctatgccagcagactggcatggcttattaacacttataaatgcttagaaaaacctgtattaatttcactatagtatgttgagactttgctaaaaggatgttttaatgtgaaatgagctttgctacaaagttgcaaacaacttaagactctaaacacttttttgaaaataaatctcaacataatgaatatgaaagcctcatgaactataaagcataaaaatcattattattgaagaaagaaatcctaggcttcttagcacaacttaaaataaaaatattgcaattgagaaataaatgctaatgcttggtggtgaggtttttctcctgtctcctcgcctcctttcctttccctccctctctcctgatcttccccttcccctcctttctcccttctctctctggttcctagaatgccttttagaggaaaaacagaccttttcagaaatacattgtcatctgctaaatctccacctactgcaccagccagcctcagcaccctgctaggaggtggctggtcattctttgccgtatcttaccttaagagagcaaaatcaacttgtgatggttcctatctctgaatgctgccctggtttccattagaatatgctggggaagatgacctttcttaatgaaagtaggcagcaccctgctgtgcttttaattaaatgaactaacctttaaaaacgcgattcttagccctgcagcagcatgccacccagcagtctgtccccagtgatggttctgtgagccacctgtgtcatagggaggtaccaggggactgaagattggagtgaggggctttagcatagcgtgatctggactcttggttgttggggccagttctcgtgctttaggttcagggtaacttatcccttatctacccttctagccagagaacacaacacagccattacaagctgacttaagcaaaaagttacccaccagttgcaataggtctacacctattggtcatgctgcccatgaggctatttaatggcactggggagaaatgcatgaagagcatgactcatagtaagtaccgtttgctgatagtaggcaccaactatagattgtcacattcgttagatgatttttttatgaccaactatcactttgttaattacgcctcaaatcacagaggcgtaattaactatcaaagtaatagttggtatcccatcttctctcaacccttctttagggatagcctctgttgagtgtatgtataccctttcacacacatgtataaacatatgtggtgtgtttggaaagataaatacacttaaataggtaccatctgcatgtttacattacgtagtattagattgcatactatattttgctacttggctttttaacatgttgtggatatcttgtcagtagactcaatgtatttcttttttctgaaacagtctcactctgtcgcccaggctggagtgcagtggcgtgatctcggctcactgcaacctccacctcccgggttcaaatgattctcctgcctcagcctcctgagcaactgggattacagccacctgccaccacacccagctaatttaatgcacttcttttgatgactccctgatgattcatgattagaacataacacaactcaaccagctattcctattgattgtcatttaggttgttgccaggtttttttccctattataaataatgttgcaaatagcattctttgtttccttatgtaaatgtatttgtaagatacattgctagaagtggaatttctgagccaggaggtatggttactttacgttttaatagatactgtcagtttgctctgcaaactgtttatactgatgtattacccccagcatcgcatgagttcctctctgcccacattctcaccagtactggggattagaaatcattttgaatcattgccaggatctctgatagacgtaaaatagtatcatcttgtttgaatttgcttttccttaattaggaacaaagctgacccttccatatgcttattagtcagttgttgctttttttcctctataaactgattgtgtatatcttgcgctacttttctggtgagtttatcgtctgtacttaggaatatgtaagttatttgcttattaaggaaattagtaccttactgcacatattacagatattttctccagtttgccatttgattttatggtgtttttactccatagaattttgtattatttttatttgtagttcagatgcagaaattttgccttcctttctcctgaggttgtttcatacctaggccaagatgtataggagtaggttttcttctagaacttgtacatttttgttgttgatgtttgcttttaattcactggacattctggtatgaggagtgagttagatttctggttttctcgtttgcatgttacctgtgggatgttccaatgttgtttgctaagcagtgctctttctttgaagatttgaaataccacctaaatgatcaaatatgctcttctatcaggattcttctcttgatctttttgttcatttctaagccagtttcatactactgttttcatgactgtgatcttacattttagcctgatttaacaattaatacagtgaattgtcctattctttttttccagtatttgttttcctggctagtatcatttgctgcttcttctttgggaactctagaagtatactgttactttcaaactgtcctctactcccttacaagaatgaaaacgaaaatggaacatccaaacctgttaatattttgagtgagattgctttgggtttatagttacttagggagagttgacgtctttacatcctaggttcctgtggtgttattctacttatgtaagccatcttttctctactcagtacagggtggaagttttctttatatagaccctatctatttctttaatttgtatttatgttttagattcttcaatatgaacatttttatgtaaatttaagaaattatttaaaaatgggatttttaaattacacttatttttacctctatatagagaagattattgtttctgtgtattaattttgtaaccaaccacctgtgctaaagcctttgactatttctaatagttgattcttttgcattttctaggtataaaatcgtatcacctgcaaataatgatgatttttccatcttgtttataatacttcaaattgtatttcaacattatagaggcagcagatgggtattctcatcttatggaaacacgctagtctttcaccactgaccatagcttgggtgtggcaatatggtattttatctcaccttcaggtatcttgatgactttccctgttacagacctagttaccccaacagacacatctagctttctttcattacttttacataggctccaagctgacacacaattcttctttaaagaagcagcttcccgaacgttctgtgagccacatctccatctgcacactctcgatgctgccctgtggaggactccctagggtggtgggagtgtcctgtatccgcactgtccactgcagtaaccactggccacttgtggccactgagtgcttgaaatgtggtggacatgactgaggaactgaacttttaatttttttcattttaattaattttcatttaaattgtcatgttattgagcacttaaaatgtagctagtactaccgaggagtgtttacttttgctaattttcattgacatagccccatgtggctggtagctgcagaactgggctgcacgggttcctcgctcattcatggaagggtaagatatgaatgctagaaaggccctggtggccactcattgtgcccagagatgctgagattgggcccacatcacacagcaagttcatgacgaaactgagactgggagcccaggattcttactctctgtctcaagctggtgtcactgtccaaccccttctttactcctcccctcccatttcccttctgtaagttatcaccgaagtcccagtgtgtgcagaccaacgcacagcacagtgagcaggcccgagcctcgcagacaccttccctagtgtgggtccagccaagggctgtgcagttgttgagttttcagccgagctccttcactccacagtgcaaaggttctcgcaagataaaggcagggaggcaaagtcctcggccctttgtcgaggtggaaagcaccctgaggtactgtgttggtgttccaacatcatcaggaaatgcccatcccggttcgaatgtattttccagtgcttctaaaagaagactttctgcatcttctgcatggcagcgggggttgctcctgtccctgagacggctctaaaccttacgagaacccagcctgccgtggtcagggagtggagagaatatagaaagcagagccttcgagaaggccctcagctgaggctccagtgggcaaggaggctttctcggtcatgcaggagccacagccctgcttgcacttcgagttttttctactttagccaactctttctctctttccccagtgagggggttccctgcatcagtccctgggcccctgtgggtctcctcagccttccctcccagtcgttcattcaaaagaagcaggagggaaccacgctacagagactctcggctttttctggagggcaggaaggcctccgcttatactggaggtcacctgttggagcttagaggttaagaaggccgggcacttgagcttcttcctggcactgctgctccctggtagcatggacatgggtgcttcagtttgcccacttgtaggatggggctcataatagccacctcacagggctccggggatggggacgtgagtccacagacagaaagtgccgagagtccactctccacagatgtcagcactgatccacactaagatgtcttctctacctgcttcaagggcaggtgacctccaggaagggccccctctgctcctcggccagaatccttgaggcaggcttatctggggagcttggcctgcatctgcgtagatggactgtgtgggggacccccagactccccttttcacacgtatgtcccacccctgccggggggtggtcagcttgtctgacaccacaggtccccagctccttgaggcagcctgtccggcctgcccagtggcccccatcagagccatccaggcagcgtgtgagtgggtgttgggagcagtgcccttccagtggccggcgaaggcagtgtgcatgcctgaatctgctgccagttgagaagtcagctcctcaggtgggacaaggaccctggccttcctgggaacctgagcagattgcgcagtttccttttctcagcacggctcctgcactggcttacgtaacagcaacaacctgcagagcctgggctccggggctcattcccagacagtgaagtctatgatgaatagatgggtctgtacactcttagcagagagccagtaatttgctcaaaggtcaaacttagcttgattcagaacacaaaattactaggattctattctttctgcgggtgttgcttctgtatttttcatggtcaaggaaaagctgtgaagcactttcttagggcttaagagctaagggatttttcctccttttttgatgaccctcttttccagcatctcagcacacccccagatgggaagaggctatgatgaatttctcccaccatttatgccacacccactctgtgcccagttactagagcaagtggtttccaggtgtgtgtgtaaggaaatgctcttagtgcatttgttctgtgtcaggcactgttttccatagtgtttgtccagtgccaggtgctgctgtaagtatggcactgcctagaagtgtgaatgcatttcatcctcacataaaccctgtgaagcagatactatgactgtccccattttatggatggagtcactgaggcatctggaggtgaagtaacttgcccatgttgcacagctaagttggaggagggggcaaggtttgaacccaggccatcttattccagagttagcattcttaaccactacccatgctgcctgtccaccctggtcccccatttcgtttgccacccaggatccctgtgaggtatgcgcttgttacgattccattttacagtgaagacacggaggcctggcgagtttgtatgggggccagtgcctgcttgggattccgatgcaacacctgcaggtctgactcctaacactgatctctgctgtgcacctggcccattggtcattgttatttctgagcacctggactgtgccttattcagtgctcctcacattacgactgtcaaatgcaagtaactgacttaggggcctgaggctcccctaaatgggtaccttgccacccttcgttttgttgttgttgttgttcttgttttgagatggagtctccctctgttgccaggctggagtgcagtggcgcgatcttggctcaatgcaacctccgcctcctgggttcaagcgattctcctgtcccaacctctggagtaactgggagtacaggcatgtgctaccacacccagctaatgcttgtatttttagtagaggtggggtttcaccatgttggccaggatggtctcaatctcttgaccccgtgatccacccacttcggcctcccagagtgctgggattacaggcatgagccaccgcgcccggcccacccttcttttgtgaaacattctcatttttttcagctatgtccctgactacagattattacatatttccatgtgcttgtttactggttctgtttcctcctgtgaattgactgttcatatcctttgcccattcagctctcagattgtttattttacgcagatctgctttctaactcaagggtcacgacaggaactcctctaatataatccatcatcatgtaacatttttgtcccctttctgttttgcaacaactctgaaaataatgacttgcctatactgctaaataagagggtaagaatccatgccccacgcctccagccccagaataaaaaacaagtggaaactaacgatttttttcttacacgtattatagaatttctaagtctgtctggagcagtgggcacccaggcatagaccacttctttagactgagcacctgctctttgagggcagggactgtacctggttccattttccagatatttttccacttgtttatttcctaaacctttttcctactccggaaaccatgcatatcctttccccatgcatcagctggcccagcagccacagcctcagcccgacctcccaacaccttgaggtccagcttctcagtctctggcaggctggcacgtctgctatcagcaggcacaggtgttccgagccaggctgccccatgcccccttctgtgactaagagacaggccaagtgggtccatgcataagagctcttcagtaaatgcaaaaggtggcaggtgtgctagccttatttggcatcgtttcataatgttgtgaaagggtggcacttctgcctgtgtcatataagccaagtctttttcataaagatgtaatgatttgataattggtaatgatgtattgagaaggttggaggaggatgagccttgcatatggtgagaacagttgtgcctattctagcagctccaggcactctgtaacctgtggttgggtgagggctagtggtattatgttgaaacacatgaaattgccaatacttgaacatttttgatgaaaagtattggtgcttcactatagtgttcccctctgtgatcaggtttttcctgtaagactattttataatgagcttctccataactaaagcaagattgggaacatcataaaagatcctagtctatataaactcagggtcaaatgttattgtaatctagatgagaaggatttaactcatgtcagagcaaaggcaggcaaatagtaatttttaatactgcactgcattgacacataaccactgtcctcatgggtcttctgtactgaagccctcatgggtacccagagtccagctccccatcctctttccttcagttcccacatgcgcttagaagaaccagcactgtggtcctttaccatgtcctcctggtgctccaattaagtaaagccattgaggttttcctgtagttgtagattgatatctctgagttaatcacgagagaacatagacatcatataggaaaatctggccagaaacaagacagcctcagccaagaaatgttttttcttggaatcggaaaacacaagaaacagatgattgggttctgttcacgtttgaggggaacgtaaatcatcatgggtttattcataaatgattatcctcttatagactggagtcccggcgtagagtaaaggcaggcatgtagacggctccgggaagggggcctcagggaaggaggtcagggatttgtgagggtaaaaactgcccatgatattactttgccatctaatcctagtgctgggaaaatgggactttgctcccctctgcttgaactgtaatcacctcctgaccagtgtttatgttcagaagaacagcagcccagccctgatccttggggtttatcgaagctttttttagcccagtcagtcagaagacagtgccaaaagggtgtgggcgtgtggcggacgccattatcagggactcatgagagctgtgctgttccaggagtgtgtctgagcccagcatggcattgcacgcagaccagggcagagggtggccttgatgccaggtgcccaggtgggctgtgaggctgagcgctgcccgttcctttccagaatggaaattcagacactggagtgcacttgcgtagttttctcaggttttctggctccccatcatttttctttcgtctgtctaagcccaagcacagggagttttgataagacagatctgaaatgctggcagggtgcaagggaggggaacgcttctttatttcatttggtggcacctttccccccagctttcttaaggcatgactgacaaattgaactgcatgtatttgaggtgtgcatgtgatctgcagtggtggataccaagaaatgactgccacagtcaagttggggaacacgtcttgatggcactttttagagctgaaatcccggtcatgttgtagtttgctatgtgaccacctacattctaatttgggtggggcagggagaattggtgcatcgagatgatggccaggttccctggacctgtgtaaaataatggacatttacgtattagcgcaacatatggatccaccatgcgagaatctcagagtcctttatctagataaatttaatcatcgaattagaacccagtggcagtttaagagacttaatgtgagctctatttagtcttaaaatagttgcactcaaagctcagctttaattttcctccactttattctgatcctccagggtttctcatgtcccacaggatagaaggtgtccctagcgtggctggttggacccttcccatctgccaccgtgctgtttgaatacatcgtgttcccccccagggcccatgcttgccttctcctggagcagttttcacccagaaagccatggctcaccttggttaggtcttggctcctcactttgcaggaaactgtccctggctacctgaccccatcccctgctcttctgtcctcagcctactttgtttttttctctgtgcccctcccttatgtccagagggcacactgtgttgtactgattacagattgtccatcttttcctatcagaatgtggacagcatgtgggcaggggtttcattttgttcacggctacattatcagctcctagaactgtgcctggtatatagtaggtgcataaatacgtatttagcataagctgggcagtgttcagggagtgaggactggatcggggatctgtcttgattccatgccctccacgaggaaaataatttttgtgtgtcctgtcaggtttcttcttcagaacactacagaggcctcgctgtgcacggatcataagggcttttattccataagcaaacccttcttaggacctcccagatgaagacataaaatattgctgtgccccaggatttctagaccatccaaatcaagtattcagagcactccaatatacagctataattctgtagataaacttaatatttcaactatgacatagctgtgtgtatccatgagattccacgcttctcagatataggaagcctgtcttctagtcctcttgtaatctcatcctgaagccctgcactcaggggccatcaaggatctgacagatcagcctttctcagtccctggccccagcagggggaaatgctgtgtaaaaaaagcacagcatcctggaatgtcagacccagtaagggcaccaggtgctgagcaggtgctgggatgggaggaggatgaaaaaatatatgtcaggataatgtggagaaaacactcacttcaggagatgcagtgtagaaaggaaattcaggacagtttttttgcctgtaggtctccagttcttattaccttctagatcagagtaataaagttagtatcctatgaggtgtgctcattatatattcatttatgtattcatttgttcattcaacaaatatttattgaattgttctggcaatgtacctggacccaggggaaaacaaagcaatatctttgctctcgtggagtgcacattttcatgggagagacagatactatttttttagtttattagattgcgattgctgctggaattaagcacatgggggctgtggtaaacaataatgggaggtgctgatgggccctggagggccgctctgaggatatgatttttaaactcagctcagaagggggtggtctggacctctctggtaaggtccaggcagaggaaatggttggcacaagggcctctggcagacagactgtggtgtgctaacacaggaagccagtgtgaacagaaggtaatgatcaaagggaaatgggtattgaagaatattcagtagtcttctgcatcaatcagggttctccagggaaacagaaccaataggatagacatagcggtagatgtgtatatagatatataaagaaatttatcatgaggatgtggcttacataattatggaggctgagaagtcccacagtctgccatctgcaggctggagacttgagactggctagtccaaaggcctgagaaccacggcagctggtggtataaatcccagcccgagggtgggagaagatgagatgagctgtcccagctcaggcaggcgggcaggaaaagggggcagactccccccttttgttctcctgccttttgttctcttcaggcccccagcagattagatgatgcccacccacattgggaagggcagtctaccttgtagagtccaccaattcaaatgctgatctcatccagaaacacccgcacaggtacttccagagataatgctcagtctgcacacaccggggccagtttgacacacgcaattaaccaccacatcttctgaactgctctaaatcttctcttattttttcaacgatcatgtccttttccaggaaaattagcatcctttacctatatctccttcttaaaactttaattaccaatcctgtaaagatagtagtaagatcagagtttaaaaagccttccagttttagcactttgctatccacaaagctttttcacaactgaagcctaatgaaaagcagtgggagaccccatttaatggatctacaattaaatatgttcttcttgatcctttgtatgatccaaagtatgaatacaatctttattatgctttgatttttttctttactaaacttttaaaaattgtggtaaaatgcacataacttaaaatttaccatctttacatgtacagttcagaggtattaaatattaaatatattcacattgttgtgtagcacatctccagaacacttttcatcttgtacaactgaaactctgtatccgtcaaacatcaactccccattttctcttccctcagcccctggcaaccaccattctactttctgtgtctatgaatttgactactttaggtttctaagtatttgttttttcatgactggcttacctcacttagcataatgtcctgaaggttcatctatattgtacatgtttcaaaatttccttcctttttaaggttgaataatattctactgtatggatggactacattttgtttattcattttcccattgatctacactggggttgctgccatcttggctattttgaaggatgctgctgtggacatgattgagcatatctcgtcaggaccctgctttcaattcttttagatacatacacagaggtggaattgctggatcatgtggtaattctattttcaattttttgaggagctgccattccgttctgcacagtggctacaccattttacattttcatcaatagtgcacaacagttctgatttctctacctccttgccaactcttgttattttctgtttttgatactagccatcctaatggctatgaggtataatcaataaaaagctatacttttctaattgaagtataacatacatacagaaaaatacacaaatcaaaaccttgctgaaattttacaaaataaacacacccatatcaggtcaagaaatagaacaatgccagcacacctggaagcatccttcatgtccctccccagctattactcaccagtcaccaccatggcccaccaagttacccaccatgctgacctccatcaccatagaggagttttgcttgtctggaactttatataagtggaagcatgtttttcatcatttgtgtcttgtttcttttgttcaacattatgtttatgaaatgcttattgactacagcgttctccagagaaatagaaccaataggatgtatatgtatatagggaaaagtttgttttaagaaattggctcatacaattatagtgactggcaagtccaaaatctccagggtgggttgacaggctggagacccaggaatgaactgatgttacagttcaagtgtaaaggatttctgctgcagattccttctttcttggggtaggctagtctttttgttccgttaaggcctttaactgattggatgagctccctgccaatatactttactcagagttcactaatctaaatgttaatcgcatctcaaaacacctgcacagaaacatccagaataatgtttgtccatatatctggtatctgggcaccatggcccagccaagttcacacataaaattaaccattatacatgtcatagtagttcacttttattgttgtttctattctgtggtgtgaatatatcacatttccatttgacttttccagttgggagtattatgataatgctgcagtaacaatctcctacatgtattttaacatatatatattcacttttccttggttatagtacagtattcttttttatgactctggctttgttttactattattttcattttgtaattttatgtttatgttcatgaaagatataggctgatcacttttcttttttataatatttttctcaggtttcaggatcaaggttatgctaaaagcataaaataagtagaaagggcccctccttttgtttcctgtattgaagagttgatgtaggattcatattatttcttaagtgtttgggagatttcactgataaagatatctgggtgtagagttttcttttgagaatgtttttaattaaatattcagttttataaatagatatagaaccaattgattttctcttctgtcatttttgtaagttgtatttttctaggaagtagtccattttacttaaaatcttaaatatattggcataatatttatataggctttctaatatctgtaggacctgtagttatgtttcctttttcaatcctggtagtgacaatttgtgctcttttcttcatcagtcctgtcagaggtttattaaatgtattaatattttgaaaagtcaacatttgacttaatttctgtttttttgttttctgtttcagtgttttccactttttttcttctacttttttttttatttttttaaacggagtttcactcttgttgctcaggctggagtgcaatggtgcgatctcaactcactgcaacctctgtctcctgggttcaagcaattctcctgcctcagcctcccaagtagcttggaatacaggagcctgccaccatgcctggctaattttttgtatttttagtagagacagggtttcgccatgttggccaggctggtcatgaactcctgatcttaagtgatccacccatctcggcctcccaaagtgctggggttacaggtgtgagccactgcgcctgtccttttctccttctactttctttaatctcttgttctgttttcttgctttttaagatcaatatgtaaatcattaatttttagtcttcttatcccatatattcacataagactagaaatttacctctaagtatggcttttgctgcatcttacaagttttgatatgtcatatccttattattttccaattcaggatattttctgatttccagtataatttcttcattgatctgtagattgtttagaaatgtatcactttgttcataaacatttggggttttttttttaatgttattgattcctagagtaattccattatgtgatcagaaaacactctcagtcctttgacattttttcagacttgctttgtagctcaacagtaagtcggttttgataagtgtttcatgtgcacttgaaaaaatatgccttcttaacaacaacatatatagatgcagtcatgtaacaacaacgtatatagacagttgggttaagtttgttattcgtattgtttatgtcatctatggccttactgaatttcgtctattcttatcagtggctgagagaagtgtgttaaaatttcccaccatgatttggatttgctgatttctcctttttgtcctgctagcttttccttcatatagatttgaggctatattattggatatatacagatttaggattgttgtatcagcctggcaaattgacccttttttattattaaatgtccatcttttttgctagtaatgcttcttgtcttaaagtctattttgcatgatgtgccagctcttgtttggttagtatttttatagcacatttttccatccttctatttcctgtcatcttactgtttgttttctgtttgttctacttgttctatattccttttctttcttatcttcctttgaattatgttttttttttttttttttttttgagatggagtctcgctctgtcacccaggctggagtgcagtggcacaatctcggctcactgcaagctccgcctcctgggttcacaccattctcctgcctcagcctcccgagtagctgggactacaggtgcccgccaccatgcccggctaattttttgtgtttttagtggagacgggatttcaccgtgttagccaggatggtcttgatctcctgaccttgtgatccgcccacctcggcctccgaaagtgctgggattacaggtgtgagccactgcgcctggcctgaattatgtatttttaaaaattgtttcattttccccctctactaacttgcctgttagacattactgttcttttagtggttattctagatattacaaaatgcatccttgacttattttattaaggtctaatatgaatttaaaattaaagctgatatcttagcatgtgctgcttctgtagctaatgacattagcattattctaagaatgcttataaatgtgtttcttttttgtataacaaaatggcccttaaaggcctcttagagctgttaatgttataaataatcaccaaagtaagtgattattaccttaaatacattaaaagagtgaagttgaaatcttaatctttagaaattattcaacttttttgaaattctgttactaattctcctaaaaaaattttgttttaaacaagaatgatttataaattatttttcataataaactacactgtttgtggaaactgaacattgcccttggagcaggcagaagtaatatccattaaatgcatagcaaaacatgaccctcagataatttttgttttcagtttctaatgccacagatttacatgaagcgattaaggacgggtggttagtgtatatttaattttgttatttggattcaggatgctcttatgaatcctctggtgaaagtcagaaagcagaattatgggtacaggttgattttcaaaaagactttgtcaccaggcaagcaggtacacgcttctgcaatggtttgaggaaggtattatcttttcagtttttacctcctttggactgacgtcctctgtgtcctttgtagttttccccctggctgtccctaattacaccatctcatctagcaatttgatgaaaacctcaataggtgttactatcaacaggattatatttcacagtggaatgtaattttccactgcagtcagtgatggaagaagagtggtcagtaagagaaaaccttttttgcaagagggatgtatttgaggatttattcacaagaacgaactatcattatgaagttttatttttgcaaggtacaattttttttttaaccatggtgacatctgttttcttagatgtggtagaaacattcaaaaagagaaatactctggtgttggaaggcttatttttcatcatcattttgctttgaagttgtttggtgaatgcattctgaatgagacagtttggctatttctagcacaattgagtttctgatttccctttggattcttaatatcttttgagggccagggagggatattaatagagattacttgaaataagctgtgagatttttctgcgtctagaatacaggcaacaaattgttgcacgatgacagcagcaggctgtgattgttccaggctgtccttggccagtcctatcttcaggaatccaagtaggagcaggaacaaccattcccttattccattcaggaggaggctcaaagaaaagttgttccaagttaattgggagtaaacagaaactcatagttagactttatgattataatcaataacaaatatgtgtgtatgtgtgtgtaataataaattgtgtgtgtgtgtatgtgtgtgtgtgtgatataggagggtgtagttttttcagtggtcagccttcaggtctctgcagtggctgatatggtcatggggtctctaacttgtggttaactttgtcaactcatagcaattcaaagcaaaattgaggctatctctatcagtgtgctagggcagctctaacataataccacagattgggggcttaaacgacagaccttttttctctcacagttctggaggctggaagtccgagatcatggtgccggcagctttggctcctcctgaggcctctctccttggcttgtagacggctgccttctccctgtgtcctcacatggtcttccctctgtgcacgcacatgcctagtgtccctttatgtgtccacattctctcctcttacaaagacaccgatcagattagattggggccccaccctcatgacctcattttaacttaattgcctctttaaaggccctatctccagctgaggtgggtggatcacctgaggccaggcgtttgagaccagcctgaccaacatggtgaaaccctgtctctactaaaaatacaaaattagccaggcatggtggcacctaactgtaatcccagctacttgggaggctgaggaaggagaatcgctgaacccaggaggcagaggttgcagtgagctgagattgcaccactgcactctagcctgggcgacaagagtgaaactgtctcaaaaaaaaaaaaaaaaaaaggccctatcgccaactgtgtagtccagttctacggtactgatggttagggcttcaacacataaacttgtggggagtgaaggacatgaacatagttcagtccataatgctgttagagccagctgagctctctcagttatattcagagtgtctgcaggaatttattagccaacactgttgttcctaaaacaaccagcaagaggctctctctctctctctgacactctttagaatggcatcagcctccatctccacaccgcacagccaacccagcagccagtcctgggtgcctcttcagatgatgttctgggctcctctgctttttaccctccctctctcacccctgtctaaaccagtgtcctcccctgcctgtgttatcgcggaagcctccccattcttgcttccctcttgtcactctggagctctgcctctcaatggagcagccagtggtgttttgaaaacatgaatcaaacctggccactctcttgctctgagtcctctgagcacatttagcgcgggctccagatgcttgcctgggcatgtgaggacgtggcccgctctgccctctccagattcagctcctcctcgcgtctccaataccacagctgggctactctggccttgctgctactgctcccatgtgccaagtgtggtcccttcctcaaagcctggaattcccggaaggttcttcccccagatacccacatggcttactccctcactcctcccaggtcgctgcccagatgctccttcctcagaaatgtcttcccgagcccctagctaagcgagcgcaccattccccccaccccagaccatctgtcctcaaagtgtcttcatagcactggtcactccccaacatcagggtatataattgcctgttgtctgtgtttgctagaacgtcagcttcacgaaggcttttgtctcatttaccactaggtgcccagtaccttaggagcttggaagttcttagtacctaagaatagcacttgcttcatgaatatgtattaaattgataaatgacattctgtggctcaagtgagtccgtggtgtcaaaggttatgctgggcagactgcctttggtaatgagcatagacccctctttaggtccaaagcaacccccgggagaaacttgcatcttcccctacctcgtgcccagaatacaccttgccttggatgatgagttgagaagctacccacaagggtagatgactcgtctggcttgaaagagatcggccctgttggcattttgatagcaaatttagagttgggaggtcactaacaaggctagtccccaattctgcgacctaaatggagaggcagttgctttgcaagagtactgtagagcccgtgggagacacgcttctcagcctgccttttggtccacatgtaggccagccacttcctgggctgcctttttttcaaagatttttttcatgaataacggtattaaaactttcatgcaaagtgccctgatagtgtgtaatatttttagggcctgtaggcaatggaggctttacatttttagtgattttttttcctcatatacactggcattgaccctgggaatgatggctgtttttcttttaggcttgcttgactgccataaccagagacgtggagcaggggatttattctgtttcctcctcctccttcttcttcctcttattcctcatctttgatttgagggggcttttcaggtatgagggcagaggggcatgaataatacttcctcagactgaaagggtctttgggggcaacagcaattcatttttcagctctctgagatactcattttgttttgtttttgaatactccttaacttgtagtcttcctttctctacccagtctgagaactgcctaagcagaggcagtttggaccctacaaacagcgtcttgatttggctgggatgttggaatagggattggaccctagaaacagcatcttgatttggttgggacgttggaatagggatctttccattctaagaccttaaaaaaaaaagttattagagaagtgaaaacattttagttatttagactttccagtctagaaggcattttcagtggttttccctgtagagactaaggcatctctgagacaacggtgggtccatctccacaaggacttagaactcccgactcgtgacttctgggtggttctcctagtgcttgtctaaagaacatttttgagcttttggcctaaaactctcttcttccttctcacccctccttttccatagacctcccctgtgttgcctgcctgcctgtgctttgccttgatttacagcatccatgtgcatacgtaggtgcacgagacagccaggtgctagaaagtttgcaaggccaggagggatatcacagggtcctggatttgggtcccttcttcgtgcaagcaccagccagacacttgacctctctaggaaggattccttcatctatagagtggggcggagatcatggtgagccatgcacaaaggtgaggaactgtagagaaagcatccgggagccaagtcagcccttcacaggtgtctgtctgtgcaggcagtcaccacacccatctctccacccagcttcagctccaaggagcctgcctggcctgcttttgcaaacactgtctccagctgcttcgggttgcagcatctcattcctgaaacccggaggacgtgactggataatagccgggcaagtgagctgtggtgatattttaacacaggcctgatctgatcattcctcactcattcaaccctaggcaagcctggattcatactttccatggccacccgtgccagccagtttccatatcagccagggcctcaggaaggtggaaggacacactgtcattctttccatttgcgctgaccctgcctactatcaggcctgaatgccagcaggtttagctaaagaaagttgcaactgctgaccaggctgtgcaggccggcctctgtctctagcatacccgggggtagataagatggttcctgatgctctaaagctgggcttgacttcccaggaaagtaaatcaaacagggcctcttccattctcactgggaatccttggttgggctcttttttattttgaaccattgaaatatttgtgcagacacggtgggtctgaaagtaatgcactgtgacactttcccctctgttctctgacaccgggtgttagtgggagaatcagacggatagtaatttccctgtggattctcagcagccctaggagataggttagcagtggttatttctattttacagagtggaaaggcaattttaaagaaaaaaatattcttctgctcaaggtcacaactgcaaaccagtggcctggctcatggctctggacctgccaacctgtcgctctcctcttctgaggactgggttgtggctggtactgtgtttcagttttagaaaatgtaatttgaaggaaatgggagactggggtctattttgagactctcgaataattcattttactctattttctataaagcctaagagtgattcattagcaagcataagtaatgtctgagtgatgcaactgtactaggttaggttttgggacctggttgttgaattggtcatgaacatttgtcacatacatgcattgagtcatacattgctagagatggaaggcagcttagtaatcatttagtccagtgggtcccaaatctagctgtttatcagaatcacctatagagcttattaaaaattcagatgccctggtgctacccaaggcctggggtcaaagatctggaccctttatctttaacattgcatttttggggggtgggactctcgctgtgtcacccaggctggagtgcagtggcgcaatctcagctcactgcagcctctgcctaccaggcccaagtgatcttctcaccccagcctccagcctcccaagtagctgggactacaggcatgcaccaccgtacctggctaattttttgtatttttggtagaaactaggttttgccatgttgcccaggttggtctcatactcctgagctcaagtgatctgcccacctcagcctcccaaggtgctaggattacaggcatgagccaccgcgcccggccataacatcgcatttttaacaactcttccaagcagttcctaaacaactggcctaaaaacctttgagggaccccacatttgagaatcactggatgcaagtccttttttttgttggcttgtttttgtttgtctgtttgttgtatgtgttgttattcaggtgaggaaccaggggcccaaagggtagatgaccttgcctggagtcacacaaatctgtcactgttggagtcgggatgggaaacccagctacgctcttcccaggcatggtgtgaccacagcccaaccgagtggccaggaggacccactctgttgggcgctgtatttagagcaaccgagaccacttctggtaacacttggtaacatgccctgcactcttggaaaggcactcttgtcagggcgggtgtcttagagaacccacaaagttcaggagattcttccagagcccttagcaaagggccatctgcaaagcctctcttcctccctgggcaggtccattcccccagggcccagagtggggccaccaagaccagagcagacaccaggaattgaccctggtctggaactagtctgtctgttctgatctgccgccctgtgacaatcacctgcctgggaaccctgctcacagatgaccaggcccagtggagagatgataagaataggtagtttgttctgatgcagattcctaggggatctggctgatgctggctgatggctgcttacagcaggagacctcaagtttctcaatctaatgttcttagttctgcatcaaacagatgggtttattttctggatcctgtctattcacggaactcatttaatatggagggcgttatgatgtcctgcctcatctgctactcaagctatatatttgcaggtgaggggagaagaatcataaggtaagctctcagagatacgagggtcaaggagaatataagatcttacattccctaacgcacctcttgctcttttgtgtttttgcatgtggccttcatgctggttgtcctctggactgtgtgaccttggtgccctcagtttcctcatcttattggtccctgtacttctaatagtcagtgggctgacagtccacacccctctgcagggctccagacctggctgtctgactttccagcaggctgtcccctcggtcatgccgcagacttttcacactgtgtccgaagctgagccttgatctgttcctgaacttgctgcccctcttttgtcctctcccatccactccactgtttgtgctagaaagtggggagatattgttggcaccttccctctcactcctacatattagccaaaggttttatagatttcacacctaagcagtgatgtttcagcctgcttccactctcccgtgctcaggataactgccttggttcagtcactttcatgtaacactcctgcctggagtacgcagcagctcctacctggtattctgattcctctccggcactcttcagtggccctctagtgctccctgagtgatcttttgtttgtttgtttgtttgtttttgagacagggtctggctctgtcactcaggctggaatgcagtggcatgatcacagctcactgtagcctctaccacctggactcaagtgatcctcccacctcagcctcccaagtagctgggactacaggcgcacaccaccatgcctgaccaatttttgtatttttttgtagagacagggtttcaccatgttgcccaggctgatctcaaactcctgggctcaaaggatccacccacctccacctctcaaagtgctgggattataggcacgtgccaccatgactggcccaagcgatttttctaaaaacctatgtatgtcatcatctcactatcctgtttctagatactcttcagtacttatctgttgttcataaggtaatgttcaaaatccttactttgtgaataaggcctctcatttggaccctgttgtgtctcagctcttgcttctccctcactcagctcattagtgcagtggtgctcaactacctgaggttcccaggacacagggcaccgtaggatggaaactgcagttgcctccgcctgggatgccccagacctcttctccatggagctgacccctgccggccttctgatggccttttctcagtagagggtgactctgttcccaactaatctctgatgttctggaatgaagaaacaattttagtattgccagctcctagcacagtcattgccatgttatatgtgatcaatacatgtttgatgagtgaatgaatgagttagcagctcctttagaaaccaagtcctataattgaaccaaagacaaagtattatccattagctatctttggattttcttccacctgcttgtttgtgttataatattgatgtgattagcatagatttcttgctgagcggtgattagagtctcagtaaactccatccagtttaaactttgaaacattcacagacattgaccaaaatgttcagacttctccagtgctagtacattgttttcaacctcctgtgacttatttcttctaaagactacttgctggctgatttgcgttttatttttaatattcatcattcttcctgtgtgcacacaagacaatcaaagactgatttaaagtaaagggaaaaataccatcaagcctggaacgtgtcacagccacccaccccacacttgggtttgtgtccgagttggacagtgtccctggggctctttttctcttgtcctgggttcctctggaagctgtccagatccctgccgttggaggggccccaactcttattgccagaaaagaacagctcgggtagaggacacagcctccagagaggggtggtgcaggtacgaacctgcagagctctgtgacttgtttattgcacttatctgacaaaggtaatgcaaaaccctgtgcttttattgggaaatagaaggaggaacttgttggacaattatggaatcagagaatgatgtcactgggtggttccttagggatcatctaaggtaaactacattgttgagctgttgggtatgaataaaaattttccacaagctttcctgcatttcttcccctccagtcaccatattatagggcacagcagttttggagaattccacaggaccctggctcactcagagttaaggatcccatgcagtgtgatggaaggaacccagactctagtgctagacagacctaagttgggcctgtccaaattctttgagtttatttcctcatttgtaaaataatgcctacctcagggctgtcctgaggattaaatgacaccttttggggtcactagtggtcccttaacacaccgctgtctcgtctcttcttctgaggttcagctacaggagctcattttgcacgtgtcgttgctgttaatggaactgcgcttaggaagtccagtcaccaatcttcctatgttaaatgccttttgaaaaacactttcacctggcacggtggcacacacctgtaaccccagttgcttgggaggctgaggtgggcagattgtttgagcccgggaggttgaggctgcagtgagccatgatcgtaacactgcactccaacctgggtgacagagtgagagcttgtctctaaaaatatacatctaaatgaaataaaaaacactttaactttgcataagcttctttctcacccctagtcatcaattctccgggctgtaggtttgacctcctttcagtgggctcgccttgagaataagaccgtctcagccatagtgcttggcatacgctagaagctcagtaagtaggagaggcaagagggaaggaggaagagaaggaggaaaggagggaagtgggaaatgctgctactagcaaatgagcatagccgctccagatggggagaaggtgaactgtgtttgtgctcccatggagccctgtgatgcacactgtgcaggctcggatcctgaagaaaggccaggtagctgtgcagacagaggctcctgaccacatcctctgagaaaccccaggaccagatgtggtagagagtgacccacgggtgctgttcgcaaacatttgatgtagatgaactagttttagcagatgccctcacattttgcagttgtgagtttcctcccatttcttcttgattcccatctgcccgtgcagttctgcctccatcagccatgcgttgacatttaggtgattaacacttgatgccgtaaccattgtccatgttttattcataatttgacgctaaaacctgaaaagttgtcagtacggtttatgctaatacagctataaaaatgttcttcgatgccagctaagcagctggtgaggattacgttccttctgagtaggtctagcttctgacgcgggaggcacccgaggagaacgtgctcagccgcggaagcagacagacactccgtgtttacactcaaacaactgctgaaaatcatttcatgtcacgttttacttcatatttggatctgactttcttgaatggcatttttatttttcttagagtttgtattatctttttttgacgcattgtgtgctttatcagatcctcaagttcttgtatcttctcagttatgacaaacattctattattcacgtttcctattctggactggcttttcccaggacctgaggctgatctaccttctgggggctcttcttcgctctgtccctaagttgggtctagtgcatcctaaatctcatgtctttctcctttatggtttatgccatcattttgctggactacatttatattttctcccctagaaaagagaatgaaaagtcagttgtctgatttcttgaaaatatacgtagtatctcaccctcacgcttgattgatagcttatctgcaggtagacttctccagtggacattgtttctcagaacttctaggaaagctcattggcttatagtgtccaatttagctgatgcaaagactgatgtcagtccaacttccactcccttgcaaatgactgattttttgtctctcttgaaacatccttctttgtcttggatattctgaaatgctttgtggatgtgtcttcacatgggtctgtattcatagtaggcttcatttggtgagtcccttccattggaaaattcatcttctttagaacctgaggatttttgtagcgttccttaagctctgccctttgatttctgttctttctgggcctcctagtaatgctgggcctcctaaataggaactctgtatgtcttatattttcctcctttatatgttttcatgacacgtataattttgacggttttctaattagaaaagcaatgtatattgtaacagcgacaacaaaaattacaagtaggcatgattataaaatgaagcaaggccttggaggaggcaggaagatgcagaattgagggaacaaaagatggcattatctttgggaggaagaggaatgctccttattgacataccagagaaaggaccaagaaagagtccagatgcaggaacatgttgtagcacacaggggagcagtgaactcgagtcacttggccttgctagttttataaagtggaagttgaggtcacctacttagactgaagacttggggtcataagaaggtgtgaaacatgtacagaggaaaaaagtggtgactggcagtttgacccagagccttgaagacctatctgcatttgtagtgggaccagttggcctggttttgtaatgttcgattattggaacctatgagcaggagcagggttgaaatttggcaaggcaagcatggtaacaggacattgatgagggaactcagtgaaggcaaaatatttccatcagtgatggttaatacaaaagattagctaaataatcctttttccatgtttgtgacttagtctgtctgtgtctccctgccccattcaccattaccatgccaaaatgtgtcccaagaagaaccgagaaaaaaaggatgttgggaacttttggtcccagaatggtctctgctaaaaatctatccatttacatcaagtcagttttcaaaaagcatcctttgatcactgttgtaaaaccaacatttcacccaagagaataatttcatcttgcatgcagaatttttagctgacatttgcttggatctaggaggagagtccagataagccaaggatatggtttggctctgtgtccccatccaaatctcatgttgaattgtaatccccagtgttgggcctggtgggaggtgactggatcatgggggtagattccccccttgctattcttgtgataatgagttcttttgagatctggttgtttaagagtgtatagcatctcccctttcactgtctctctcctgctgtcatgtgaagacatgcttgcttctcttttgcccttctgccatgattatacatttcctgagacctttccagccatgcttcctgtacagcctgtggaaccgtgagtccattcaacctcttttcttcataaattacccagtcttgggtagttctttgtagcagtgtgagaccggactaatacagccaaattcaccctttttcatggactttagaatgttgagactggaagaaaccttagagatggtcaagctcagtggttttgaaacagtttcattttattttgttgttgttgttctgaatgtcagatctttataagtgaattctttcactgaactccaacacataaaacagcaaagtggagcagcccctcatgaagtaggggtccaccctggggccccctgattagctcctagtcaccccctgtgccacctccaccagccccaggatgtcccttattttacagttaatggaactgagccagaaagagggcacatggtgtcggagctacaggcgcctccagtattctgtgatcttctgcctgccactggagaagcagtgggtccgggacccaaaaggcatgtggatgagtccagccctcggacaacctagtcctcattgggcagagggagccatctcctggaatttttaattcgaggactttttaccttgacctcttgcgaaatccctgggccatagtgggttaactgtttgtattctggtcccactgattttctgtgtttgcttcagagaaggtgaaggtgaattctgcagattttccatcctaccgtctttggaacaactgggtactgtgtctccttaatgataaaagggagctcttcttgaaataggatgatcattttccacagtttcttggtaaaccaattacactagtggtgattaaattaggtctttgataggcatgcaagtaaaagcatttgttgtaatttacaacaataagtaaattgtctaaatggttttaatatcattaaaaatttttatctggcaggcacagtggctcacacctgtaatcccagcactttgggaggccgaggcgagagggttgcttgagcccaggagttcgagaccagcctgagcaacatgctgaaaccccatattcacaaaaaattagccaggcatggtggcacacacctgtagtcccagctactcaggaggctgaggtgggaggatcacccgagcctgggaagtaacactacagtgagccatgtttgtaccactgcaccccagctggggcaacagagtgagaccctgtctcaaaaaaaattttatctgtattctgtgtacagttctaatttaaaacaaactgattgacactgttagggaaatttgctctctttaattaaaaatacattaatattttaacacaatacttctgttgaagaggtagatacaagtttaaattttgtaaaatgtatttaattgattttaagtggtaactttttttcaggataattttgcaagtatgtcagaaaactaaataatgtgacaaatttaaacatgttacatttattttatttatgtatttatttatttttggagatggagtttcgctcttgttgcccaggctggagtgcaatggtacgatctcggctcaccacaacctccgcctcccgggttcaagtgattctcctgcctcagcctctcgagtagctgggattataggcatgcatcaccatgcccggctaattttgtatttttagtagagatgaggtttctccatgttggtcaggctggtctcgaactcccgacttcaggtgatctgcctgcctcggcctcccaaagtgctgggattacagggttgagccaccacacctggccacatgtttcatttgtttataaaggaactcccctctaagaacagatcctttttactcttcttcatcatggttaatttttgtgaatttttgttaaagtttgcaacttgcttgagtcaatgattggggaaagaattttttaaaaaatatattttatcctaagtcatgtaaatttctataaaaaaaggatattctagcactgtgctaaaagcagtttgtagctcttttaaattgtatttggagcaagttcacttgagaaaattagatgtggattctggtcacattctatttttggtttatcgtagtgttactgggttgattgtgcacttcatgtatcatattttggttttgagtgttccaaaaaaaaaaaaaaaagagtccactatcatcacaagacagagatgtatcagcagaaaaaagtgttctagatgaaggcaaaaagagttttgagccactcagcatggatatgtggaaaacatgctccacgtgtttcagtggtagaccactaattcaagacgtcagtcatgctgctttataatcttaactcatattgcctaagaggttgtcatttacatcctgttcttaggatgttttttccatatttaccagacctcttacaccactggtaagtaacgaaagctatatgcagaagcaaatcactctagtctttttgagaatccttgtgcttaaaaagctccttctttcttttttcttaattattattcccttacttgtctagttctcttattttctccagatcatattttacctataacagtttttaacctctacatctttagaaaggaaaggccctttttcactatctagaattttctagactggatggtttttaaaaaaaatctctacagttactacacttattgaacactgcatttatatagggatttagggtccttcagctaccccagggagcttgggcctgggccctcccgtctgtccttcaactttagtctgtagttgggctgtgccaccagcttccagaagaagccatgggcaggcccaccactaccttcacctcccttcctccagcccctttgcctctaccaaaccccacccgaagccccttgagtggatcttgtgagccctgtggtctctgcattcaaagactggatccgggaaggaattaatcagtgtccctgggcaaagtcttgaattctttattgtttgagattatgacatgagattatttcctcatctgtaaaatgtaaataacacctacctcagagccaagataagaaatttaagatgatatatataaacacctagcacagttgctggcacacaggatgtgcttaaattgtgagtcgctttttccttccttttccttccttttctctccagttgttcctcccctgtatcccatcaggcactccatcctgaaagctctgccacagtgatttctccaccttagcctctggcagtgactccagggtaggcaggtggaggaaggacaggccctgcctttctgtctgagctcatagatgctatcataagtgggtttctaatctaggatatggtaacacataaaacatcaccatggaagaaaggtgcgtttgttagtatttgtattaaattattttgagataaaagaaaaaagctcttatttgaggcccagtcttttaggatttatggtgattcctatatagcaattcttccaacttcaaaaataagctatagtctaaaaaaattctctctctgcacttgctgtttagtgctggaaggcattttccacagagacaatactgtattctcaagcccacagaaacctatgcaacctatagtgtgactaaataatactgctcagaggctactctaaaatttacacactaagtgatatggtttggctctttgtccccactcaaatctcctattgaattgtactcccataattcccacatgttgtgggagggacctggtgggagatcatttgaatcctgggggcggtgtcccccatgcttttctcatggtagtgaataagtctcacaagatctgatgggtttatcagaggtttcacttttgtttcttcctcattttcctttgccgccgccatgtaagaagcaccttttgtctctcaccatgattctgaggcctccccagccatgtggaactgtaagtccaattaaacttctttttcttcccagtcttgggtatatctttatcagcaacgtgaaaacagactaatacactaagaaagatcttgcagaaaggaagacattgaagaaaaaagggatgaaatgaaatcagacttgaaatggctctgggccttctcagagctactggaaagcaggcccaagtgcacgctgcctgctggttctgccccagcaattcatgagtatgattcctcagagaagcaaggctcctttcttcttaaagacctccttcacgtatgattagcatgcaattcctccagtggatgtaaggagagccctctaagagctcattctgctgtaaacacagggaaccaaggtggcacaaacacaccgtgactccgggcatcgctgccatctcgccaacaaacacactttctagactcaaagttacaagctcacttcattgtgaagttggaaaaccaaattctcaaagttaactgaaaagttaaaaaaacatttgaggtcaagctcttgccagctcatctaattatatatagcaaggtcctgtgttggatttgtgggaggcaggggggagatttgcatcaaaggtagagcacttttagttcctttttctaacatgagcacaaaaaagtgtctagatttcaaggctgaattccgattgtaggggctgatgaggtcagtggaagtggccccaggcagctgcagtgctgaatgaagcagaggtcagctttcaatgtgcacttcgggcttccttctaaagggaccatggcatgctatgaaagctggggcagaggtcccaagcaggaggctcacatcctggtggaagctgtcttaagagtattgccatacagatccgccaacaccctcactgctcccagagccgagccccttctgtgcgcttagctatcagatggaatttggtccttactttgacattgaccaaccaaatgcagaaggaacatagggaaatatctatttcactccagttatcttctgtccatgtagcagaatgaactctggaagataagtggcaaaagcaagcctcgtggctccaaccccattttcctcttatgttgcgatttccttgcatcaacagcagcgacaagtgggaaattccagtggcgcccgtgctgctagggacttcttaggtgtaggtagaaccttggcaccttcccagtcagtaactagaccgaagttctgaatttgaaaatagatttcagattagcatgagtggtgaaatattttttttctaacagaagtatgcctcttagagcttgtgttctcaactttcgaagtattcaggagtttctttcttttttttttttttttgagatggagtctcactctgtcttccaggctggggtgcagtggcttgatctcggctcactgcaacctccgcctcctgggttcaagcaattctcctgcccctttcccttaggccagaaatatttccacttctgctgcagtgttgtgtagtacattccagagtctcccgagtagctgggactacaggcatgtgccccccacgctcggctaattttttgtatttttaatagagatagggtttcaccatgttagcctggatggtctcgattctcctgacctcctgatcctcccgccttggcctcccaaagtgctgggattacaggcgtgagccaccgcgcccagcctcgggggtttctttttagtggaaattacttgtacctttcttactttgaagcattttgtttgtgtctacacaaattttgaaattttacatagaaccacagcaggatttagggggtggggaggtgggaggcaaagcagtaccattgatcaagtttgttagtttaaagctggtgtagtttggatgtttgtcccctccaaatgtcatgttcaaatgtgatccccagtgttgcagggaggcctggtgggagatgtttgggtcaagggggtagatccctcatgaacggctgggtgctgttcttgcagtagtgagttgagttcttactctatgagttcacagaagagctggttggttaaaggagcctggcacctcctcctctctcgctctttctcttgccatgtgacacgcctgctcccccttcaccttccaccatgagtagaagcttcctgaggccacaccagaagccgagcagagctggtgcgtgcttgtacagcctgcagaaccatgagctaagtaaacctcttttctttatacattacacagtctcaggtattccctgagagcaacacagcagggaccaacacaaaaaccatcaggtcagagaacagtgaagtgagtttgcttggtgtgcttctgacccctcctctgcccctttttttcaggtaaggcctgggtcttcaggtgaggcctggtcccactctccattctttgtccattccagtgagggactccagggagctgagaatcctaaatttgaatgtggccttccaggtcactgtgaccacatttgttttcaaggaaggaaaatggaacatattttatttacagtttgttgccatgaagtgtaactttcagccatgtggactcagggaatgttagtggccatttgttcaggaagggtaacctgccacagaccctagtcctggaatattgagtgggtctggggttcgcacagaatttggagaccctggattaggagaagactctgggagtcatttgcccagaagcaatccactctggggctggactgcccagccacatgccacatggttgcccggcctctacctactcgcaggaaaaggcagcttcctctgtccctagacagcccatttcatctttatgcagctctgaaatagtgcccctttcccttaggccagaaatatctccacttctgctgtactgttgtgtagtacattccagagacgtagcaggttcagcaggtgacggaaagtgttcctgcgtgaacgtagtctccagccccgacacctggtagatggttcacacgaacacacacacattggggagcaaaacccaggtgtgagctccgcccttgcagagcttcaggcaaatgtgtatacatggtcgctggggaagagatactgtgaagtgtattatatcacaaggtataccagctctttgtgctagttatgtaagccacacattttgccgagcacacatagaaggaggctcattgaattcacctaatactgcattttaaaatgacaaaaaatgaatgtgttggtcaggaaagagttctggggctatgtagtggcaccatttcttgtgtaggccatgttttcccatctgttgaacagtttgttcaatacatatacacacacactcatataagtggttattaaagaagcatcttcctcagttatggctgtactcctgtgtaatacagctgtttcagctgcagcgccctcaccttcccaaccagcgtgtcagtggagcagtagcccccatttgagggcacgggataggataggtgacattgccacagagtgtgagctggagcaggctgccctctgtgcactgccaagccctgaaagcccagcaggaatgtgatgtctttagttagcacttctcaaactatctaccagggaaacctggtttttgtttaaatttccaacctgttgccaacggataaacataatatgataaaagtgaattactagaagaatgaagtggaacaaaaagagacatggaatacaagccttagctttttcttttctttttcagacaaggtctcactctgttgcccaggctagattgcagtgacaccatcacggctcacttgttgactttgacttcctgggctcaagcaatcttccccagtagctgggcacaggtgcatgccaccatgcctgactggttttgtttgtttgtttgtttaattttggtagagatggggtctcacttgttgcccaggctggtctttaactcctgggcccaagcaatcctactgtcttggcctcccgaagcactgggattccaggtgtgagccaccacacccggtcagctttttcttattagttccaacagtcatacaagttttctgataaatttaaaggttttaaaggctaattctctttttctggttttccctcatgacatgttggcccctccccactgatcacatattgggtagcactatcttagatgacaagcagaggtcaagcccaggattttaaaatataaatatgtatatttatagttatgaggcttttataaacttcatagaaaaataattaatgaatattgtatccaacttacattacttcagctttactttaaattttttccagtgatcacaacccacatttcatgtggttgtgactctccgctgtgttgctattccactcttattcactggcctggccctccttgctaccctggctgtctgtccctgcctccctgttctctcctttccccagtctcctttcacatcaggctctgggcggcccagggcagtcttcccccaaatcgcagcctggctgcattccttccttctggcagtctcacagttcttatgggacagtgtccgggttcctccaccaatggatctggcccctgcctgcctctccagcttcatttcttattcatttcctgccctgtgatccccccgcctgatatggtttgctgtgtccccacccgaaatctcatcttgaattgtaatccccataatgcccacatgtcaagggtggggaccaggtggaggtggtcagatcgtggggacggtttcccccatgctgttcttgtgatagtgagtctcctgagatctgatggttttataaagtgtctggcatttcccctgctggcactcattctctcttctttcaccctgtgaagggtgccttccaccatgattgtaaggttcctgaggcctccccagccatgcggaactgtgagttgattaaacctcttcctttataaactacccaatgtcgggtagttctttttttcttttttgggacagagtctcactctgtcgcccacgctagagtgcagtggcactatctcggctcactgcaacctccgcctccctagttcaagtgattcttcagcctcagcctcctgagtagctgtgattataggcacctgccaccatgcctgcctctctctctctctctctctctctctatatatatatatatatatatatatttttttttttttttttggtatttttagtagagatgggtttcaccatgttggccaggctggtctggaactcctgacatcaagtgatccacctgcctcagcctcccaaagtgctgggattacagacatgagccaccgtgcctggccattgggcagttctctatagcagtgtgagaatggactaatacactgccctaccccatggacttcagccatgctaagttcaatgcagttctggaagccttttcatgcttccctgcccttggtgctgataaaccagcactctgctgagtgaacggtagctgtttcttcatttccccacatgttttttctgtcataaacagcagacttaaacatctttatacaacttatcttttttaatgtaggaataatttccccaaatggaattaccaactctcaagactacggaccctttataaatatgattgcattttgtcaaatggttttccagaaaggttggattacttttcagtgtccacatcaataaaccctaaattttaactcaaaaatattctgtcagattggccccaagttgagttttatgctagattttactgtgtattctcaggtttctggtggctaaagtgagagaactggctttctgctttagatgttagttctaacaagttggggtctttgtctccccatgttcctttaccctgaaaacagcggacaccacaatcaatactgatggcaatggtgtgcgtgtggaggtaaggggaagttaaaaggtttgtttatggaagagtccctgttctgtgtgtcaaacaaaggtggaaatgaagaggaacaaaataggcaacttaataagataagctgatggcgtgctggtggcagcaggttgccatggatgcaacatgaataggatctctgattatcgtagataagaatatcctactgtgcgttattataatatcactgggtaccatgagcattttacacctatctcattgaatcttcatcaccactgcacaagctaggtaccatgttattattattgtattttatggatgagaaaactaaagtacatggagatcaaataacttaccaaaggtggcgagggctgagcgaatctgggatttgatcctgggtagcccagagccctgataccaccgttgacaatggagaatttaacttttgcatttgcctgagttgatgtgaaagtgtccttttgaaagtattctagactttcaaagtctaggataagtttcaggtgagtgagagcaccttgggaagagggactgaggtggcaccacccatgtcgcctctgctctcccacatcactccttggggaccctctgtgcatgctccccttgcccacagcatttgtcacctggctttattcatatgccaccatggaaatacgctttcctgggaatgcctggcacatggtaggcatctaatcagtgatgaccaaatggagcagaatattcggggaagtcatggaatatagagtgtttgattttccaggagcgtaagaatgtaccaaaagatgtcactgcagagtaaatcggtgctccatgaagtctttattgacttctggccaaaacgtagccttaagaaattgcccctgaaggaaatggagcaagatgattgttttatatgccttcataatggaattcatggagcattcagtcagattttcttgaagtgcttgttcagtatgacctcacagaaagtatggggcagatctgggagtgccccactctggttaatgcagtcacatggaaggaaatgtaattgagtgtggcaccagtgcactgcagtgataaatgaccagggattttctgggtagtctccgaatgagaagggataggatctcgagccttttaaggaaccaaatccctcaatcctgtgtgcctatagaaaattgcagtgggcaggagcagcccagcgtgctccagctgtcctcagctgtgggaccaccgtggccctgaacgtcgggccaatattgacggaatattcttgagttaaaattcaggtcttgagttagaattcagtatcaaaagcattgacactgtgcatggattcatgtttagcttctctttttttcataaacagtttactgaggtagctaacttctttataaaattatccagaaagaggtcaacactttccagaaagtgctagttcttgcagttctgctttcaagtatttcagaccagccaagcaaaactagctccagcatttttaactcttggagaaagatttcactatttcaaatgtatttttgtttaggtagagagcattagaataatatctaaaataagttggatattgtaggtgaatcacagttcctgacatcaaaaatagtcaaaccatagcttacaaatacacttttgggatcattttcccttgtactaaaaataaagttttaaagtaaccacttgcccaaaaaaaagtttctcctgctggagaaagttgcatagcttgggaacttttatcccgtatttactctgatcatgatgtcaacacagcactagtttgtgaattagtccattctcatgctgctataaagaactaccctagagagggtaatttataaaggaaagaggtttaattgactcacagtctgcattgctggggaggcctcaggaaacttacaatcatggaggaaggcaaaggagaagcaggcaaccttcttcacagggcggcaggatggagtgagtgcaagcaggggaaatgataggcacttataaaatcatcggatcccctgaaactcactcattatcaccagaacaggatgagggaaaccacccccatgatccaattacctccacctggtcccacccttgacatgtggggattatggagattacaattcatggtgagatttgggtggggacacagagccaaatcacatcagtttgtaagagtatagtcagaatggctttatagtcagaatggccttactggacattgctctcttttgtttctttatttgaccactaattttccatttagcttcccccaggctcttactgtacttcctgcacaaatgtatcattcttctgatgtctttgtgaaatcatgtcaatatttccaatttttcacacatgattttctttttgtcatcacttcaaccaaattttcttctggtgctaattattaagtattaaaattattaaagaattgagaaatggtttccgttataaagccctgtcttcatcatttagaactttacaacaatcctcttttgtaaagttttccaggaaatggatgtcccacaaaaatcaacaatcttaaaataagtatcagtatgggcactattgtttgcctctgttctttctccttgatttttattcttattctttgttacttctttgttctaagcgtaaaagatggaaaaatgataaagtaagatcctgctttcaaattcttagggaagtctaggttgctttgcttatgtggagcagttcacagaaggaactttagaattagccacctgtccgaagcttttagcccctcccagtgtggacttctttccctgggactttcatgggctgcctgcatctatcctagaatgtgcctgtaccggcaaccccgtcagactaaaccaggcttgttacagtcatgatttgtgcatcctcttttgctcgcttaggcaaattctggatttgtgttagagtggtcagaaatgccaagaacctgacttcttagattaaaagacaaaattgttggggggagaaaggttttttaatggtctgaacattttctcagttcagagcctgagatctgcatgagctcaccattgctctcgttaagtaatgttcactggctcaccgtggaaacttgaaggcatgtcagtgtacctgaaccgtgcctttttcaggactaactcaaagaccttcaggaagaaatatttgggtacagccatccgggaccacagaatcacagggcaggaatgtgaatgttgatgctggcgattgtgagctgcctgaccttaggcaagtagtctcaattcaccaagcctcctttcttcaaaggtaaggatagttaacaccttccctatatcctctccaggttttagagaaacttgaaagagttaatacatgtgaaatgaccttgtaaactgcaaagtgtaggttgactgtgacagaattattatcagtcagaacctgcataataaactggaaaatgtgagctatgttccaaagaacatcaggaccctctgtgggacccagttccggatactttggctgactcaatccaccgaaacaaagggttatttcagagcatggcatttaaattgttaggcttattagaccattaccagcagggcatttgtataccttacaaatgagttctttatcttcttccttgcctacgaaagttaaagaagtgctgtggtggccgcctacgtaattggattcattgtggagctctacttgaagttgcactcatctgaactcattcttgaacatataagccactgcccagaacaaacagggctcttcttacagaaagactcctgcgctgtgaatcagtcacagattgtattaaacttcccaacactactcaatttgtcaggcaagttttgttttattttttccctaatcctggccttattccaaattttccaactattcctggaataagtagactacatccatccatctttgcattctctcaatttccagtggccctagtgggaatttcatgtagctagactgacagcaatttgtattttgttaaattatgattaattggaaacctgtttttagcatttaggtggaatgtttcttgtagtattccattagcatagatattaatacacttgagtgctaatacctctgccttgctttcccacactttgttcacttatataagctgaatgagattatccatgattgtgttctttccggtcacatccttttggattccctgaattccattggagcattggagcccagggagcctttaccgttgattttgcgacagacagggcgagatccaggagatgaaatgttctccccagtgcaactcagtttgttactggaaaagcgagagctagaaaccaggacttcagactcctagaaccagtgtccttttgaagatgccgtggttccttgaaaaaccagagtaaaactctacaattcaaaatctttaggaaatacgttaagttgtttgagatggccagattttctgtagagctgaagggtatatagcctcttggttgttagaaatgtgatgtttaaccatttgaggaatcagtgtctaaaatggacagtccaaccctgccttcttaaacaatgatgaacgttttcttcttgatcatttcctttcctgatgattcttagcctttcttgatcattccagctcatcagtcatctcaattctcagtcacggtggaggtggagttgggtgtcagcttaaacaggtctgaacctgaggcctgctttcctagaggaagtcctggcctggcaaacctttccatctctgactgtctcatggagttctttgtcagagtgttggtgcagggctcctgcaccgggtagcagggcaccccagctgcagagtggtttggtgatgggaacctgaaacagccttctccctcggagttcgagagggagaatctcttttatggaatagccaaatgtcttgtgaatggtcggcagcatgaaaagcattatccttttctatcagtaacgcacaagcacctcctcaacagcttgaacttgtcaacatagttcatcacaggcttgatggattattcttcactattttaagaatttgtgttaggctgggtacaatttcattgtcactttacctcaaattctgattccaggtcggacatccaagagaattaagcacaacatgtagccttagttcctcacctataaaaaagtgatagtacctgtctcctagagtggcttgagggttacatgagagagtgagtgttgactgcttacatccatacctgataggtgactggcagtcaatttcggatcgctgctatttctcatcatcttcatcatcgccatcttcatcactagtggctgttaaatctatcagcatcatctttttttgtgaaagatggccaccacctttctcatctttcaagtatgttaaatgagaaagttgtgttgatgtttactattttaaaaaattgtctcaaattttaaaaagccaccacgtgttacttgctaatgtaactgaatctgtcactcattttagcatcttccccaggcttggcaaaggcacactgtgatagttaaaggtgcctgctgggatctcagggtgttgggttggactgtctttctagccttccctttgactcattccccgacttgagcaatcacgtgacctgcaccagccttccatagatggaacagaaacatgtgggctgccacctgcacacctcagtggggcgttgtgggaattatgagttagtgtttctgacataggtggctggagtgagctatccaagtgtgaggtgtccatgtggcttatctagccgaatggacattacctttaccaggggctctggtgtggtcttcacagcttttttaaatttaatttaattttattttatttttcgaaacagagtctcactctgtcaccaaggctggagtgcagtggcgtgatctcggctcactgcaacctccgcctcccgggttcaagaaattctcctgcctcagcctcccgagtagctgagattacaggcgtgtaccaccatacccagctaatttttgtatttttagtagagatggggttttaccatgttggccaggctggtctcgaactcctgacctcaggtgatccgcctgcctcggcctcccaagtgttgggattacaggcgtcagccaccatgcccagccttttacagcttttaaaggaccataaatgtgtccccatattttcatcaggagtgcagtgaaagcacccttctcagcatggccctgcaacctcataggtaatgtgattgacgtcacaccactgggctcagtattcttctgttacattggaagaaacaaaaacttcaataatacttggtcttcacctgaacggtgcactgaaacgttctgtcatatttttttagccttttgaaaagtgttctaaatatttttgctactgactgtattacaatgattgcaaaaataaactatttccaagagagttctgttgtatatttttagtatcatcagagtatcagagacctcacttgaaaaatcattaaaaattaaattacatattttcaacttgtatgaattgtacattttattgtgaaagccatcttatgccacatccctttagaattagcatgggtagtgctgaccttattttaaacctattattattattattattattattattattttttgagacaaggtctcagtctgtcacccaggctggagtgcagtggcacgatctcagctcactgcagcctcgacctcctgggctcaagcgattctcctactttagcctcccaagtaactgggactagaggcgcacaccaccatgtccggctaatttttctattttttgtagagattgagtttctcaccatgttgctcaggctggtccgaaactcctgagctcaagctatcctcccgcctcagcctcccaaagtgctgagattacagacatgtaccacctcacctagcctcaagtctttactgctcttttttttttttttttggcctttaattatttatttatttatttatttatttatttattttttgaaatggagtctcgctctgttgcccaggttagagcgcagtggcacgatctcagctcactgcaagctctgcctcccgggttcacaccattctcctgcctcagcctcccgagtagctgagacgacaggcacccgccaccatgcccggctaattttttgtatttttcgtagagacagggtttcatcgtgttagccaggatagtctcaatctcctggacctcgtgatccacctgcctcggcctcccaaagtgctgggattacaggtttgagccacggtgcccggcctgccttttatttttttaaaaatacctttttattatggaggttgtcaagtgtatacaaaagcatggaagatattctaatgaactccctatattcagctcctcacccagcctcaacaatgatcagtacatggaatcctccttcccacacttcccaccatggagtaattttatttttttattattattattattttatttatttttttttttgagacacagccttgctctgtcgccaggctggagtgtagtggcacaaccacagctcactacagtgctgacctcctgggctcaagcaatcttcctgccttggcctcccacagtgctgaaattacagacatgagccaccctgccaatcatgggatcattttaaacatatcccaggcatcatatcatttcatttgtatgtatctctaagagataaggacacttaacaaaaataaagtaaatgtactttcttaatatcaccaaatatccattctgtgttcaaatgtccccgattggctcatgaatgtctttttataattagcgtgtttgcgttagaatccaaataagaggcactcactgcatttcagtgatctgtctcttctgtctcttttcatctggtttctccatcctttgtcataggtccccagtgaaactgttttcatatgtctcataggctgtcccacagtctggaaacagcaagtgcactgttagcactgtttagcacatctctgcattccctctgatatggtttggctctgagtccctactcaaatctcttcttgtagctcccataattcccacgtgttgtgggagggacccagtgggagataattgaatcatgggggcaggtctttcccatgctgttctcatgatagtaaataaggctcacaaaatctgatggttttaaaaatgggagtttccctgcacaagctctctttgcctgctgccatccatgtaagatgtgacttgctcctccttgccttccaccatgatagtgatgctttcccagttacatggaactgtgagtccattaaacctctttcttttgtaaattgcccagtgtcaggtatgtctttatcaacatcatgaaaacggactaatatacatctatttatctaaactcagaggcctgggagcttgctgaaaaatcagagttttttgtttttgttttgtttttatttggacaagactacttcacacgaaatatcctgtactgactattgctgtacaccaagacgcatgtgatcactgattgtctccttctgtgatgttaaaagcaccatccctggcttcaggtgtgttcagtctggcccagcttctgcaattcctgatccgcctctcacctggtggtttcagcagccagtgtttaccccagcctccagatgtatcagcagctctgtggtttcagcaccacactttcagcacctaatacagaattcactttgaaagaaagatttctaaaaatgacttgctagtaggtagttagaaatactgagtgattcttaataaaataatgatttcaaggtgaaagcgatggcataattcaaaatgtgtttacattttttccatagaaacacatacttgattactaactaggaaaataaaaagatttctgtctcaaagaaagaagatgagtatgagaagcaaccagtagagttatcttgtttactctcctcccgagagctctagctaaagattcgaatagtgcattgtttctgagatttttgtcttaatcataagtaattctaaagcatttatcttccttaaaatgccagcaaattgaggcaacttaaagtactccagttcctttaggtaataatgtaaaaaatcgctgattaaatattgaggagtccctttgagtaaggtgtaatgacatgccgtcttacagagccagggtgtagttgctgcttcttatcccctttgcatcctcattatgtttcttctcgatttcagacctctctttggtctgaaaagatttcgctttataggttatttgtttcatcacaagtagagctgactctggaatgaactcagtgcgttttgatcatgaacccagcactgtgctacaggcttgcttactggaatatacagtgtcctttagaatccagaaacagtggttcatcttaggaatgtatggccaaatgttgatttgggatttagagttaagatttttaaattgtacctaggtgtctgggttttatatattgttccactttttatgtggaataagcttcatcagaatcatttcaggaaatgagaaaagtaggatatggttatgaatcagccatggaaaactacggtatggaatgaattagtcagaaaaaaggtttcagtggccagcgtgagctgtgtgctatcaggaagtggcatgactttccatgattttatgtgctataaatcatgtggcatactgatccagacacctagagtctttttttttattattataatttttgaaataaaactgaaaagcaccaatgaagcaaaagcaccaaagccctttcagtagttgcttgctcgtccctactatcagctggaatggatctccacccccactgtgagctccgctggtgagggatcattcatctaaaagtccattgtggctgctgggtcaggtttgagaagcagttggcttccgcagagttgctgctacaaaaatgtggcatctgtctgtttcttttgtttgtaatactttttctcataccccttgtctggccgcttctagatctctgccatttatggtctagaaggtagttgcttctccctgtgttgtgctgtgtttagaaagatagtctgaaattcagaattaggcagttatgttccagtcttctatcatcctattaaagagaaaaagaaaaacttgcgcaaatggggtggattaaaagtttgggtcatgtgaagttcataaagctatatctccagagggaaatgctaaaaatatactcaaccactaaaattgcccatggagggaaataagtttattgctttattggtcatgtaagtcagttaaaatataatcaagtcagcctcctcactgtcttttattatcgatacatccatgaataggcattcaataatgacagcttggtatgtgtctatgtgtgcatgattggtttttttttttaataggcacatgtaatggaataattcagttaggaatggagtctgcatgtgagtggctacactactattgaatattgatgtcatttccattgattctgatgcctttggcaacctggtaaacattttctctggaaaaaatctcgtaaaccaggtttgccctgtttctctgccctgtttgccgtttgtggtaacctggcagggttcctatggagaattgttggtctggaagttaacccaacttaacatcgcatagtatcacttagcaatcacgtggtaaaaattggcatgttcttcctccccctctaccttagaccaatgcctcccagaccttactatgtacaggagtcacttcggatcttgttaaaatgaaaattctccttgagtagatctcaggtggggctctagattctgcgtttctggcaagctcacaggtgatgccactgttcttggacactatataccaaacaacatctgtagagttcaacaagaagccaaaccctaaagggtatcgtgcctctaacgctagtaatgcagagccagcccttctgtatccaagacctcaaacctctctacatcatataaacaccagccctccagcaggagtgaggaacaccctaggatggagaggaaccctgatagagacatcacgtgagtcctactggcctttccaccttgtatcttaaacttcacttgatcctctgagcacacagccatctgtcccaaattctgccaaagccttatcaagagctaataatgccttcctttctccattgactggacactttctgagcaaggaaggtggttagaactgttggtcatctaagtcttcccctgggacccatgatcgctattcctaagtcttcattctaagattttttttttacacagcccacttgtcttcatcctccaacattcagggagagttcagaaagtttagtgggataagaagggattttgacattagtggcaagggaaaaatgctggaagtccaatgaacaaaggtttgggagacttcagaattctttaagattgacttaaagaatcaaaaaagaatgttcactaggggaagtgtcccagtgtggaaacttcagcagctgtatttcagaatcaccaatcaccagaacatgggttttggactagctgaagaattgttgaaccagtgagagagctgccttctgcctcctcctgttttccctcaattgtcccagtaaaagtaggttaaatatttaattggttactttattaccatggaattttcaaataaaccagcaaatcaacatcattattttaaaattttaggaaatgtgattcagggtttgtcattattttttccaaggaagaaatgattatagatattttctgcaagggtaaatatctgtgacttttccagtttagaagccagccacagaccttcatacacaccatccaaaaaggaagagtgttcaggacataagattaaaaatagttactattggtatgcacccattctaatgttttcccttagcgtcacgggtgcctttaaaagcctttctactattttccttgggtcttcccagttttaaaaacaagagccccattccagatgattaccaaaatgtggcatttgaaaaggtgagtttaatcgttgtcatagaattccttgtctgactttatcaacatcattgagttatgtgcattgagttgtgcatatgtgaatgagttacttacagcttggtattagttgatagcaggatacagattctatcggctatatgataaagctctgcccactccattggatggatctaaaggtagtgggggcatgccttagtatgggggactgaagctacattcattacattcctgtctcatcattttctttcagaggcttttccttgagaacattaaagccaactgtagagacctataaggatgaaggtggtagtttgagatgggcatattttatattgttacatgctcttaagttggcagtggtgttagtctgcttgggctgccatgatgaatactacagactgggtggcttaaacaacagaaatgtgttgtttcacaatcctggaggctggaagtccaagatcaaggtgatggcagggctatttccctcagaggccttgctccttggctcatagatgacatgctatctctgtgtcctcacatggtcttttctctgtctggtgtccaaatctcctcttcttataatgacacccagcagattggattgggctcctccttaatggcctcaatttaacttagtcacccatttaaaggccctacctccaaatacagtcacattgtgaggtaccaggacggttaggactcaacatatgtatttttgggaggagttcatttcagccaaaacaaagttcacagaagccactttgaatttgcaaaactgtttctcaaatggagattacttcatggttcttccatttctttttgagaatagttttgtcttcatcttcattgggagatgacacatctgctgttttgtcgtggaagtaagaattgggacaataataacataattgtctaaatgatattttagggtatcaggtggttttgctctgtgagaaaacctctttagaaatacaacgagggtgtccacagataatagaatgggcctctgccactcaggagtcttggcagtgcttccattcttccatactccacctcatcattgatgtgccgccctgtcactgccaccaccagcaggcacatctcggggaaggagcaaggtgggcctcagaacttcacctgggtctgtgttcagtgcctcctggagtctgtctgggtggcatggtcatctctgggttctagtagctggcatggtcagtgcctgtaggtgttcggtggatggatggatggatggatgatggatggacaaacgaataaactgataatgttggcaaaccacttcccccttagctccgctcagaaatatttcagaacatcagccattgaggctgctgacctcctcctggtccccatcattgtcctccatcttggagacagctgctgtagatgccacagatagagttaaaccttgttttgcttgatgtatattaaaaacaaggcaaatattttgcttacctgttttagcctggactggagggtcaccagcaccactctggctgtgagagagtactacttttctaagtttccctccgtaatttttcattttgggatcctcggtattcaccacctcggcagccaccatgaatcatctggtagatgcattttcaaactcaaaagcagattagaacatcacctgaaccaccttcaggttagaaaatgaacgttgctataaaagaagtaaaaataataattatacaagggcataggttaagtctttgaaactgcctgcatggcagattttacatttttgaaccgaggctgccacagctgtggctagtggttgtctgaccctcttctttcacctggtgccttcgagggccactgagagcatgagtcagagcacaccaacacccaaacaaagcacacatgctcatggcgccttagtccctggccagagacacgcctgtctttcatcacgtgggatggagacagtgaagagcctgagcaacagaagactgatgaagagcttcaggcgtgagatgattgaacaccacctagcacctggcaaacggtctcatagtccctatcctgggtgttggaccacaacgaactgtttgctgaccgtgcaatttggcaaaatcatcaaacctacacaaaacaagaaacaagcgcacaaaataagtgcaaagaggaaaagtaggcatttttctctaattgctatatattctggcatagtcctttgctttgtttacaatagaacttagaagaaatacagttttatttagatggcactaagagaatttaagattcctttgccggcatattttgaactaaactttagtagatttactgacagatgtagaagttaatagcagctttttaaattatcatgaataatgttttcaattaaaataatatttcttatgttaagcaggatatcaatgttatcacaatacagttaaagacaaaggttttacaagtgctaaaatgggatgtaaggtatacctcagtgaaactgtttttaaaagttttatatttcaaaagtttcgacattgcagagaatttaaattctcagcagtactgccttaacttttttttattattatttttactcttttgaaaactctactttccagctttctcagtttgagaggacactgaagagcttttgcagaaatcagacatgtcattttattaggaaaactgatttgattattgatatgccaattataaaattcttagtcatccagcacatatctagccatgcaaaaaaaatttcatatgtaactttgaaagcaaaagtaatgaaaatcaatgtgaaattacattgattggctaaattcagttcttctcaaagagtagtaaaatgcagttgttaagaacataggatctataggctttggttcagaatcctggttccaaagctgagtggtggtaggtgtcttcatctgctcgggctgctataacaaaatgccctattctaggtgccttaaacaatagaaatttatttctcacagttctggatgttgagaagtctgaggttaggctgccagcatggttgattcctggtgagggctctcctcctggcttgtagactgtcaccttcttgcaaaaaggactctactcacctgacttcacctaaccctaattacctcctaaaggcctcacctccaaataccatgtcttagtccattttctgttgctataacataacaccacagactgggtaacttataaataaaagagatttatttggtttgcggttctggaagctgaaaagtctaagagcatggtgccagcatctggtgagggtcatcgcatggcagaaggcagaagctgaagcaagcacaggagacagggagaggacatggagccaaactcatcctttttatcaggagcccactcccaggataactaacccactcctgcaacaatggcatgaatccctttgtaagggctctgccctcgtggcctcctcaccttgtcaaggccctacctctcaacactgttaaaatggcaattaagtttctaacacataaacttttgggggacacattcaaaccatagcaccattgcactgggtgttaggacttcaacatgtgaattttaggggaacagaattcaatccattagcattggacaaagtacttaattgaggtcatttgcctggcctcttcatgacagcctttttctcttgggacgatgtttttcaaaattgtgtgtttcctggggtgcattcccatacatggcagtgagcaggtgagggagggggagaaaggtgaggggaagctgtgatgtggaaagagtagtagacctaggtaaaaacctggctgctgtgatgggcctggactcctggatatgccctattctcttggcatgtgggacagtccccgctcctgggctcaggctcctgtagcacctgggtgacgtggaacccgaacccttcgctgaatcctcagctactcaattttggcaggggtagtggctgcagctgagtaggagtttgtttgcgaccctttgtgttccaaagaaaacgccagccacagaatttactgtcttactcactggagaccttgcaaaagtgtgggccccaaactagggtttggggagagatttattcacgtaggtattatctggtctctgttacccagaaagtcatttttaataagtcatgcactcatgactaatcattttctccacttaaaaaaacttttttccaggtaggacataataatgggtcaagctacttatacttttcctgtttcccccttttaatgggaaaaacacgctctttttccatatctaaaatggaattgaatgcttcttgtaaaatgtacatctcagggaaaaacccattgctattctaaacctgcttcctcctattcttcagttcctggtacggtggatgttgtttgcgtcttctgacttctaccctctgagttggagactcataattattgttagtatgtgagcatgcagtgtctgtctttaaactgctaagacggtgttgcttttaagcgacagcgattgttttcttgttcatgtttgtgctgtcttctttgcgtcagctcctaaaatagaggggagttgtgtacctgttaacaacgtgttaacagcattgttggggtttttcagacaatttaattgtacaagtaaattattttaagttagagcctattcgtttgaaacaaagaaaatagtttttacatttctaaaaaaaaaaaaaaactaataagtaactgccaacaaatgctagactatatacctgtaaagtcagcattttaatgtcattttcttctagagccagagtttagtaagttcttggcctgctgggaagaaatgtaaggaagagagtgttgttaggtggggattttttaacacaaaaatataaacttgcctgacgtgatttctcgccattttctaagtcactgaaatgtttgttatctattttatttcagtaaatcactttcttttagcatccttcagatggtcaaacagcatgttgtatctctgagaaatctcatcttattaaagattgactgatgtccttcaacatttctatgagcgtttttcaacccacagagatccagttaagatacagacaaatatcaggatcttcttaggacctgtttgaaatgacatgtttcaaagcagctctgtattaaaagaggtcattcttttctgttgaacaagaaattaagtgaatgcatttggtgtgctggggctattcttcgaatgttagagcaacctgtttcattttagggcctggggtcattattctccatgggtggcaccgctatcctcccagtggcatttgaaaatccttgcgagactttgtggttgcagcaaggactgggggaaagctgctggcatttgtagggagaggggactgaccagcagggaggctaaacagtctagagtgcaaggggcagggccatgcaaggagaagctgtttcctccacaatgtcgttagtgtaactgctgagaaacagcgggagaagtcacaggctcagggaacacaaaggatctttgtgcctggcctggccagccccccacttcttcaaggaagcatactgggggtcacatctattttctcagtgtttccctttcacccatgccccacattgcagcatttttcatcagaaaccacaggagcccaaaatacacttcctcatttctgagatgcctttcttagtcagggctgaaattagttttcagtggacacccacactcaggcactgtactagcaaagccttttgttagaaactgtcacactggtgttcagattgtcctctgcccgagttttggaagggtgggtgacaagggccagcaaatagtcaacactgcccgttgtgcaatgctgtgatctccctctgagagcaagaagcaaacttgaggtgacactgaaacaaggggcgggggcactgagcctgctttcgtagctttgctttgcttttgcctcttggtttactttctatggggaacatatcccactaagaaggctggtccagcccgcaccatgatggcaggcatgggactcgggagacgtggtcccagaggctctcgctccactgatggtgaggagtaaatgacacagtaggctttgcagaagtgaagtcagaaatcagagggctccatctttcaaccactccctggccttcaaggatagatcttggagttcacgtcatacagtctttaaaaggctctcctgcccacaaggtgccctcactacccctcttccacgtgcgtccctcgcactgctgtttgctgagacttacagccccgtcccatgtgtgacttttactccaacccgaggcgggtgcttcctgacagcagggctgggtctcctttactttctatcttggggaccagcagtctcctctgacaaggaagagattcagcaaaggctcgttgagaccagcctgggtgacacagtgagaccctgtctcaaacaaacaaacaaaaaccagcagagtttctgattcagtaaatatatattagttttctattgctgtgtgacaaattactacaaatctagtggcttacaatgcccatttcttagttgacaggtctgtaggtcagaaatcaccatgtgcacaacagggttctctgctcaaggttaacaaggctggaaccggttctctcctgggctgcgttcctgtctggagactcttgcggagaatctgcttctaagcacattcagatccccgtggccactctagctccttgaggccactctcagtccttgccacatggccccctccatcttcagaatcagcaacagagaatgtctctcccatcctttctccgacttcagaaagaacccggtcccttttaagtgttcaccccacataatctcccagggtaatataacctaactgtggaaacagaatccatcacagagtcccgggatcatgcaaagcttgtccaccagggggccatttgagaattcagcctaccacaataggtagggcaagaattctggcaagttgccaagtaaggcagctactgctgctgtggcagccacagtctgaaaagcacctacctatgcacattctacaacaacctttgacttagattgttcccaaattgcaaatgaggaaactgaagttcataggattcagtctagagataatattcatagcacatagtaactggtacctcgtgggcactgaccactccgaatggctagcaggcaactgactctggctgtcagtgccactgtggtcatcttggccagcaccaccagttgactgaggacccccagcaagtaaggactgcagccagggttcctgcccaggcccatctgacacccaagcctgagctttggccacttcacatgctaggattaaaaagaaaatgtcatccctcgaagcctaagtcaggagaagaagaaataaaaggacagcagtttattgattccaaagcccaacttcctttgaacattctagctgctggatgttctataaagctacctttctccagtcttaaatttgtatttgcttcctgttgctgatgtaacagattaccaaacaattttagtggctgaaaacagcacagatttatgactgtacagttctggagatcaaactccaaaatcagtctcaatgggctaaaatcaggtgtcagcctggctgcgttacttctagggcaaaatccgtttcgttgccttttcccgggttccaaagactcccactttccttggctcatggccccatatcactcgaatctctgcttccatcatcctgtctccatctccgactccagccctgccatatcctgcttataaagacaccttgattacactgggcccaccctggtaatccatcatctcctagtctcaagatccttagcttagtcacacctgcagagtcccttcttccatgtatggcaacatatttacaagctccagggactagggaggggctgtcattcagcccagctcatagtctgaggcccacacctatgtggatcataacagtgaacgctttcatggaaacttcctatgcaccaagcctcaatgtaggcattaggtcaatttgtgccaccaccaccacatgaggtaggtcctgtgattatcctctttacagatgaagaatctgaagcacatgggacttgagaaccttgcccaaggtcacacagctaagaaatggaacaccaggttcagacccaggtggcctggctccagagtccatacttctacaactctgttgtacacctctcacagatgtgcaagtaaaaggcagaccctacatatgtagatggcaagaagccccacacccacccatctctccttcctcttacacccactgttccactaaggaccctgcttactcaggtgacctcgccttctgagtctaatgagttacaatccttgccacttctgcccatcgcagaaatgttgttccagttactattgctgcacaacaagccacccaaaacgtaatggctgtaaataacaatagtcatctgttttgcttgtgaatctgcagtttgcacagagatgattcttctctcctccatgcatcatcctctgggtttcccttggctggcgactggagggtccactcccaagttgtcacacttatatagctggcaaaaataccagctgccagtgaggagctcagccagagctctgggccagcagcctcagttcgtctctgtatgggcctcttcatgggctgcttgggcttcctgaaagcatggtgggcaactgggttccaagaggaagtgccccgagagaacaaggcagaagggcatggctttttatgacctaaacttggtgtcttttccaccatatagtgtcacttgaggcactcacaaaggtcctccacattcaagggcaggggacatacattccttctcccaacaggaatggcaaggctgtaggagagcatgtggagtaggagacagtgttgcagccatcttcagagaatttgttcttccagaattgtctttatcatagctacctatgacatcccaccacaccacacatggcatcctccccacctcacctctgtttataggcactttccaagcccaaatttgggtgtatgcagaaacacaagattttgtccaatgtatttatttttatgtccttaccaaaattttaaaaatgtgttgcatgaatagcattaaaaaaattttttttatttattttattttttttgagatggagtctcactctgtcacccaggctggagtgcagtggcgcaatctgagctcactgcaagctccacttcctgggttcacaccattctcctgcctcagcctcccgagtagctgggattacaggcacccgccaccacgcctggctagttttttgtgtttttagtagagacagtgtttcaccgtgttagccaggatggtctctatctcctgaccttgtgatccacccacctcggcctcccaaagtgctggcattacaggcgtgagccatcgctcccgccccgtgaatagcatttatttttaaaatgaaatatgcaaaggtaggatttcctaagaaatccaggacatccgttaatagatattagcactaacccaatgccatgcaaaaaaatacaagccatcaaatttgttcaaaatgagtaaagtatatatgtcctttaataaaagcacctgcttatttgatgccacatgacagtggatgatagtggaacgttaactaactagtataagcgcctacactgagcagattcttgtgtaggttgattggggaaagctttccttataccttttctttttaggtagtaatgaggaaatgcagaggtatatctttttcccacttatttaaagcctaaccctattctcaagtccttcatctgtaggactttttgtaactggaccaattggaggttgagatgggattcttatatacctagctagacttttctgattgctacgctccacttctagtatcctgagctctgagtgtctgtgacacacaagagagatcatttatattatcactggagctgcagtctcatcactcaagcttccatcttaagcccctgtagggacagaaactgaggcttttggaggccctagtagactactgagcacctggtcatggcttagtatttcttgattgatttcactgtgagcttttttttctttttgagacagagtctcgctctgtattccaggctggaatacagtggtgcgatctcggctcactgcaacctccacctcccaggttcaagcggttcttctacctcagcctcccaagtagctgggattacaggcacccgccaccccgcccagctaatttttgtatttttagtagagacagggtttcaccatgttggtcaggcttgtctcgaactcctgacctcatgatctgcccacctcggcctcccaaagtgctgggattacaggagtgagccaccacgcctggcccactgtgagctttttgaaggaataaccataccttcctcatctttatatctctaaggaagagtcagttacttggctgcatgcatttgttcaacaaatgtttatgaagggttttaagggttccagggtctctggcttggtctacccttagttcggtgaaggaaatcaattaaagtgtggtaaatactaagaactaggggtaattttacccagccaaggagttcgagaagtcacgtgggagatctttaacaaatggtggttgaatgaatggagacatgagtgatttcttggaagtctgcccttaatcccagtcagtccatgcaagaatctgctcagtgtaggtgcttgaacaatacgtaggcagcacccagccccggaagagcccacctgtgcagagaattttcccctgtaactgacttactgcctggaattttccccttagcaatgcattcctttgagatgcagactgatctccagaatttgctgattaaatacaaattctctgggaaggccttatatattaaacaactgtcatcattaatgctgtaatggggagaagtttattatgtaaccttccagtcttgttagaaaggagattcagaggaaggggtcatccagggagaaagaaaaggggcttggatgtgattctgggactgcaagaagaatggggaaaataatgcaggtgagcaaggaatagatgtagggacatggcagtgacaagaaacaattcagatgagtgtcccctggcactcagacagccctgactccagtgagaatggctcagccaacactactgattaaatgagaatttcaccagataaagatggcaggcaggagaggtaatcaaagaaagacaaaatcagtattttctggtgaaatccctgtttctaggtatgaaataggattctttcaataactagcactccaaaatgttaatgggttaaaatgagcaggtttagagattgtgcataacagatacagagcaaatattaaaagccgtgataccaaaccactacacaaaaacaggcaaagtcgattttctctccaactaacctttacccttacatattgtgtctgttaaccacggttaccttgaccattgatatatagcatctagtgagggaaggggaaaggagaagcttttttgttattataaaagtaataagtgttcattgtggaaattcatgctagaatctaaataatccaaatccaaataatcaagaagaaaaacacaggagtcttctaatactatcacacatattctttcttttcaccaaaatgagaacaataaacattgctttgtaacctggttttttctcctaacagcaagtcttgaacatcttttcatgtcattagttttcaccaccttactatgagtggctctatagtctactgaatgaatttagcatgtatattatctgatcacggatcttgatgtattttatttacataaaactatatttttgcatattttatttgccttgcaggaacatatttgcatctaatgtttgcccacagccatgaggatttctttagaataaattcctaggagtgaaattgttgagtcagtattcgggatttgagttgatgcggtttatactgaaagtttaaactgtttgaatttaccgctaatcttaccgatattcttcttgaagctccttacatggatgatgagctaatgatttggagtggaataagcagcatttttgtagtgttcagtttaaaggctgtcacatttctgagacttcagatgattaacttagggtgcaagtctggagccttctaattccttgagcttgggccttgcgggttggtcggttagctggtcggtgcactggtcacagtgacacaccccaggtcacttcagaaaaatagaatttgtctcccagcctcccttgacagtcagccctgttggggcagagcaaagccaccttgcccaagttccacccccttctcagggtagccccttcccagaactgaccaacgtgggggtatcaaggcccggtcctcctgctccgataagggtcgtctcatcctcaaagctccctgtagagtcggctaggcttccactaggaccacttggtagcttcactctccctctgcccagtttcctttcccctccccaccactcgtcctaataacctcccctgcgcaagaacctctgtcttagagtctggaagcggccagtacccatggcggggagtggatggggaattggctggggagttggcagtagctgtggttgatcacagtatgtgccacataatttcacctctacagaggacagtagagccactgtgtcctccctcaggatggaggagcccacggtggcttggaccaacagggagcgtttcttaaatgggtgaaacaggcacaatcttcccatcattttcaacataaggaataaaatgtaccatagatttgtacaagagcagtttaaaatgctctcttctccgaatgatcttttaagaaactatcttaaagaccacactctgaaaacacctggacctcaggctcctttcaaattgtttttctgtgtcttcgaatgccattcctgacaaaactttttttgcctccatgaatcatgagctaattctgtagaaatctgtaagtgaattacagttcagattcttcctctgtcttcctctgacatggcccaatcatttcttaataattgctaaagaaaccaactgtggtttatgtttgagcagaatcaagatcgtcgctataaccatgtcaccaccattccctggcatttacagcataatttcaggagtgggagacaacatttcacagatgcccagggagtcacccataggaatgtgatgtgcccatacatgggccagatgaaaaaataagtacacacacacacacacacacaattaccatgtgggagtgagggccatgccctctccatgtataattcggtgtaaattgttaggcatagaacagcttgagccccagagctgggtaaacttctctgcctgtacgcctggcacctcacaccatggctggccctagcaggtgactaatctgtttttgatgaattaccaaattaagccacaaattgaaatgccctgggggctggtcagccagcagccatcattggtggaggggcgagtagaccacagacagtgatgaggcctggggtatttgaagagcatgggttccccaacaaggggcatctgctcggccacagtgaaatggagctctgggcccagggtggccacatctccccgggccaccaccaccaaaaagaagtcagaagttctatttctgtgtgacacctcccaatttttcaatattaacaactaattttccgtcaatgttaatgggctacagttcaccaggagaaaactaactgggccattctaggcctgatggaaagggaacagctcttaggaatcagatactcggtgcaaagatgtgtgcccacattttagtcacttgacgggaacacctagattttcctgatgaaccaggttggcacagttgttctctctttgggtggacagagataatatccaagttgtggtggggtcttgcttgttctttgtatgtagtttattgttccttcagtatgttttgaatcattggtgaccttcatgaagatgacaggacatgcttcctcgtgtgacttgttatcaggcttttaagtcatcagcaaagaatgcaggccaaatgcagaaagaaagcgtttgcagtgccctgttgggacttctcaactgcagacatggaaacagggtgtgtgtatggtaatggaaatagcaggtaagagcacataactcacttttctcccagcacttggtgaaaaagaaaaaacaaaccaacaacagaaaaccatttctgacctgcctcttgagttttgaaactgggtgtggatacaaacgatctttagcgaagccattcagaactgggttttctgtctttattgaagagttgcagattttgatcttgctcatttttttccccttccctccatgaccctctcacctttactcctccgctgacattcagccagctattcaccaggtgccggcgtggtgtgtgcctggacccctcactgcgccagcctccctgggagaatcatctcctctaaggagagtatggaatgctgcagcggaaggaaaaggttttccaggcagcattaaccctggaaagtagaattcctactttgcgtgtgaaggactgacttgttgagaatgaaccagccgtggggttgtgaaagctgcttagcgcagggatgagggctaaccagacactggtgttccctgggcctgagtgaccacagccagcccactcctgggtgattgttcttccccaggtttttgctgctgcagtgctgtgcccctggctgagaatggcatcaaagcagaaattaaagtcagtaattaaagcaaggtggctctggaaagagagaacaaataaagggtaattaattagggtggctttggccccagtaatctccaaataaatgttgcctcccctaatcctcatctgctggtctccaagtcattaagtagagttttgatttgcctgtggctattttttcatcttaaacattgcaagcagtgcgtttccaagaagttacagtggggtggttaacctttacatattaaggaaagattgaggcaatacggaataagagttaatggaattctgagcgcacatggaatttaacaaacaagatgaaatctagtatgaactgtgacctcagtcttaagatgtacatttgtacacactcttcctccctgtttttcccaattattttatttttctcttttcttttttattcttttttttttctttatacttggattttttttttgtttctactgtgttaacagatcatgatcaccattctgctaaaaaaaaagtctttagcattttcacctttaacaacatgaatatagagcaggcataattgcagccatcattttggtcactggcataaatcagccactcagattttttatctaaggaataaaagttctgtgttatcccagaaatacatatttgtaaactctcttgtagtaattcaggcaaagtatcaaaagatacttcagcgtttcttatttttttttcaaagtatcagaactgtgcctggctgaagtttaatatcagttattgtgttttcttacagaaaattaatactcattaaacttcaaagtgtttttttaaacaatttcattatttcagatttagaattcttagttgtcattctctgtagttgcagaaccagcacctcccgtattttctccggggcattctggttaacaccttcaaagcccatcaaaaaaaaaaaaggttatgtgttttgctttataccacttccctgtggccaagcaaattttaccagtaagagagcaatactaagagaaatacactcctgagcccatttcctgattgccctaaaagtgaacaaaaatagaaattcctttaactatatcaagaagaatgttcttctgttctctttcttacacttgcttatcatgaaaaagcctaaagaaaactgggaatttaatcacactattgcttaaacacatggtctccaagtgttttggattatgaacctccttggtagaagattttttagtacatctgccagtaaagcattttatttgtaaattctatacaaattctcctatatgctggatactttatgaaacatgccctaaagacaggtccttaaggtggacatgcatccaattgactctgctcttcctcttgtcatggggttggtgctggagatctctgcagtgtacccataagaagaatcctggccctcagcagtgtccatgtggtcgggcctcccagtctccatgtgatggtgcgggccagtgcctggcatcctgctaggccccccacagcaaggacataggaagcacatccgggaatgtgacacccacagagcacacatgtggccctcaagcacagtgcttcccctgaggcctgtgagaaatgtcatcacaaccctacaccacctcctgtgaccacaatgaatggcctggcctttgctcaaaccacagacaaaggctgcccttcagtctgtcacaccagaagccatggccttttgatgccctggtgaattctggctcttggtttgcatcagatgagcccccactggtgcagttctccgaattttggtgtcattgacttgcacaagcttttgtctacatctctggggagctgcagaataagctgcattgtcctcatgaagcttttgttgtagtatgaagattgccaagtcccaacatgactatgatgccaagcagactatggtgacagcgggaggtgggagtcaccaggttacaggtgggaaagaacacttagttgggggatgggggagctcctggaggaattggacttaatgataggctttaaaggatgaacaagagttcaacaggcaggaatgagacagggaggagctggctgaggagctttagaaagtgggtactgcagagggggtccctggaggaggtatggacactggttggagaagaagctcccactgccctgcctaccccagctgtctcctcatgggtaccttgcttccccctcgccccttcgctgtattctgaacacagaaaccagagtacttctgtaatatggaaatcatgtcataacagaccatgctaacctttgctcaaacccccttatggctcccacttctgtagaatacaagccagggtccttccaatggctaaaggtctctcttgtcctcattcccaaccactttctccatgaccctcctccgcagccaccctgagcctccttgctgggcttgcagcatgccagattctcctgcctcagggcctccacacctgctgttccctgggccagaatgctgttccccagcatccaacggttcactcccctacctgcttcaggtcctcatgcactcgcatgtccccttctcaaggatgccttccctggccgggcttgctttcaccacttttccagcttttctgcccctccgcgctgctctgttgcccacactcaaggctgtctaaacatactgtggattgtacccatctatcttgttttgtgtcttttttccccatctggaatgtaagctccaagagggcggggagttttgtctgttttgttcatatttgaattcctagtacctagaacagtgtttagacaaatgaatgaataaatggagggatgcgtgaatgaatgtgaaccagaaggcttaggttcaacttcaggagcaaagggaagtcattgaaggtttgttttgtttaaatatagcatgttaccttttatttacttaaagtgggggaaataaaatcataattgcttttatttgattaaaaaaaccccaaaataataaaaatggtttaaaaaaatgaggttacacctaacaggcagagtgagaatggagtggacagggacagaggtaggaaaagctttctcagtgtatcctatttaagtatattttgggcctggcgcggtggctcacgcctgtaatcccagcactttgggaggccaacgcaggcagatcatgaggtcaggagatcaagaccatcctggctaacacggtgaaaccccatctctactaaaaatacaaaaaattagccgggcgtggtggcgggcacctgtagtcccagctactcgggaggctgaggcaggagaatggcgtgaacccgggaggcggagcttgcagtgagccgagatagtgccactgcactccagcctgggcgacagagcaagactccgtctcaaaaaaaaaaaaaaagtttattttgttttttatcatatgactgtattatcaaattttaaaaatatttgtttaaatgagactgataaggtgggcagtggggggttggaatttgcaatgttcgaaagtaagatccaggaaaactatccaaagttctactcatcttagtggcagggtttacacttcatttatctattcttttctagagtatctacaatcatatctatcatgtaaaaggctattcagtatttgctgatcaaatgaatggatatgtgaatgagatgacatctgtcgtcaaatgtatgaatgactcttgtgtcaaagaggaactagtttttagttctatgtgatcaaagtagaagcagtggatgacagtgacaggaagaaagacatcagtttgtttctttagctggcatttttgagagactattttgtaccagcaccaggactatcaagtggaataagatgtggctcaagccgtcaggaggttcaccgtttagaaccagggtgtcatcacataggtggtcacctactgaagtgagcacggtgctggagacagacgtaggaagtttggagagtgcttaacaaaccttggacaagggtatgagtgggtttggggtgacaaacattttttgcttggccaaatttgggtcaggtttctgaaccttttcctaggctcacctgtgcacttccttataaaacccagttttagcaaagaaccccgcaaagtcagtttaacaggaacccccccacccttaatatctgattgggttcttcatcttctaccatccgtcaggtgatgtctgatcacccgggcctgtcttcagcaagaatcctattaggtcagcttagccagagtcctctttaccccgatgcctcctcttagtaattttccaccactgaccctgacactgcttcttggccatgctgtattcggagttgagctcaatctacccccgcccccagcccccactgcaagacctggttgtggtggtctctatacccatcgtggtggtcctgaataaagtctgccttgtcgggcttcagcaggcatcattgaataatatttttttaacacggggggtcattgttggcttcctggagaacgacatgcctgcactcaatcttaaggaaggaaaggaaaggggagaaaggaggaataatccagggagagggagagcacgagcagagacttggggaagagaagaggggagtgtgttttgaggcatataagccatttgtcttggaggaacataaaagtgagagcagcactggcaggatatgtgacaagaaagacacaagacgaccttgaacagtctgcctgggctacagcaggaacagtgcttatcactgaagcttatacagcgggagaggaacgtgaccgagcttggtcagcatcagggatttttatgtgtcagacttgcacattatgttggagtggtaagacacaggccaagcgaggccagttgggaagatattacagttgctgagggctgcctacctgcagcactatgcacggtgaaggatgggatagagaacctacaggactttctgtggacctgcagggcacataggaggacatccaaggtgccctggaccacccagagagatggggaaatgagctacagtaccacagggcattggcccaaggcgggcatagttccttggaacaagcgtggaatctgcaatgaaaagcccagagtgagttccggctctcctaaacatagtgtgtgccactctgaacctcaatatctttatcgatgaaatcggaaatagaaaggcaactgatgtgctttagccgccacctgtgtttcaggcattgtgctaggcactttgccaccatcactagatgaatcctctccacaactctgaatttgatattaatccctcttaaaagttgagaataagaaccttctccttagttaataatgccttttagaccacaaagtggtaaagatgaggaagagagcaaacccttgtggggttgttttttgttttgttttgtttttgtgtagtaacttaggctggggaacaatgctccacattctatagggaatggttacacatgtgaagtaacagtaaaactactttaccactttgggaggccgaggcgggtggatcacgaggtcaggagtttgagaccagcctgaccaacatggtgaaaccccatctctactaaaaatacaaaaattagctgggcgtggtggcaggcgcctgtaatcccaactacttgggaggctgaggcaggagaatcgcttgaacccaggaggcagaggttgcagtgagccaagatcacgccattgcactccggcctgggcgacaagagcaaaactgtctcaaaaaaaaaaaaaaaaaaaaaaaaaaactatttcactatcttagaagcaaaaaactgaaataaaatgtaactgtcatcatgttcattcacaagagagcctttgcaagttgcctcattttttgctcagtgttggaagtcaaaactcagtttctgtctttggtcagttcatgttgcagacagcttcacagggggcacattcttggtgcagttgtcaactccttagagttcataatggatgtgctgaagtcatcctaatgatgctttcagaatgctgtaatgggaatgatggaattcatcataaaccttaatttttcctcactgaaaatggaaacttcctaatggaaactgtttggagccagaggaggcaaatgcaggttaaaaagactcatttatgatttttatggtgtgagtggaagaaatgcaaaacttctaaagctctcagttgactaaaacattcatttactttaacttctgggttcagttttatcatgttgagtgcaggttttagaatgcttctcaagagctctaatgagactatattagtccgttttcacactgctgataaagacaagacatacccaagactgggaagaaaaagaggtttaattggacttacagttccacatggctggggaggcctcagaatcacggcgggaggtgaaagacacttcttacatggcggcagcaagggaaaatgatgagaaagcaaaagtgaaaacccctgataaacccatcagatctcgtgagacttattcactatcacgagaatagcacaggaaagactggccccccatgattcaattacctccccctgggtccctcccacaatatgtgggaattctgggagatacaattcaagttgagattttggtggggacacagcccaaccatatcagaggtcttgctgtgggtcttgctctgctttcttcagatcactgacatccaaccagcaagcaagaatcaggaatatacttgcctccaaaaccacaaggaatatacaagtaggaaagtcagctttttaaatacttgctttggatccgtttttattctcagtggggagaatcactatttataaagtaaattcatttgcataggacctttagaaatgcaagttcacgtataatagacatgcagtcaaagacagactctcttagcaagaattgtcagataagcagatgaggaggcattgatatgagcataaggcagtcttaccctatgggtacagggacaggtgtcccaggaaaccctgtgctttgccctgttggccaaccagagtgtccaagtgccactaaggattcctgctactcagcaagacgcactttggaaactcaaatctgctccatacctctcacattttagccaaggaaaaccaaggtggcagatcctaagtgccctccccctgatccagggctctggtacaatttgtgaaccagtgatttttttgccagagaacatgcattccagtctccctacaaagtggcagccaccattttgaccggctcttactcctgatctaaaaatggaagtgctcaagtttactaaattcaattcagatagatagaaccgatcaattcaaaggcagatatagaattacatgtttttgggcaatctagtgaaagatttatcatttctatgagcaaagacagttgaataatcttcaaatacctcaccgttctttttttttttttccatccatataacgaaatcaaaattgtatattcgggtgagcccacactgttgtctcagatgaacagagatgtttgagatttgcccacaaaattgagctggaactttgtgtcatgattttaaaagagaaaagaagacagtgaaatcagcctcttgtgtctaaattagcctcttctgtctcttctgatcaccttttaatggaatttgcccaggtgcatgccaggagaagagaaaagggggagacaaagagttggagagggggagggaacatcagagaagttccaagcccctctggaggagtggaatgcaggactgtgtctgctcccctcacctctgtttccccttagcctctcctgcccaccaccacaatcttcatgtgcctgctggacagacaaaggctccctgtactgaaaatgcaggactgcaagcatacacattccctctcgaagcatcatccaggatgaccacttccccttggtgtttgatgcatgttgcattgttcagtattctacacttttttggaatacatgcgtttatgtcttttcaggttgggagttatggataatttggcaaagcaaacaccataactggtttcttacataactctacagttggcagcaaggcacagtgcgttgaaattaagcaacactcactcatccaaaaggactttgcttttccttttttggaaggctaaatgccctgctttgtttcttcctcttgcatgtattttaaattattggctgactttaatgattctttgaagttaatttttaaatgtgaatggcaggattccatttaacttctggaagcttgagagctgtccctgtgtgcccctaaatcagagaatgcttaaataacttgagtgcttttaggtgataataaaattggagagagtgagaagaacataggacccaggctgccatagggatctaaactggtaaaatacttagaaggttcaagagttgcaaccttttgaaagaactagagtcagtcttgcatcgcagagcacttctccaaaccaggcatcttccctgcatcttccctttcaattatagtgtacattctttccatttcttcttcctttcctttttttttttttttttacatttagtttatgagtctttaagcaggacctcttaacccatttatgcctagtgttccattattggaacgctaagcatgtgggagttatttatatcctattgctcaaggtcattgccaaggtctgatggcaaaaattcaaaaaattgcaacctctggcataaatgggttaatgcttctttgctcagtttcaaaggctagattgctcagtttcaaaggctagtgtttttgtatcctttgcctgaattcagtagtgctttgaaaatgatcgaagtgtttcatatccccagttctcaaattataataatgaagttttcaaatgaaaatcctaggattgttttaggttctgtttgctccattccactgtgggatacaagtagaaattgggacattcatccaataaaatgtcactggggaaaaaaattttaactacacttcaaaatgattcctctttttgtcctttaaaatttttattgaccaagacagatttcaaaatgttttctctaataccccaaagtgaaactttgattgaggttttcaggaaattccagggatcaagtatgtcacccggactttggtttccaggtttcccaaagccttgaaatttccctacagtctaattgctgtttattgccacagaccttcatcctttttcttttgtaacattttccatcttaagaagggtcgtcccattcggccgaggagcgtgttgtctgagtagctgaatggaattactaccagtggaaactatgctgcaagagaggttgataaagcagctgtgaagcaaacctcagctgttttttccattctccccaagcaaagttaattagcatagggaaaatgactaaggtgttgacgtcacctctttccagtagaaacttacactttgtccctgtctgcctgcaagcatgcaggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggtaaggcttctaatataacgtgattttctttagttttcaaagcattatgctaactgggactattaactgaatacttgggagaatgtggctctcttgtgggtttgggggttttgaaagaaatccaaagtctttcgagccttgaaaatcaaaagctgttgcctgaggaattaactgaggaaggaatttctaaagatctcaatatttgacaacatccaggcccctgaaccaactcactaggaaggcgagagttggggcatcgtgtgtttttcattctgtgtatgttgtaagtgaacttttcagaaagaggcctcttctgacagtgaatagtgttttacttttgtagccagcgttgtgaataatttcatttcgtcttaggaaataaatgttataaagatatttgtatgtttgtagtaattatgagggcctggcctcaagctcccagatttctctaacaagagaaaatgccgccagagcaaataataaaactggagaaattaagtgtgagatcagtgtgcctcctgggcagcagctctctttgatggtgattaatataatcattttaatcactacacttttcttcttcatttgattaaaatgtaagttttttcatcagcagctatccggctaattgagctttaataatactgtataggaatgaatcctgtatgctctatttgaggggtggtatttgtgcctggtggtgttatatgctttatatccaaagccatattgggacatgcgaaggtttctttttttaaaaaaaatcaaatgtaactccataattgtatataatgcttatgggctcgcaccatagtgtttggactagattgcagagcacattctatgtttttaaagtactacaaagtgagttcacttaacatgagccttatgtgagtaaaatcactattttttaaatgaagtagagatgccatccaaaagctataataactaggtatcagttattagaacaaataagattcttttataagagaaaggcatcatagtaatctagattttaaagataatgtgaattctcttttgttctggtcctaagccctgaacctgtattctaaaaatattcttcaaagtcatctctcccaaattctgaatcataacttcaaaactaaacagtgggtcacagtgcctattgatgaggtcatacaaaattccaaatgtacgaagacacacttttgccagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggtcctcagtgagctctgtccgcgctgcctaccatccacaccctgcgccatccccttcttcctggccagccccttctgcctttcacacgggctcccacaaactgtcctaagtgtttttgcctggtaaaaagattcacaaaacccggcgactagaagcccatgcagtcttccttggagctttgactgtccaccagttaaactccctctctgaggagttgcagtggcccccagctgcccccaccgacagccacactccaggacccagcctagggggctgtcccctgagcaacctaagcttgtaatcccccacctcgagctttgcattctaagagctcaggacatctcctaattctcactagccctatggcaccagagcgaggtgtgcacagacacgaaagccaggatgcagaaaatggtccatttgcagaacattaatttttaaaccagtatcattttagagagttaaaaagtaacagactgagataaaagcgatcgtggaaatttttaaaaactacttattttaagaaatgcaaaactttctaccaactttgttatttttcaagtcagtatttctttttttcaaattagctgcagttcttttaagccttaaagaaatctttgatatatgcaacactgccctgagctgaacggtggggttggagttggctagccggggaaggctataggacagagaaaaaagggggggtgagtgggggaaggccataggacagagaaacatggggagcaaattaccaaactgtacctccctggaaaatgctcattctactttttaaaaaagtttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcaggtgagttgggttcattgctatgcatgcttctccctcctccctccctcccttttgtaaagcagcttatacgttgcttatgttatatgctgaccggaaactctgagacttcaccttgagaaagacaaaattcctactctgaatgttcagcgtctcacttgttttaagaagatatcaaggtgcatttgaaagcaacctcagacattgcccctgaccttcctgggttgataatgatgggggaaagaaagccttccctgttcactggggagcttgcagggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcttacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgattctcacctggccttcttaaaggaaaagggaaggagaaccataggccatggtgagggaagggccgcggtcgggctgccctaccccagggcctgtgggctggtcccctacagagcttgctaaagaaagaggaagttcccgtcctctggagggacaaaagtgtgagcactgcggggagggggtaggttcctcaggctctttgtccaaaatgtgggccttaactggtggaattgtgagcagtagatgagatcatcgagtgaaaggcacttccatcagcacctggctcacagtcagtgttcaatgcaggatttttgaaaaccataaaatgttggtggttcctgtcctgtcctctagggtttgggtgaggaggcaggtgtgagggagagtcttggggtgaagaggtttgagccttctcctgctctgtccgtggagcaagtcaaataaatgctgagaccgtcagctcctcatttctccttgaccagcaatctgatgttcccttgggttgagggttttgttttcttggtccatcagcagtttcatattgaaaagattacatttctgaaaacattgtccaaacggaaattccctctgtgggataaagcaagactcacattacttactgctaattgtggcgtgaaggtcaagatcagaaatggccattttgaggaagcgtgtgctccccccacagcagctcctggcccgggggcatgagcatggctgagggtgtggagtcttcccctaggttaggaatgggagaaaacagggtctccacttgcaaagaggtgtccacagttccagaggcaaatgctgttaataaaaattctgcatactccagaatataccacttccttcaccgagggcttattggagaaggctttttaggaaatagacgtaataaaatcagtttgtccttggttcacttaacagtgagcttgagtgagatttcatatttcacctgtgcttttcaaccaacaggattgcggagattttgcaaattatggtcctaaaccctgagctttctggattttcgatgattagtaggtagataagagacttgcaaagaggtagatttgtaagaggctcttaaccagcattttcagcaatccatctgacctcccatgcctgaattctctctctcagagagctgagctcctttgcctttttcagtgcagttataataacattccagtcccacatgtgatagagaaaagatcaccaccttccttatcagtaaaagtaccttccaggtttagaggagtaaccagtgtggctggaggtaggaagctctcctgggccgctcttgtcgggcggaaatcacacagtggttggtgcggtgcctcctcgcttacccgaactgcaaagaaatcccaagcacaggccgggcgcggtggctcatgcctgtaatcccagcactttggaaggctgaggcaggcggatcacgaggtcaggagatcaagaccatcctggccaacatggtgaaacctcgtctctactaaaaatacaaaaattagctgagtatgatggcatgcgcctgtagtcccagctacttgggaggctgaggcaggagaatcacttgaacctgggaggcggaggttgcactgagccgagatcttgtcactgcattccagcctgggcaacaggcaagactctgtctcaaaaaaaaaaaaaaaaaaaagaaagaaagaaagaaaaagaaaaaagaaaagaaaagaaatcccaagcacaaagccctggaagaaaactgaccatgaggccacaccctgtgggtggagcaggttgaagcaaacctcctgcccctatttcagatccctgcccagcagggcaccaataacgatgcagtctccattcttaaacatctttctaggtgacatgggctggacaagcatgtggtgagccgggttctcattgcctcgggcactcactcatgctgttagctccatgaagtcaatacctttaccgtctcctttactgaggagggaactgaggtgcacagggaagcagaataaagtgcccatgagccctgggtactaaggagccaggctcagagctgccttcatgagcaccagagatgcacactcttcccgtggccagagcggcaccccagcgggaggccccagtcccttcattctacattgccgggtttttcagttgcagaaagctctccccacccttgctggaccagagtggcctgaacttggccaacctggtagaactcaggctgacatagaacagcaggacactcctggtcccggggattagaagttgttctaaggaaaagatgcccaggtcaaaaacgtttccagagcacctggctccgtgcagccacccctgcgtctgctgcagggcctcctgtggcgcccttcctgggcgtgcactgcgaccctcaaataggagctgcatgagggaggcccagggttctgtttccaaatacgtttcttcatccatctttttcctgaaccgaagtttctcacattcacacttgaggaaatgctgacagaaagggagttctctgggtagtttagatatctggtggacatgtgaagtataactagaaaaatgcattccttctatacttctcatgtgcctggactcccagaatgtttgactaaaaacagagtcatgcacaatggaaatctctctttttctgaatgagctagcaaagaaatacaaacccaaaatatgtctggctgtgtctctcagcccaatcgaatggtcacgagcagctggcccagcagagccctgaatgctcttttatgtttgccttttgactcccaaggacttgtctgagtgaccctgcgattattttccctccttaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttctaaattctgcagtttaaaaggcttttaaacctttttaaacattttaaattcagaaggagacatcctttgtcaatttgagcttagaaactcctaattctgtgctgtggttcatggagagtccaccacactaagaatgcatcacttgcaaaagaagaaaatggataaaactgaaatcagaacttcgagtatttcgtttgtacaggtagatgctactgtgatgaaacccctgttcaccagcacctccacaaaacagcaatggttttggtcatttgaagagctttcttttctattagaaaagatgtccatggaagatactaagttatcttcagaagatgcatctgtaagccttctgtttaatctctggcagcttttcccctgaaagtctcatttcaaatggtggtgaccttcctgggaagcccacaaaggcctaagtaacccagtgtttatttgctgaaatctaggaaatgacattaatcctgatcaacattagcattaggcgtttatctatgaaaattcacatgctacttttttttctctgtcttgagaaccatgatcctgtcatttccaagagtatttgcacattttcaagccatatatgttcaaggtttaatcgtgctggaaaatccacacttccaccaagttggtcaaatctgattattggacagattcaggcattgacccccactaaggacaggcaggaaatatttccaaatagagactctcaacaggtccccttagataaaggagggaaaaagtcagtggtcccactgccagtgaagccaatagaccttagaatagaaaatacaagtcaaggaaaaggctcactcaggacagcctatttcttctgagttgttctgtggaagcctcagctgaaattgtaaaaccaataatgcacaaagtttctggttcccaggctgatgggcctgaaagtaattgaatcatgaatgtgcccaggacccacgcattgctttgtaggagaggggttcagtcaaatgtgaaacaaccgacattcaacaggcagcatcatgcaggatgcacactttgccattgattgaaagtgtttcttcaataggctttgatagaatatgttactaatctgatgggaaacagcttagggccatgcaaaaaaagaaaatcagcccctggaaatgagtggctaaatcaaagcgaagggcagtagaaggagaggagcggagcaattcatggagctattcagacacaagctataaacattgatttgaagtcagcaggcatttgggattttacatttccagaatattgtgtgtgaattactgcccacagaagatttgggttttcagagagctttaattttctgtgaaatgtgcagaactcactacaaaataaatcgattttctcatatgttaagttgcaggagattaaaagcactctatggacgtgttatgatcaaaagtgaacgcgcagccaaagtctgtcacacttcacagtgcccgtagaacccgcagaaagtttgcctgggtatcataggtacatatccagtaacattcacccaaaggtcagtgactcaggtggaagctgcatacataattaccctaaaaattattcaggaagaaggtccactatgaataacaagtactcttccctcctgcctctctggcctcctgattctaaagtagaacagggagtagaacgtggaggaaacttttcaagtatatcaccactcttggcaatccttaattcacatctgaaattctcactccgtgactcaccgaaagttacatggcaatcaggtagatggatttgcttctcacatacctcattttcttccacaatccttccctgctgttcgtgaaaggtcatttcaatcatagctatgtttatgaaagacagaaggaaattattcacaagtgattgaggtgtgctgcctgtgcccaccgtttctccttctttcaggattctgatgagggactcggtgacc

SEQ ID NO: 16925 - DNA, 4733 bp, Human
ctggctaacatggcgaaaccccgtctctactaaaaatacaaaacattagccaggcgtagtggcggttgcctgtagtcccagctacttgggaggctgagacaggagaatcacttgaacctgggaggcagaggttgcagtgagccaagatcgcgccactgcactccagcctgggtgacagagcgagactccgtctcaaaaaaacaaaaaatttttgccttgcaatcgtttgccttgatgttatgtctaaagccccacaattctctaaaaacagagatgtataaaaaagcacacgtatataattctctgaaaacagaatataaatgagtcattgctccatttaactgacatttgttgagtgcttgttataaatatggcattattctagctggtgtgaggttaccaattttttttaaacaaaagtaatatgaatatatacacacacatttagtgactgcatatgtgatgtgtgcttttgaagaaaaaggagatgctgttggaggaaaatggtggtggtggtgggaagtgatttagagtagaaccagggaagtctcagaagtgacaactagctggaacctaaagaacgaggaggtagcaggtggaagagaaaggcaaaggcattctaggttgagagaataggatgtgataatgtcccgaggaaagagagcttactgacagggagggaagatgtcaggtgtgaccgaactgtagtgagcaaagggtaactgaggaggtggtcaggagcctgctcagccaatggggtaaatactgttaaggaattaggacttgattttaagaacaaccatcgcatcattttaaaagcaaacaaattgcactataatttccctcttcaaaaaggcacattggctgtgcacggtggctgacacatgtaatcccagcactttgggaggctgaggcgggtggatcacctgaagtcaggagttcgagaccagcctggccaatgtgttgaaaccccgtctctaccaaaaatacaaaagttagccaggcgtggtgacatgtgcctgtaatcccagctacttgggaggctgaggcatgagaattgcttgaactggggaggcggaggtttcagtgagcagagatcgtgccaccccactccagcctggacgacagagcaagattccgtcttaagaaaaaaaaaagggcacattgatggctattcaaggcagagaggggcacatataaccccaaagagatggctctggggagggttgtgttgtattacattgttggcattgtattatccaggtgagagatgctggaggctgggcggtgccagtggtgatgaaaaggagagatggatttgaaacataggaataatctctcagattgtttcttggcatcacttacctaaaatgcttctttcaaatatagatgtacacacccctccctttaggatacttgggacaatgtgccacttagacataggggatggaacaaattggagagtctgtcaatgccccctgcaatcttttctcttgatgttatctcataatgccccacaattctctaaaaacagagaacataaatgagtcattggtccattccactgacgtttgttgagtgcttgttatgaatgtggcattattctagctcttgtaaggttaccaattttttaaaaaacaaaagtaatgcaagactgctgatgaaaatttggaatatgagaaaagcataaagaagaaaatacatatctttaagcacaccacccactgttaacattctgatctatgtacttctaatattttctccattttcatatgtacacatacatttatttacatgcatatataaatatcaaagtgtatatatataattttctctgccatttaaatttttactgtgtaacaatcatggattgtaaaaaaagtgaataaaatgtacgcagtcagtttaaagactaacaaaatatgcattaaatcaccagccaggttaagaagaaatactattacttataccctggcatctccctcccacctttacatagccaaatccagaaaagatccgttttcctaaccttgttcgcctattttattatttaaattgcagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaagtaaagtgtctgggcagtggctgtggggatagaaaggagagatttacaaatcattgaatcttctttctcatgaaacatcatttgtgtgtgacaaattcaatttataaataacccagatgtattatgtagaagctgaggctcaaaagctatcacttgcttaccagacggacataggagcatttatctgtaatattaattcatgagtgtggagtctgaagagatgaataaacaaaccataagattactttacatttattgttttcctggcctttaacctatttagaagtcttaagacagaacaaacatttttctttttctttttctttttcttttgagacatggtctctctctgtcacccagcctggagtgcagtggtgcaatctcagctcactgcagcctcaacctcccgggctcaagtgatcctcccacctcagcctccctagtagctgggactacaggcacgtgtgccaccacacccagctaacttttgtatttttttgtaaaaacagggtctcactatgttgcccaggctggtctcgaacctgaacaaacatttcaaaggacaaataatccataccagagaagtagagtatttaagaagtacccagtataacaaaacatattttaaaactaacatttaaagttttgcagaaaactaatcttaaaaagttctcattatttaagaaaaaaaaataaaaagttataatgtcgctttaaaaatgtattcttttaacttgatttagttttcctctatttataattagttgttagcatttatgtttaagaaactaaaggatacagaaagggtctaaattgctgatgccctctgaagacctagacaggaactacttaatatcttgcaccatgtggtgcaggatatcatagaatgtcagggctgatcattctactgttggcagagaccacttcacttacagatgagagaagggcagtccactgagaggagacaatttcattcactaattcggtcaggcaacattgacctacttggtccactggcctagaccccaagagtataaagatgagcaaggccgggcacagtggctcacacctgtaatcctagcactttgagaggctgaggtgggcagatcacctgaggtcaggagttcaagaccagcctggccaacatggtgaaactccatctctactaaaaatataaaaattaaccgcgtgtggtggcaggagcctgtaatcccagctactggggagactgaggcatgagaatcacttgaacccgggagggggagattgcagtgagccgagattgcatcattgcactccagcctgagtgacagatgctaaacatcatagtacaatgtgacaaggtcctaacagagatcaatgcaaaggggacacagccagccagcacaaggacaggagggcatgcctaatgcaggtcaaggtcttctctctcagagcagctgagagtagcaggtcaatggcagcagagagatgtggggcctcagcatcccatggcttcatgcctcctagtttaccctgttctcctccccatgccccagccaaggcacagcaacgatgggcaaggcctcaagcctcagggtgctaggacaaaatttagaaaaagaggctcttcttcagagaatgcttgtagaactcgttattccaatcacaaggtttgtctctttaaaattacagagtgagatatgtacaaggtatctacttcctaataacagatttgcaattatgccaactgaagcattcagtacagttagagaaaaccatccatattccaagagcagatgtaggaagagtggcttccctcctcagatcagaaacccagaaatgttgtcccacccagaaacatccatctcagagaggccagagcagccatcaggctttaaatcccagccctctgctctgcatccagacagaaatccgaggtttccatcaggtgacaaagaccctctccttaaccaaactgtcaagctcctctgagccctcttcttgactagagcccaa

SEQ ID NO: 16926 - DNA, 100928 bp, Human
aatgtagtaagttttctttccgagaccccaggtccattaaaacaaaactgaactcgggtgctggcagtgcccagggggagcggaggcggagagggttgaggccgcgggccgcccgccttagccccccggaagcccgggctcctgaagcacagatagccaagagcggcccgagtcaagccccaggaacaggggcttcgggaagagaccccgaccgggccgcacagcggggaggcctggtccgagagtccccacctggccggctgcgactctatattggaacctcggaaacgcgccttggccgttccagctcaagtgggctctggggcggcttcctgtcttttatcctcgaacgctagttcttcccgggcgacccgaaggccacgaggcgggccgcacagccccgcgccgtcgggggcgttccgggagctccggggactgcgcgcggcgtccagggagggcggctgctgccccctggcgtccgccagagcccgcggcgcgtcccgacagctccgcgcagtccgggcccgcccgggaaaggcctccacgccagtcaaccccggccccctcctgcgtccgggcccgcggcaacgcccggggacagtccctgcgcggcagcggccacagcaccctagccctgggggagggaggagcgggcgtcaggggccccgtgaggtcggcgagggacccccgcgccggggagcttaattgaggggctccgcggggaccacaaagcagcccgcggtggaacggggccgggatccggggactgggttgcagccccggggtggatgagaggccccgggaggtgcagggcccggcagggagggcgtggagggactcatggtgacgggagcagcctccgctgggagggagccccgccgggcggggtcggagttggcagcgcacgccggaccgggggcggggccctccgagctccgcgaaaatgcccgcagcaccgcggggaccggcgcagggggaagcggccgcccgcacgcgaagccggggtgggttccgcacctggggccgctcgagcgcacgggggcggggagaggagcgggggccgcttccggggagccggaggggagacgcggggcccgggcaggctgtccggctgctgcgggtgccggcgctacaaggcccgggagcaagccgcgtggctgctttcaactttccttccagccgcgcgttcttggggtctttcctgactaggaaactcttcgctggccgctgacgcacgcagcaagtgagacgcgcggagggatcgagccgcggcccgggcgcagcggtaaaaaacacccattacagaaaccgacccaagggaagacgctgagagcaaacggcacgcgcggacgccgtccggcctcatgcaaggaatcagcgccgcttcgccgcagctgccagccggacggtgcaggagcgcggagtggctcccccgggccccgcggccaaatcgcacccccgccctggaagcggaggcctggccctgggcggccgcgcaggatctggggccgtccgcgggctgcagcccggttcgggagcctcgtggcggccactgcgcctgcctgcagcggctcgcggggccgggcctctccgggtgcggcgcgccggccgggtcctcctcgggccggcggggcctgctttctttttccaggtctccggaccgtggccactcgcggagccgcacaagcctgcgtgtggctgcggaaaggggtccgcacgcgggcggggccccgggccagcatgcaggcttggatgcggggcgcgggggtggcctccgactccccgcccgggctgcgtacagtagcgcgcggcgcggcggcgggggcgcgcgggccaattccaggagccggcggcggcgagccgcgccctggctgataccggaaaggcctgtgattggccgccggccgcccctatgcaaacgagctgagggaatggaattcctccggccgggcttacagtaaaagcacgttcatttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggaggagtatcgtctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtactggcccggagagggtggtgggaggacaggcggaggccggcgaggccgggggagatccgcgagggcagcggccaggcgggcggggccggattctggaaaggggcccccgcagccccgggtcggtcttcctagcttgggatgtgggggatgctgtgttgccgtggcgaccctcgggaggcactcgtctcagctttctggggcggcctcccaggagggctgaaaacatcagggtgtccccaaagatatccactgggagccggtcgggacctccctggcaggggccttagctttgatacaaagtaggaaaagttataacccagcccggcagagacagcccgtctgctaacttactgctgcccctaccgctggattaacacccaaaccattttgtcttcctcagatgaaaggatcaggaaataaaatagtaagacttttctgccttcaagtcagtgaaaagaaactaactagggaaactgtcagggattttttttccccttctctaaccgccctataggaattagcatgtccaaagtccacagcgggcgtagttaagtttgcaaaagttttctgaagagttctctgagctttttagcctgctcctgccagaagccgcaagtatcgaatcctgtttcttttcccggaaccgttctgaatgctatcatcagctcacctagattaagccaggggtagcgaaaggtgacgaggctgttttcggagagccaggggtcccagcggcccgctttcctgctagaggagggggcggcgcgtagccggagacttcagcgcggcggctccaaagatctcccttcacttttcacccctgatcatccccaaagctttgagctgcctttaaaaaccttgaccttcaacaggggtatgaaaacaaccccaggcgtttctaaacaatcaccctactacactagcagcaagcagtaggaatttaatttctgcagtggagattctgttttgtctttggtgggtttgaaaagatgcgactaagtaaaatcagtgcgggtcatttcctgttcgtttaaagggcgaatcaaggcaggtggttccaagtgtaaagataagctactaaaaaaaaagtttaaataattgtcccctttaaagggagattaatttaatataagctttttatagttccaagcctcagctgggtcttgatcttattacaacgacgaatattcactttttaaaaaagtattgttgcggttatttttaagctttatacagtttccacacttagattgtgatttctaaaacaaaacgaaatttgcagttggctgtgtctatagattggcctctttttccactcacttttctaaaagcagttttttttgtttgttttgttttttagtgggggtggaaatgaggagaaggaacgaaggaacgtggtggcttgcttgactcttttttccctccctccgtttacttagatttgggtttgggagaccattttacttttaaatcattctaaccctttgcctaaatggactcagcgatgactctttagggcacccgcattgagaggggacccaacagggttgggccatggggtcactatcagataaagagcagaggcaagacgggctgataaccaccaaaggccattaaaacctggctgccccaatgcactagggctctaagagatttgtggcttccttttgggggggaaatcagggtctcttctgaactccctcctctgccagggaacccacactcaaatatattaaaagactaaatgattaataaataatcttcaggaattggagcaattcagagtctcaagccattacatgaaagtatttattttcttctaaaaaatgaaaaattatacatattgcttttatgagctgtcagaattctttctagcagaaaccataataaccatagagtttcctttttaaaatgacttttggcaattcacttaaaaacaattaatttgttttattgagtgataatctataggctactaaaaatccaaatacagagctcttgaaaaaagttcaagcagatcccctgagaacatttaggggaaaggaaaggatagcagagaaatcagaccatttgattattgtctgtcaccaccccaatcctcataaaaagaggcttcttcctggaggagacctgctcactgcataactagaagagtagacaaaatgttcagtgagacagtaaacgtgaagggataaaatgttagggataaaagcaagcaaaacatcaaaacctgcctacatcccgggctcatttagtgtgtgtccctggcttcactctatctgcccacccaaccacctcacaagcagcttcaacagaaattattactttaaaatttggatcttaaataagccgcaggcaatctccctaggaagttaaccagtaaataattattatattccctatggtaaagagaagcaaatgtgaaacaatgataaggcctgatgatattgatgaaaagatcactgaaggccttcttaggaatctcctgaagttctgtaggtaaatcctctacgtcaatcttctgaactaaagagagatttaaaattatgaattttctttaaaatagattacaataaccctacttgcttattttgagccccaacctgttctccccctactccttccctcccatggaacacctttattttttacagtatgagagatacatgttttttactactaagaaaaccttaagtttgctgtgtgttttgctgtacttacagaattagcctaaaaagctgttttgatgacttaggatgtatttggtaataccatggtgttatagcttgttcaggccctggtacaccagagtccaaagacgtaaacgtgccttcagcagggaagttcggaggtcttggattctgatggtaatattcttttcataaaaaggaaataagtaatatttttgtcggcaagatcacagtccctagctatgccttaaatatcatctcagctgaattctgtgttccactccacagccttctttgcaacactggaaggttaacggatttgaagtaaatgaattgtaactgtaatttcaacctaattagaattggtttaaaatgccagtttggaccgtgaacaggctagccaagaacagtattgggaggtccatgtaatatagaagagagttgatatttggcccaacttcctgatactttaaaaacagagaagtaaaacaaaatatgagatatctttggccagcaagtcccttcttgcctgtttggtctgtgttaaaatgtaaatgtttgtgtttccttacctattgtttatagcttttcattccagttgtttcttttttctgtttgaagttagatatttttacattctctccatattgcccatcagtgacaaaacctgtatcaaattagcacgcatgttagttttgaattaaaaagaaactttttaaacctggcttaagtatgcttgttaacaattggacgatatacagtattaatgaattgccctggatttactagttcccctttacccacccgcctccaccaaaaaaaaaccctcagagatcaatacaaggccaagtgaatgatatgtaggtgcccaaatatggttgattctgctgcatttaaaaaaaaagaggagtgggagttaaacttctaatttttttcttcttaagttccaacatcaacagccttttcttatttagcctccatgataattttattctatgtttgtttcgacttggcgaaggtctcctgaatttgccaaattaccaatgaggatagtattggaaagatgagagaggcacaggcttggagcactgtgaggggaacagcagtaggaggcagataattcagaatacattcctgtagttataaaagaagatttatttattttcacctttttacagatccagacccaacaatgagttattcagtttgaaacccacgtagtggaggcagtctctgtatacctgctgaatgttgagttacaatagagaagcctgggttaccacagggagaggaggatgaggaagtaaaaatatgtgttcaaagagggcatttcaacactgtgagctaactttacaacgggaagtgaaaatcatgaaaaaaaggggaaaatttgttgtgagagactaaaaagagcaaaataaagcaagcccatttttcgggaatagaaaaaaaaaaaaaacagtagcaataaccaaataactgatcagggagatttatttccgtgatatctttttaaaacaaaaagggaattgtcgtatcactgctcttaattaaatggcaacaaacacacttataatgggaactaaatagctaattagagggtgcttggggaataaatagcagagttttaaaatctcctatatggaaaacatgtccaacaattggaatgaaaggattaaaaagagagaaaaggcccagaccttgtttggcagtgcaagttggataaaatagaggaaaatgcctccctgcttctatgagactagattatcctggtgtagtcttggggttggaagtatgttcatctctcatagtgagttagttcgtgttctgtgccacaaggactgaagcagttctaatgaataaaaacaatagatagtcatctggaggccacagggaaagggtgatggctaagcagatcatgaaaatgggaatcttgagaaacatgacttcgatatcatacaagtgagtctatggcagccttttttacatatagaaaaagaggcctgaaaatatatactacaaaaaattatgtagcagttattaaggtaaaaattgggaagtaggaggcagaggaaggagtgataacactagattaaggaatgctttactgttaccaattcaaaaacagcaaccaaaaatgatgatgtaattggaatgagtaatataaatgtcactactgactttaccgtaaagaatgtcagaaatgatcagaataaatacagcttggggcatttcgatttgaagttgtatgactgctttgaaaaatagaaacaaaggaaatacagccaatagtaaatgtctagaccaagaaaatagtttctagaaggcctaaatgatagccaagaaattgatgctattgtacaaagtatctttaggtcatgcttttcagagtattttactttggaattcattttcttaattacctgagtataaaaacatttatctaccagttttctccaatagccctgataagacttcatacttactcagttacattaaataaattcctggtcaagatcagctgggctagcagaaaacctcaggcatctgtgaggacatgagtttacacacgctgagactcacagatacaaaaatgcaacccaattccacccctgaattgaggggagtgcatagaagtgaatgtcccgtctttctgaggtctgttgattttgtaattagtaaacgaagggtgcatttctgatttttttttcttgtgtgctagaattcattgctagtaaaactcaagataatagcgatgagtaggaggtatcaaagatgaactgtagagggacagtttaagttacttaagaatcgtcagcaagatgaaatctacttttagcagaaattgggtttttttgtgtttttttgttttgttttattttctaaaagtaaagtctgcaccttgttcagcctgttagtggaggtctgagcaagtaaaagatgggttggattataaacttacaaacacaggatgttctgtttctcaaacgggagaaattaagaagagatgcttgtattcaggagacggcatagctactcaaaatccttgatatcttgctatggttagtcttgttccaactgtgctatgtgacctactatggctttatgaggtaaatttagtatatgtgtcactatttgaaaatttacatatagttatacataatgtattaggttggtgcaaatgtaactgcagtttttggagttaaaaattgcaaacactgcaattacttttgcaccaacctaaaatataataaaaaagtgtcttctctttataacttttctgttgttttgcttaagttatcattgctattcctctgcaacctaaaaagaaatcattgaatatacatttaattttagaataatcactacacaaatgccctaaaagtgtatgtataacatccctgatgtctgcatttgtcctttgactggtgtttaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagaggtacgttatctgtcaaaactatgcttgaaacacgtttcatggcaacaaacccacatttcaaaattctagtgatttctgtgatggaatccctagaaactcggtctgtcttaacattcttattgctatgtcaagctcttaaaaatatttatttgaagtttaatatttttagcagaatctctatattattgctttatgttactgagtggatttaagactgatttggaacatgcaacgtaggaattgtgaatttcaaagaaacgcctgagatttttactaaaatgcaaaaaatataaaactgactttaatgaaactaggattatacaattacaatgaggattctctcttggataacaatacaaaagctatttaatggaaactgttgacgtatgatctgtgggctatctgtgaaaagtgacagagtttcgaatgaccacttctaataattttagggatttctagtgtatgatgttgaaacatggtttcaagcaagcttacctttttagaaaaagacatgaagaaataatgttagtaccattgatggcagtatgatcttcctgttgtatttcttttcaatgccttatttaggaggaggggttgggcctggttagcattttagatactaataatattagagattggattatccaagaaattgttgcattacttcagctccatgtgtgattttatttttccttgcctttaactcattatcaaagcattagagcagaaataggaatcttggcttattgtaattttttctggtttccaattattttcaagtattatgttttctttacattgtaagaaccaaatcatattttataaatagcaacaagtagtaaaagtttagttgagggaggtaagatagttttttaaactcattttttgtaatatagtaccgattaagcttacaaataagttatttcaagtataataaaaagacttatggtaaatacctaaataacagtaatagttctcgtattgaaaaaaatggaagcaccaatcaaacaacatttaaaataagagaaattattactctttaaaaaggcatttaaaaacaagaaaatctcagttctcagagaatttgattagtcagaaaggagaaaggggtaaatgtgagttgattattttggtgattatttttgctatcctagctatctggagcattttcataatagaatcatagctggagaaaataaaaaatttatataatgtgattgaaaatatatattcatagtactatattaataatagggtaatgcaaagaaaattatatccactttttgaaagcatgagtgatgctataagatataaaagcataagtcattaaatgggttcacttgttgtattaaaagtccccacctttcagtaaatggaatttgcattatgattcagagatgtgtgtctagaaaacatcttaaaggcttcggatgagtagctggcagagtgggtgagaagccaataaaaaacaaaggccccacagcctggtccatgcccatcggcctagctaactctcttaattcagttcttgtggatttctgctgttaggaatcaatagctaagtatcattgaattgcttttctagagaaagtgttatcatcatactatgcatctgtgtgggtcttcaagttaggttttggtcataaaagttttaaaaactatttagtgatccgtgccagtgacattttcccacaagaagttcagtagtggctttccggcaatgcacagtaaaccagtgataataaaaaaatgagattttgaaagcagtgtgctttcttttctggcattgatggctgatcttgcatccctcattgaccatttctgttttgagtgggtgactaataggtgcttgtgtttacttgggtaacagtgaactgtttccccaaggtgtggagtgtttgcatttggctgcaggattcgtgccagtatgcccttgagtttgcataaaccccaaaaagtaaaatagctgcaaccaaggctgggctgtcttcccatactctggaatgagaaaattaattgaaatgccataaacagacaatattttgaacagactctccttcccaccagtgataataagcaataaaaaatacggaaaccctaatggaacatttgacccaattgtaattactgtggatatgaatattgttggtcttgagatgtatatatatatgtgtgtgtgtatatatatatatatatttttttttttttttttagtcagcgctacaaaagtaaatgagctgtctgaaggcccgatttgactctgtcataatttctttccatagtcataaaatataacttgatttttctctttcaagtgtaagtgtcaacaccaaagcctgccagatttttttctttctttttccttcttcttctttttttttttttttgcaatttgcttcccattaggaagagagcagatcattctgactaattttaacaattagtcttaatcttcctcactgaatcttacctttaacagtttcattacgttttattaagtgatcttaagacaactgtctcattttctgtttttgaaaatgtgcttgaaaatatacccttggcatgaacacaccacgccatggctcagaaggccctggctcttggctcatccaaactttcagtgccaattttgaattctgtcaaaagccaccagtctgatggattctccaaggggcctagtaagtggtgcaaaatgaaaggtagagaaagaagttctctttctgtgaccagctgccagtccatggggattgtaaacctcatagaaactgccagaggttgaacatggaagggtttttctctgttctacaaaacgaatctatctgggcgctggctgccatccaggatcacagctcctaacctcgggttcattccgtaactgggaaaacctgcctgtccggctttgatggcctcgctggctacactggccctgtagaagcctgaaccttctctcttttcttccattccctcctttttctccttggcagtttaaatcttggttcagagtgtatctcacccttggaatgtttctctctttgattcagtatctccatgtaaatcgaccgctcctttacaaaggaggaagagatagcagctcccaggagatgagggttagggagctctggggaccgggctgaactccagaggtcatgtgagcacagaggttattgttcagaataattcacattttagccaaatggactgggactccatgacacccccaaaaaattgaagttcagggtcaaaaggaattctcttatgtgaaacgaattcactgagcagcttatatcagtttacatctgcagttgaggcaagtgctacatcacctgccacctttagaatgacaagaaagtgtatcatggcttcagctgagagaaatttaagaaattttagcaattggtatccgggcacagtggctcacacctgtaatcccagcactttgggaggccgaggtgggtggatcacctgaggtcaggagttcaagaccagcctggccaacatggtgacaccgccatctctactaaaaatacaaaaaattagccaggtgtggtggcgggcgcctgtaatcccagctactcaggaggatgaggcaggagaatcgcttgaacccaggaggtagaggttgcagtgagccgaggttgcgccactgcactccagtctgggcaacaagagcaaaactccatctaaaaaaagaaaaaagaaaaagaaattttagcaatgaaatctgtgactgcttcatcccagttggagtatttaatcagtcagagaataactgatcaatcaggaaatacagctttagtaatttcatttcagaaccaaagaagaaatctctccagctgctttatcagctgcattgttgctgcaggaggaaagatggtctactgcacatttctttctagttttttcttagaatatgatttttaatctttggggaacatcatagatacttttgaaaatcctttggaaggctttttccaaggacaaaaaaaaaatgcacgtgttcacttacacacagaattacgtatatcatttcagtttctaggctaccagaactcatttatggaccttctggggatccacagaccctaggccaaaaatttgtgaatttggaactttgcattgatcatggagggccagcttagccctatgccgcatatagtagacacctgaaaatgaataaatacatgtacaaatgagctagacattttcttgaacctgtgctgttttggtaacacctgtgtttttgttatcgccggggtctggtttgtctaattaagaaagtagatctccttgaaaccactggccaggcctttggatggccatcaggtatgcccacatatcatcacgggtaaaggggagggggcctattctgtcattgaaaggacagtcgcttccctcgtactgtgtccacacccagccctgtaaggccaagtgttctgtggcctgtcaggatggcgttgagtttcttggcggaatttgtgtttacattgacctccctggcagctttaatcttgcccactttcaaaatagtatcctttcccaacacatttatacaatgaaattccttcggtatgttcttgctgtgaatatcttcccagacataatatttatcctgtcacaatctgggttattgcatatttgtgtaatgttagttgcttaaggcattttcattcttaaattattctacattatttgggctaaagtgtgggaggttgcccttcaggtgagtggaagactgtggtcaagaggaagggaaggtacatttagggaaggataaacggtactgatattctaaacaaagagacatggcttggctttatgtagcggttgttaccaagagatgatctgaatgactcgcagtattatcgtaggatcccagtccttctctattctattaacagattcatataatagaagaaggaaaaattcatctgaccaccccagagttgtttcacgggtaatgttcatggtataaactggcagtcagatctcctggagagaatataaggaaaagacatgagttatattaaaatcaactctcccattttcccactttcttctgttacatactgatctacactttaaaataatatatatactgaaatctgtattcagatctcattgcaagcaaatatagatgaataaagacccagtctctgatataccaagcctcaaccagccctaacaaatgctgcttttcgacgggcaggtcaaaagcttgcctccatgatctgatgtagaattcatctctagagaccaagtttctcatttcggtttcacatttgccaataaaaggatagcaacactttcctaaagcaagttgctccctgccctgcttaaagcctggggtggcccagtcatggcaaggaccagcaggaaaagctttcttgaaaactgcttgtgcttgcaacaggcagtttcgcagttgatcccttcatagttttcttgctgattttgtgaagtgtcaggcattgctgatggcgtcacacagcttttttaaattgaggttatttgtatgaacaatattttatagtttgatgggcagaagctgtacttctctccacccaccctcaaccccttccttgccagccggcttgtgtttggtggaggcatttctttttggtcgggacagaagactatcaatcagaaagtgcctgcaagagaaataatggttgagtgatttttagagcttcctgtttcagcaacaagcattatagacataaacagtgatccagccaacggctgcaaccctgctctggttctaataaatcagttttgtattttcttttttgtgctggttggcaaggggcaagagagggtggagaaggttggctaaagaagaacatattctgtgtttctggtttttttgttgttttttttttaaggaaaaattacttgttgacaaggagagatggtgtactgtctttttttttttttttttttttttttgagacagagtttccctcttgttgcctaggctggagtgcagtggtgtgatctcagctcactgcaacctccacctcccaggttcaagcgattctcctacctcggcctcccaagtagctggggattacaggcatccaccaccacgcctggctaattttgtatttttagtagagacgaggtttcaccatgttgactgggctggtcttgaactcctgatctcgggtggtccacctgccttggcctcccaaagtgctgggattacagtcgtgagccaccgtacctggccggtgtactgtcttaaggctgttttctttctgtagatgattatgacacaagttcagatcagtaaagagatgtttatgaataatcatatactgtcaatatggggagagtgtatgcttttgaaggcttcattgattcttagccagtggagtgtgtgtgcgtgtgtgtgtgcgtgtgtgcaagggggagagagagagagagagagagaatgagaatatccatacttccattgagagacttcttgggccaaattatctttgaggactaaattcatgctaataacatcttctcatctaaagcccaaataaagcaattaatggaaattaataagtgagcagtgtggatttaatgagctgcctatgaatactatgacatgcgctcgttttgtcggctccctggcggggcatggggacagatcgcagcacttcaacgtctgtatttataaacatgcattcctggacttcaggcagcgcgcatactccatcattggttctgctgtgagtcctacattcaacggagatgtattttgatctctgttgaagacagagcaatcgacggcattcagtttgcactgcactgatttgggattccagtacattgcccagtccctgttagtctatattgggcagcatgtcccattcaggagctccatttgacatcaccgaacgttctccaatgaaggtgtcaggcagttgaggtccatagaggaatcccagcaacttcctttgagaggctcacggccattctgctgctagactgaaaatgcgtttcctctgatttccttagtgaggaagcattcatttaggagccatttaaactgtgtttttctcaaagaagatgtaagtacatttcctgtttatttctcaacttagattaatttgggcttttaccttgagatttaagaccatcattaagaatgtatgggcagggccatctgcagaactaccccacctcccccatcacctatcccaaggacgtgcctgtccagttaataggagggctggccagcactctggggtggtgtatggccctaattgagtcaccgtatgcaaaccaaggtaaatcacaggaatatgggcagattgagcataattggtcatctgtgtgctcatcagatctctggaggtggaaacactccagtttgctcaaggcattgggttggggtctttacagatttttttccttcattctatttgaaactattgtatagaggatagtcagtattaatcatctatctttctatctatctataattagtaaggagctagtctaactcacatcataataaggctttgtctgcctctttaaatggtgtgtctctagtacctaggacaaatgtcctgccttcattattctatctgaaaccactgggcagtttattatcagtatcttgtctccctgcttatcaattttgatcataatcttgctcagtgtttcccagctggggtgatttgactcccagaagacatttggcaatatctgcagacatttttggtggtcgtgtattgggttggggagtgccggtggcatctagtaagtagaggccagggatctactaaacgtcctaccatgaacctgacagcctccccaacaaagacccaaatgtcagttgtgctgagattgagaaactcatctagctccagtcatgcgtgatctcgccctgatcatgcataggttgtaaaatgtttcccttgccccttttattctgacattctgcctccctacaaacttatcaaaatgtatgaaaaacttattttaaattttatgaaaaacttatttttaaaacattgcacagaataaaaaatagagaacatcactgaatattaaaagttttttttaaagggaaaacagcagtgttctgtatgcatagaattgcaccatccccctggcgccactgaccctgcctgctatcctgggtcagggatgtgcagtggctggaggagtggctgcaggtgggggtggtacacacagcagggcagcttctccgagaaggctccccactgtagccaccccctcatgaatgtcacacaggtgaggtccacgaggactgcagaaactaggaagccctctgccagaggctcactgcttttccctgaatacttcagcagagagtccatggagccactgatctaggaatgggaattgatgtcagtggacagtgtccactcatattaaaaaagtgataaagagccgggcatgctggctcacacctgtaatcccagcactttaggaggccaaggcaggaggatcatctgaggtcaggagtttgagaccagcttggccaacgtggtgaaaccccatctctactaaaaatacaaaaattagccaggagtggtggcacatacctgtaatcccagctgctctgaaggctgaggcaggaaaattgcttgaaccagggaggcggaggttgcagtgagccgagattatgccactgcgctccagcctgggtgacagagcaagactccgtctaaaaaaaaaaaaaaaagtgataaaagcaaggtcttggtgtgtgtcactgacagacaactcccagacaccaaaatggctcagtctgcataccctaaataaaaatgaaggcactacgtggcaggaggggagacaggaccaaggtttgtgggtttgccgcccacaggatgggcttgcagatgccacccgcagacagatggctgggttcctctggagctttatcccacctgccccagcatgtcagttttgccatcaccggtttttacactgagattcagggcacgatgatttgaaaacaaaaatccgtagggagactcccctaggtgttcccagtgcatcaaggtagagcctgctgcaggttgagtttctggaataggtcaggctgtgtctgctttgtttgtttgtccgtttccttgcttttgtgctgcatggggaccctcacgcctaattttccttctccgtgtatacatctgcttcctttaagctccctacagtagagcaacgctcctagattcgacagagatcacttgtgtgtcatgtaatctgtgactagtaagcattaactatccaaatgggagttcgtggacggtgtctgagccagggactgcacagagctcacgagttgctgtaggtgtgctctagagagaaggtcactggggaaaaagcttgaaaacagctgtggcatgcaagggtgtgtgtaggaacggagacccaagcactgtggaaaggaagatgtgctcaggagccccgaggaagtgggctcacaggaattttccaaaatcaagagatccagcctttaactagaaagctccaggtggtatcatgagtgacattagatgatgcctgatacatggtctgtgaatgaatgactgttcaggactgtttgtttttttgtttttgtttttttttgagatggagtctcgccctgtcaccaggctggaatgcagtgtcgtgatctcagctcactgcagcctccgcctcctgtgttcaagcaatcctcctgcctcagcctcccaagtagctgggattacaggcttgcaccaccacgcctggataatttttgtatttttcatagagacggggtttcatcacgctggccaggatggtctcgatctcttgacctcgtgatctgcctgcctcggcctcccaaagtgctgggattacaggcatgagccactgtgctgggcccaggactgttttgatgttaggcagtacagcctagtggtcagcacgtggactttactggcttccccactgtgtttcaacttgggtgttgctgacatttagggccagttattctttgctgtgagtggctttcctgtgcatggttgaacatttaacagcacccctggcctctactcaggggctactagcacccaccctcctggttgtgacaaccagaaatctctgaagccattgcgtcatgtcccctgggggcaaatcgcccctggttgagaaccactggcttggagctatctgtccttgaacaagctacttgacctgtctaagcctgattttgcccttgtctgtgggaagacagagggacaatgaggattgattacctgagacaagacataggttaggagttgttactttttgcagtgacaccaacaccatggggcagacaatggggactctgtgagtgcatagcaaacaacagcaaacagcaacaacaaccagaggtctgctttttttgtttgtctaaatgggtgagcttccaaggaggaaacacaatccttatccttatttcagggccccatacggttctgtggtcgtgaaagggttatatgcggcaggccctgagattcctgttagcaataggagaaacgaaattaaatatgtactgtaatttgaagcactgcttttcatgggaaaagaagttctcccaactcagcctttccaactcttttgtccaaacattaatggcatgcaaatatttatgattcatatgtgccccttttaattcccaatcgtattttaacagtaaacacttcattttaataatgaagcagaataatccctttgtcctgtcgctgggttacacaggctggcacctggcagcatcacattcttcctgagtgatcattgctgcctccacccaagttgaaggggttttgtagcagtgccacggcagctcgccttggactacttgaggacttccggatgttccgctggaagccattcttaaggttgtgtctcagcattttcataaactgcaagtgaacatccatgcatatttttctcttttggccacgtataaactcagcactggttcatctggctgtcacttggaagggttcttactacactattatcttgcattctggccaaatccctgaactctagattacaccgaacccattgtgtcctatttaatattcctttgattcgtaatgatgacatagaaaacacacacatctattagcgatgattctgtgagtcctagaaaagtagcataatgtaatatgagaagagggcacacctgtaggactcagatgtgccagcctcagtctccccatctgtgttcaataggtttaagagtgcctttcatctatgacttatatcatctatgttaggatgataaaagcgagatggtgtgtatgtaactatacttaggaagaagagctagggcccctcttgatgatgttcttccttctacagcgagaatccctgagggaggaggggagagagcaagccagaggcagcatgggtcttgctgaatttgaaaagttgggaatgatgctgtttttcagggcccactcctcgatggcaaggaatttatattccttggtcctgctaagggcctactaaaatgagagtgcatgagataacagcaggcattccataagtattcacaagtaaaagcctatgtaataataatataattacaaacttttattgggcattgaccctgtgatggaaatatagtacctattcctgttttattagaactctccctctgccccaccccccaaggtcatttactaagggcatttctttcattcattcatttatcagatatacattgtgcacctactgtgtgccaggaactgggctagcatgagaaatacgacggtcagccaaagagaacccacagccttgggggctagtaaggaacatggcaattaagtaggccatccctgttgtgagtagataacacatgatagatgggtgtggcgggagccaaggctcagaggtacagaacctggtgaaggttcagagggtctccctggaccacttgtcattcacttgagacctgcaggtgacaaggagactaacccggtggaggcatgaagaatcatgtcccagcagagaaagcagagtgaggaaggagcacctggcctgttgggagctgagagatgctccagtggcggtggttggggagtgatggcggggagccttacagagagatagggcggggattgccttaacatccacgttgggaatttggtctgatcctaatgaaatggagaaccacttataactaactccagatacaaattgtggaaagatacttggcttacagtttaaagaatggaaaggacatttggagggtgcgtggggagcttagagacccatccagagactgaaagctctcctttctcctttcaagcagcgccaggcatgtgtatatccagcttgcaaggaccccatttggtagatggcactgtacctagaagtcagctccctcctcaagcttgcctcaagcttccctctcttccctctctacctccacactcacctgcctttcttcctacctgcagtggcaagtgctgcaaggctggtgagcaggagctgacgccccccaagccttccttccctgaagaatgtccatgcctcaggcctcccagctgcagctctgtgtggccttgggctgtgtgtttgaggcacccggctaggggcactatcggaatcaggaggaggccaggcccaggaggtcactttggtcacttgccctgtgtgaccccagcccaaacacacagcctgatggatgagtgaagactggtaaatctggtggctgtccttgggggaagcacagggcagcaggtgtggccttggtctccagggggctgcgaattcagggttttggggtgttttggttaaaacttggttccccagctgagatcctagggaactgtggtatcaaaaggaaaaggaagattagaaagggaaaatgaaatctcaggaaaggaaatgcaagattgcatgagaacatcatggtgttttgtgggataggtgatattctgccaaataaagaggcccgcccctccactccttttgcaaacctgagcttttcccctgcctgcagttgagcccagcatacctgtgccttggaaaaagcaagctatgccttccaagtgaaattcgacgttgtaaaggactggctgtcaaactgaaagtttgcagagtgattcattgatttttagagacagggtcttactctgtcacccaggctggagtgcagtggcgtgatctcggctcactgcaacctccgcctcctgggttcaagtgattcttgtgcctcagcctcccaagtagctgggactgcaaatgtgtgccaccatgcccagctaatttattttattttattttttatttttattttattttattttattttttatatttttggtagcaatggggtttcaccaagctgcccagactggtcttgaactcctgagctctagtgatcctcccgtcttggcctcccaaagtgctgggattacaggcatgtgccaccatgcctggcctcatttatcaaacttttctttattgcctcagaatagaagatacaaagatgaataaaattctgtccctgtcctcaaacaactcattttcatagaacatctccagagaaaatgctttgcatgtcttcggttttctccaagtaaaacagctatttttcaaacaatccataattccaaacaaatgccatttccatggaaaactgagttctatattctaaggacctgattttcagtctgacttttgagggtagtcctggtgccagtagcttaggcctcaagtctgcattttgcatgtgtgatgtgagtgcgattggatcaagcaatctgcaaatacaggcactttgcacacaagtatatacagtacgccgacatcttaattcaattcagcatggagaatcaggaaattatgtgcaagttgaaggatttgtatcccgtccagaaatccccaaataaattaattatacaactccactgtcaaaaatagtggcaaatgtttgggtaaggaaatggaagaggagcataagcatgaattttggctgttaggttgttccagtggaaaagtgagaaatcaaaattaaaaatacttcataaaaaatactccaaatgcagactactcctggaatccgagggtacgttaatttttatacttagttatccgcaattaaaattagacccaaagccatctattgtaaaaggagaaatctccctgcaacctttcaggatcttgtgggatttcctgaatttgcaaagagcagaacctgagccttcactgactctcttggtttttaaaagctgcgatgtttttcttttatttttcctttctcactctttgggcgtttcaagactctgggcacaactggctttcctgcagacaaacacaagagtgaaaaatgttgcgattgtgtttcctaaggactctgagcccccagggcagacggctcctttgtgtctgcagccttcctttgcgtgacaaagggcaagtttcacatcccctgaaactgtccccaaaagaagaagatgactcatgcttacagacctacactaaggagagtgacaggaacagagtctgctgcagagccaactcaggtagaccggggatacctgcaaactagacctgaggaggccgagtcacaacaggagtcggggctcgcccgtcagacacggggtgttataggaggattctgctctgatgtggcctggatgcacttttaaatatgttcttcacacctaggcaagaaatgaccccgagctgcatgtctttttgctttgtaatctccttgccaccctcagctctttggggagcagtgtgcacatttgaagcaatcctgaggtttagccacttcccagatgtggtgaggaagtggagagtgcgctgggccatgcggaactgcaggttccagccgtggctttatttgaccacaattggctgtcagagttcaccagccccagggccgccaacgtcaagactaatcaagcctagacctggggcctccccgctgactggccctggggagtgtgtcatggcagcgagtgtccaggaagactcaccccttgaccttcttcccaactaaataaagcagttagtattttgccctggcatttggatggacacactggcgtcgagggagacaacacatgttgcagtgaggagcactggcctggcttgtttacatagcatatcagccactcacagttgtgccttacaaaggtcgccagctggcggggcaggagtgaacttgaacttgaagttcaagttgcgtttaggcctggtagcagccccatcacctgctgaacacacacacacacacacacacacacacacacacacacacacacacgcacaaaacccctcctcatgtcagacgtcagtgcctacttcatccccagctccttcttacgggatctgtcacagctctggtctttgtggaatcacctttatcatgtctttaatgatcattccactgacatttactgagacctttccctgtgctctgcttgtatattcagcattccatttaacctgcagaacaatgctacgagatggaatgactgttattaacccccttttacagatgacaaagctgaggccccagagaggtcaagtaacttgcctgaggtcacacagctagcaagtggcagagcgaggttttgaacctaagtaggttgccttgagagtccacactgaatgaatcaccactgtgtttccaccttcatgggattttatatggaattcttctctctcactgcttccaagcctacatcaagacaaacctcatctgccctgttgttttttgttctcaccttcttattcagtatgagtgtcgtttggtgcttctaatggtcttctaatggtcctcctggaacccaagccctggctggaactgatgctgctgtggtggtcagggttcagtgagcaggaggaaggacttggtgtttaccccttgtttacccctttccttggcttccttccatgcaggccaccctgtgaccccgtggtggccccctctggaaccaagagctgccgacttccagcagcacacacaggatcagtgctggggccatctgtgcactgaccaaagcctctgctggcctcaccagaccaaggccagtgagtgcttcagggagccttggatcctccaggctgccaacagaaacaccggccctctcggcagcagccccatccttccacccctgcactgggtcctgaaaagcccattttggggccgttgctatttagccaacctgccctcccttgctctcctgtgatttctcactattccggctgcagctcgctgggagaaacacttgagagtcttttgtgctccacacccatgtacttaaaataccaggcctataggtcatttcaatgagggaatttggctcataacacgtgtgccccgaggcacagatcctacttctgcagatgctggccaagaagggctgtgtcccagccgccatggggtggggccacagagagggcagggccacgtggagggcagagcatgtggctcctgtcaggtgcgcccgttgctgactgcagcccagtatcaaggctctgctgggtctcattggaagaatacaaaggacgtgtaaggcagttttcgtgctgtggaaaaatgtcacctacacctgtgaagaagtcatcactgtgtctgtaagataataagcaaatgtccttgtacccaaagctgtaaacaagagccctttgtgagggagaaccacatgactggccaaaacgccccacctactagtgtgtgctcggtggaaatgtcttgtgactgtgcttaaaatgaagggcatgattgggaggccaaggtgggcggatcacaatgtcaggagttcgagaccagcatggctgacatagtgaaaccccatctctactaaaaatacaaaaaattagctgggtgtggtggtatgcacatgtaatcccagctactcgggaggctgaggcaggagaatcgcttgaacccgggaggcagaggttgcagtgagccgagatcacgccattgcactccagcccaggagacagtgcaagactccatctcaaaaaaaaaaaaaaaaaaaaaagatgggcatgaaataatgagaattcagataatgaccattcatttcacaaattatcactttgattaagttttactcctgattatataggttagtctgtggtttaccagacggggtgtcatgagtgctcaactgccagaggcccaaacgcagctcagtaagaaaatgcttttgagctataacccaggttgagtaccattggtacattagaatcacagagtcagattttactttttggggcagtggtaggtgtggataaagtatctccagtccagatttcttgtactggtgctattgggtttgcgggtggagatttatgacctcagggataataaccggaagaacagtgagtagaaagctcagggatatgagttttgctgtatatcaaagctgtgtgactttgggaaaattacttaacctttctgggccttagctttgctacctattcatcaagaacaataaaatccatcttgtttatttcatgagattggtgtgaggaccaaatgaaatagtatatgggaaggtgtttaaaaagttgtaagttctacacgacttaaaaatgccagtattatgaatgcaaccattctttgttgtcatttgggtagtcgtggatagcgtggtggtaggagagccactatcggagcaagactgttccagagggtaaaacacacgcgtgcctgtagagcagttgtcactggtagagccatgatgggagctcttactacattgctatttgtactgagttaaatagtgttctccaaaaagtgtatgtccacctagaaccttaaaatatggcttaaggtctttacaggtgtaatcgagataaagtcatactggacttgggtgggccataagtccaatgactgatgtccttctaagaagagggaggggacacccagtaggaagacagtcatgtgaagatggaggcagaggctagagtgctgcagctgcaagtcaggaaacgccaagaaatgctggccaccatccgaagcgagaaagaggcaaggatcctccctagagccctcagggggagtgtggccctgctgccaccttgatttgggacttctgacttccagaattgtgaaagtcttaatttctattgttgtaagccacccagtttgtgataatttattacagcagccccaggaaacaaatacagtatttttatgaagtcactgaggtgctagagttgtaggcaacagaagaatcacacgtggacctgcccgcctgcacatggctatgggcatctcaggccagctgcattcttggaagatgaaatcagagagttgaaagggacattgcatgcatcccatgaacccccctcattttgctgatgaggaaactgagatctggagaggtaaaatcgtttgtattgcatccccaaacttgtaactctcttgctgaaagaaccacctcagtctctctctctctctctctcatacacccacatgcacccctagacctactcaggactgggacaatggcattatctattgttgtgtcctcaagggacttttttttttttaattttaaataccccctctctcctaaagccccttcccacttgcaccctttcccacctttctgtgagggctacatgggtatatagaaaagggtccccaccttctgggagactaggtctacacagccgcaaactgcattcagtatgacaccctaaataatcaaaggtgaaggatgatttatgaggcagcccaaacagccataaagcaaaatgtagtcatcaaggaaggctgcctggaaaacaagtgactgagtgactgcccgttgccagatgctgaagggcaggaagactcgggtgaagggtgcagcaaggagccttggattggcgaagtggctggaggaaggaagacctcagcatctcaatgccatggctcatgggtagaactcggagggtgcacactgggagtcaggtatgcggaggagagggggtgagtgagaaattacttggggcagggtcttattagtgagaagatcctaaaagcaggttctggagttcagtcttgatgatacaggtgataaccttcatgggttcttgacagagagggaacaggctgaccatgaggcttgtaggacaatctgttagtcagctctggaacatgtggatgtggctgctccccgtctgtggctgtcattgctcctggatctgttcttggaaagccagagactgcccagtgagatgggcagttgcccccaggacctgcctccctctgcggcagcatcttcctccacatcacatcacataccctgcttgctgggcctggccaaggcctcttctacccagtcctctccttcagctagatgccacggtaggaaagcatccagagtgtcgcctgataacatctgaacgatgtcctaaaactggcaaatccccaaaggccaacaagactcgtctctaggttctggggacaggccagttgatgggaaagatggatttggaggcagagtctcctggcatccctgatgctctgctccatggaagtcactccccagaagcatcctcacctcgtttattggacaggtcagctgagactttagttataaaggcacaatgggcagagcagccttcatcatctaattgttacttgctattgctctttttattatagactttaatacagatagaatccacatctttggggagtgttcggtggagatttctcacgattaggaatcgtggcttgctgtggccaaagattatattttcattgagcatttttctgtggccttcctttgtattaagacacgcatgacatttgtttttctgtggccttcctttgtattaagacatgtgtgacaattgaaaatattttcctttcatctgtctttgatttactttatgctacatgattaagaggagaaactatgttgattaaagaactactgtattgatgtaggaagattgaacatcagacttaatcaaatgttagggtcctattatagacccgtgagaaacagagaagagaaataaagcagacaacatacacacacacacacacacacacacgcacagacacaccctgttgaataccgtgtgccagataactgttttaacagggttactcacggtaaatcatttaatctcccctaaaactctctaaggtaggaaaatttgcatgtaaccatcttcctggtaaggatactgaggaacatagaggtgtctagtgacttgccaaaggtcagctagccagatttatcttctgaatcactttaccaacaagaaatgtttttagattagtaaatctatgcaatgaagattttctcaccttttataaatatatgtaaaatgtgtaatggaaattttgtgcattttttattactagtacttattgaatctcagtctgtcagttacatatacttaagtccatttatgagtcatcaattttattctgactgatcccatgagtacctctaataacatctggcattttcaaataatatttaaaatcagccagacttcgtcttttaaaaatatagacagaatgattctaatttagcctgttttcaaacttagaaattctatctttcctgatcttcaaaggtacaaagtaagaagagaaagatggatatggtttcttctactcttatttgccctgaattataaataattgggaaagatgggagcagggaagttgggaaccagaagtggagagctgccaatctgactctatggtttccggaaatcctgacttaacagaaaataaattctaatctttcttgatcttgtattgtttattgatgattacattaaagccatataactatgtgaagtgttacacttaggcaactatcataggtgtgtattccagaattgaagcaaagccaaaattccgggagtgttgtcaaaactggtaacttgtgctgaagggctggacagcataaattaatgattggttattcaacagatatgttcaggccaccaacctcattctgttttgttctctatcgtgtccccacagggaaaagcttcactctgaccatcactgtcttcacaaacccaccgcaagtcgccacctaccacagagccatcaaaatcacagtggatgggccccgagaacctcgaagtaagtgcatccacttggggctggtacaccctccaggctggtacaccctccaggctggtatactcagggaccatgtctcagattccttgggttcaacctttcccccagggggatgtcaggcccccgtaaagccaaaaagttgcattgtcaatactctcgctactcaaagcttgtttctgtgcactgagctctttttgaagcatccttttagagggcaaaaggaaattaggctgactgaatcatatgttagaaccattcagggcagcatgaaactaaggactgcttcctcaatatacagtaaagttcaacaggatcagaaacaaatagtaaatggaagattggccaggcacagaggcagcccaaagaggtctgagggtcagagtggaccacaagggagtaattaccgtctatgctggccttttattaattcatgagggccagagatgaaaactatgaaaatgacccttttctttctatggcacagatcaaaatcttattacaggcatttttaagatagagagtgggagggtagaagaatgtctggggaaaaccagtaaatatagaaagatagtaccaaaaaataactcctgtgagggaagcttttaaaaaaatgagtgaggttgtttagtctgcagaaaagatgtcttcacagtgacttaatgactatctttgagtaaacaccagagtaacgctcttttccagaaccacacccttccccaggatctgaggctgggttacagttccaggtctgtggaactgcccagcacccccgcccagcatccagatgtctccaaaccgtatcaggtccctggtggaaaattaatatactctcttcttggagtgagggatattgaaaaacagggcttcctactgtccccaaaagccaagatgcagggaggtcaggttgtaaaatgaagtggttaagaatttgggctttatgggcaagccagtggaattcttaagccttcagtgagctacagagccttgctgaacctcactttcctcttctgtaaaatggggataataatgagagcttctttataagatcaagccaaatgatgctgtgtgcctgatgcagagaatgaaggcaggaaatgttagtgatccccagtagggcatccctgctttcatccctggctactgctccagtcccctctagatgaccttccctgcatggtggtttctaggtggggttttaaggtagttctctgcaggctatcctgtgatcacggcagcttttatggcagccttccctgtggtcctggccacaacctcatggcatctgggtcaccttctggaaccattccccaagctgcatcaactttcccaaagtccttgagtggatggagctctgcaaataatcaccatgcccaccaggggcaggccaccaggatatggtgttcctcgtctgctttttcccttccttccatttgctgtgctcggtgactccctccagatctgactgcatttttccccagagggccctctcagctttttctgatcgagactttctggccatgcctagacttgggagactgtgggacttgataacagaccctgattcttctttatgagtgaaaagcaggccatagacacagacaggaccacacaggtctaaggaatgactgtgagctcttcttaggtttccagagtaggaatgtcaacctggacattcctacgttaatgtaaccctgcattaaacagaacataaacaccaaagcaagtttgttctccacagaggaccaaagaggaagcaggcttgaattatggcaaggggcctggctgggagggaggcagttgttaggtataagaaaatcgactttgagggtgactaaacttagagaaatgctccttcaggaggctgtagaaccactgtatttagaactagaagcaacagccgtctctgggacagttgaaatgccgaccagcctgaagaagccgaagccaggtgaccctgggtataccctctacttctcttatttcctcatgcataaagaaggctgggttttgcctcactgccagcatttcctgtaacattcaaagaaataacaaagttattgagcttcagaaaacaaatggtggcgactctgacttttaagaattggcagtcagaggggaaaaaagatgtctatgcgattgtaacggtctggctgtatatacagtttactctgcccctgctgttttacaacttaagaaaacagttgttatatggagaagcaccctctgagcagacagaagggatttgcgccaaagaagcatccatttttacacagtcttccctgccaaatggaatttggggcctggggaaaaactaaatgcgtggaataagtataagtatgatatatagaggtgcaatagccccaggtagaaagtctcacattttacaagggacttctagaaaaaagccaagtgcatgcagactcccaggttgacttgggtaatgctgacttttctatttgccctgtgaagcaagaggggccatcactgctaattttagtatgctggtttcttatggtttgaacgtcttcattcagggtgggaactttctatagtaagctttgctcacagttgctttccagtgtaacataaagagaggacactgcatgtaaatcaggatgcccagatgttgccagatctctggatgaataagacctcccgagtcccctccatgattatggtgcaatgaattctgggaaatcctggcaaaatggccctggcattgccaaggtcaaattgaatcattttggaaaattctctagtttcataaaatcaaagacaatgagagctaggaggggcctgagaagagcctttaggatcatcaccccataggtaagggaaaatagccccagaaaaatgaaacggtttgcctagctttaaaagagatagttgatgatgaagcgttaacagaatgaggagttcctgatgtctacttctgtgctgtccttcatttatctacctgtccattcatctgttcatctctctatccataccatactgtctgtacatcatctatttctttcttatagactctttgacctggcctcggtatcctcacatttaaaatgaggagttggcttatatgattggctggcatatttggctcatctcgaagactgtctattatagaagggcaaatggtagtgcctcattgcaggtgtggagcctttgacttgaggtatgcgtgcaagcttaactaaataaagcagttatctggcatttggagggacaaactgccattcaacctgccattccgctgactaagttaaggactgagaatgagaagctgtgccacagctcgtctgtttttcatgccgacgggtaaacttgatgcatccctcccctcttccagggttttcagtggtgaagctgtagccaaaagtatacgccaaagggaatttaaagtgtttttcgtttcagatggtttcttgctcttttacagtaatggacctgccccttagaaaatcaaaacttgtttttctcatattccataggattttaagaaatatcttagagtaatatagaaattattaattgttgaaaaattaactttatcatggagcaagagcaccatcaaaaggtatcctctgcctggaatgggttcttaccagcaccaaggtgggctctgttttcggttagcacgtagagcacttagtagcttgttgatatactgagagtgtctcctccttaagcacaaaagatagagcgaaaggatttttcaagaaaaggatatttgagagttttttgtttgtttgtttgtttgtttttgagacagagtctcactctgttgcccaggctggggtgcagtggcacaatctcggctcactgcaacctctgccccactcccaggttcaagcgattctcccgcctcagcctctggaggagctgggactacagatgcccacaaccactcccagctaatttttgtatttttagtagagacggggtttcaccatgttggccagcctggtctcgaactcctgacctcaagtgatctgcccaccttggcttcccaaagtgctgggattgcaggcatgagctactacgaatggctgagagttgtttttttaatgtatgttttatatttctaggatctaatgaaaaactccagctctcagctcacaaatctgtaatttaggtgtctctatgctaatattgagatcccaaagcatcttctctacagagatttcattaaataatttcaatgcaggaattggttcaatgccatggaggaagatattttgccaaggagaggttgaggagagtgagcagtggggaccctaactgacccgtcttggggggctggtcctggtggtatggattgggcagcctttacctgtctggtcaggtgtttgttacgtctggaacattgagaaactaaattaaaaatcaaaaaggttaattaacgtattggccatttctgagataacttctgtctgtccccaggttaaaggagtctttcacgtgactgtgttctgcttgagctcttgatttttttgtttgtttgtttaattaaatatagttatttctattttaaaagtgaaagagctggctgtaattttggaaaggtgtaacccagcagatgccgggaagtacaaacctggagggaaggacaggcctctgcagctgcccccctcctcacaggcaaggatgaccatgtctagagctcacgggattccttttgggtggaggcagcgttgcctctgctctctgggcagcccgtccttgaggaccaggctgttaacgtagagtcttgtgatgtggtctgtttaagggtggggcttctagcatccatacatcaggtgacatctgggatactggcttagagggcagctagggagtaaggtaaaatgtgcagctttcttttttctttttttttttcttttttttttgaggtgaaatctcactctgttgcccatgctggagtgcagtggtgcgatcttggctcactgcaacctccgccttccaggttctagcgagtctcctgcctcagcctcctgagtagttgggattataggcatccaccaccatgcccggctaattttttaatttttttcatagagatggtaaggtggagccattacttacaaactgtagagtgcttcctgaggcactagctttctttctgtctgatttttgtttttagagggagttatagttaaaataggttgatcaaagggcctaatcttcactcagctactttttaaagtacttggttgagatcatgtcatatgagtataattcttctatgactttgagtgtgtatagcaaacctattatatatgtgaacatgagaaataggatctttatatatggagaatgtgcttcaagtgaagaagagaaatgcatgaaaagtacctatgggccaggcgcagtggctcccgcctgtaatcccagcactttgggaggccaatgcgggcggctcacttgaggtcaggagttggagaccagcctggccaacacaggaaaaccccatctctaccagaaaatacaaaaatcggcctggtgtggtggtacacgcctgtagtcccagctcctcaggaggctgaggcaggagaatcggttgaacccaggaggcggaagttgcagtgagccgagatggtgccactgtactccagcctgggtgacagagtgagaccttgtctcaaaaaaaaaaaaaaatgaaggaaggaagggaaggaagggaaggaaccaacctgtaaactggtggtgataatggacctaaaaataattgctcttaggattgagtaacacctagttcacattgttattttctcttaatcataaaaatactcgataatagcaatagctaacattaaatagtgttatttgcccaacactgttcacagtgcttcacgcatattaatttatataatcttcaaaagaacaggcagggaaattgaagaaaaaataaatcgtataccttgcccaaagtcacgcaactagtaagccagcatgtaaactaaggcgtccagatgctggcacgcaccgatgccagggtctgtttttaagaactgcactggccgctttttgagcttcatggtaatgtaattcctgtattttttattgggagagtttatcagtaaagttctgggtcacatacagttttcttcaagaaagcagagccctgttgctttggcattcatcattttttttgtactgacaggagggaatcagtgttttccccggcagggctgcaggaagtaccctcccctcccacacctccccagagttcataatacacagccatggccatgctggtcacaggtgccagcagttggttctgcttctgtcaccagggtccacttggggacctggcatgaagggggacctgaccccggggtgttgtacaacatagacctcttcttccggtgttggccttcacgaaagatgggtaaagtggagtgacctgcagagtagtggtccaagtctgggtccccctttaacaaagggtttcgtggagggcccgtgtgcacagcacgtagccgccggggggatgaaaagatgtgtcactctttgctcttgaatgattatgaaaatgtcagatggttttatggatctgtgatctcaggattgtaattaccaatccacaatcgcattgctcactgggaattgcttcaagcgtattttccaggtagtgaatgatgagctacttaattcctcttcccttgaattcatcagatttggacttggactttagttctttctagatgcaatcctgatccacacaggaattagaaagtaattcttcctcccctcccacctaaagcaggagcaaggcagaggctcaaagaggaggaaaatgctgtcgtgactcacatcccctcctccccactttgaaaggcatttcaggccaagctgaaagttctgggggaacttccccctggtacttttaattccttctgtgttaagctcctcaactacctgatgacttggcaaaggcagtttttaaagcattaataataatcgtgcctaaatgtttccagcgaattttagaatgtctttctgttgaatatttttagtagtatcaaaccagtccaagaagaagaattttacatgcatacagacttccttgaccctagagtggaggttaaggtctgaaagggcccctggggtgaatgggaacctaagaggaccgtgaagggaatgggcttctgtcccagaagcggcagtaacccacctggtgcagctctgagtgagctggcgtggcctgtgtattcttggtaacttttcctgtcttatacagaaaccactgaggttttttgtgtgtggttgttgttttgttttgttttgttttgttttgttttttgagacagagtcttgctctttcgcccaggctggagtgcagtggcgccatctcagctcactgcaacctccacctcctgggttcaagcaattttcctgcctcagcctcccgagtagctgggactacaggtgtgtgccaccacgcccggctaattttttgtatttttagtagagatggggtttcactgtgttagccaggatggtctccatctcctgacctcagctgatccacccgccttggcctcccaaagtgctgggattaaaggcatgagccactgtgcttggccaccactgagattttctaagatggcatttgtattgctatagaaagaaaacaaaataagagttccttccaggtaatgtgaaaacccaaagagatgatctaggcaccttctcaatccaatgtgggagcagagaagagggaagaaacttacaccattacattgaatttctctttccgtctggaccctcgcaaaaccatatcactaatttgaatgccacaccagtgaggtcaggatctaaactaatatattgcagtccttgttagaattcattgtatgacatgccataagaaaaaaaaaaccctgtctgcatttaggcttctgtttcttaagcttcaaacatgtaaaaagttttctggatcctgaatttagggacctgggttttcacactggtgccaccaggccagtgggtgtgaacttgagcaattatcttaaatactttcgtcttcattttcctctcctgttgaaccaggcaatgggacgagataatctctaaattagttctcatgcaaaaagggtaacaaaatatggtcagcaaaataaagccgtaagttcgttcccgtaaactggccccttagaggccgaggcctccaggccttccctgggcagtgccatcctaaatcacatcaggcaaatccacatgcactcaggtggtacatgagatagacgtcgtttttttgctgtaaagtttttaaagggctttctaatttgttctgaaattctctggctgtaagtggctgccctgccttctctgccaccaacatgtaatcaagactaggggttgaggtctccattttggcacttgctaacactatgagagccgattcctgggggagcagctggtctgactgagcctctccaaaacggggacagttggtagtaccaccgtcacatcactggaaggctgaatgcagcagcctctgtggcttagaaccatgcctggcacacaatacatactcaaaagaggacaggtataattcagatttagtcttgaaatccttctggaaatgagaaaactttaaccaaaaaagatctgtggctcctaaatttaaaaattcatgaagttgccataatggtacacttttttttttacatttaattaaacatttataaattttgatttatttttctggatttcgttttgtgttgagacccagtaaaatttcttttctagtatagcatgggccctggaaacactctgggcactgttcctaagtcactaacgggtgaaatggccttgcccccaaatgttgcactttgtgaaaaagtcagaaagaaaagtcacgtgtgggtgacatcaaacatcagtgcttaagatctaacacatgggtcctgttcagtagaggcatgacacagctgcagaagtctccacactgtcctagaaacgtgacgtgtaatgtagcaggtgtcttggggtcggaattcttgtactaggcaaatgcagtgtgtctcccaagcgtgcctgggatctctccccgcagccaagctttgcaagcacataaacatggccggccacccactgagtttcctaaatcagtgaccagcactggagacccttccatgtgtgcaaggcagctccgcctgctgcctgtgtcctttgggggtctgatggggcagccccagtctgagatggtcaggccttgtcattgggtgcacgtctcccatggggatggatggacccacagctttcagatggattgcggttggcagtcacagcatcccagcacattaaaatacatcaactcctgtgctttcaggtagatttagaatttttctcataccctagccactttccatttttcattttgaaaaatttctccttgagttttctcaaaggcttcagttttttttgttgttgttgttttttcctgtaagccatgtaactaggaaaggcattagtaagaatttgatacactgggtctcatggaactccactactaccaccaaaataataatagtaataataataataataattccagtttagcttaaataagtaaaagctacccccttacaccatatctgcatttaaattcatttgagctgataggcaatttctgtgttctcctgttcatcgcatattcttttcctttaaaggcaacttttagagaaggtttgcttttttttgctatcaaagtattaattatgaaaagttggcaatacagaaagggtaaattaggtataatctattaccgtacattatggctatattatcagacatatcacaagccagtgacatttagttggatgtgaaattccttttttatagtatgattgacacatggtatattttcatcaacttctatgtgtaaattatgccgtgtcactggtaaaatttgctgtcatgaatagccaaatattctggattcacattcataggtgaaagccaagctaatatatatatatataatatatattatatatatactatatattataatatatagtatatatataatatatatactatataatatattatatatagtataatatattatatatactatgtatatagtatatataatatattatatatactatatataatatatatagtatatataatatatatataatatatattatatattttatatataatatatattatatatatattatatatatatatatgtacccaaagcaaagttcttttctgtttgccttttcaaaaagtaacacaatggaatcaatctgccaactctcaagacccctagaaagttatttaaaggcagtacattggtttggtactttcatgatatacatatacttagtttccattaaagcaattattgacaaaaacccagactgctattgaaatctttcagtgtacttccatatactgaaatgtcgaacatttgatacttgtttgattttgtatttgtttttgttcaccatggcttaaaagtcatattctgattatttaaaataaagagtaaacatttgaaataagttcctagatactacatagatttatggccctttgaatattttcctggtaccaccttattttcacttacctttgaagtggttgtatgatatttccagttcattcatttgaaagagctaggagaaatatgcggagccacgtcccacgcgcctctcggacactactcgccaggcatagcccagtgtttcaaaagtgaaccagggggctgggcgcggtagctcacgcctgtaatcccagcactttggaagcccgaggtgggccgattacctgaggtcaggagttcgagaccagcctggccaacatggtgaaaccccgtctctactaaaaatacaaaaattagccgggcatggtggcaggcgcctataatcccagctactcgggatgctgaggcaggagaatcacttgaactcgagaggcagaggttgctgtgagccgagattgctccactgcactccagcctgggtgacagagtgagactctgtctcaaaaaataaagtgaaccagggtgctcaggtagcctcggtgagcgagaaaggagtttggagcttcaagtctaaaactgcgtttcacagttttcccatctgtagaatggactgcatgatacctctcttgctaggggatgtgaggattaaaagagatagcctgaaaggcgagctggagcagtggctgatggcgaagctccagagctggcttcctgattcagcctggcctccccttcgggatcagattaacctccccaccctcagcctccttgggtataaaaccaggagtatgatatccctctgttggggattattgtgcggattgaataaaataattcatgttagggcatagcaccgtgctgggcacagaagtgttccttaaatattagctgctattattaaagcacatgctctagacgggtaggccccttgaccatgtcccaaagaccttatgagaggaaacaaatggaattctgttcaagtgggggccaaatatttaccattgccaagtacttaaaaaaaaagaagaaaaaaaaaagcttggcagatttggccctcacaatacagtacaataagggctttttctcttttccttccatactacctattattaattccaattactgcatcactgaactggcttcaacaaatgtattcctcattgaaacataaccctgtcaaccatgttgccctacttccttgagggagaggtgatctttttccaattaaaggttttatcaaaatgcagttctgcttcttaacatgaagcacctatgctgttgtgtgacctgcaaagctctgagcatctagaagcttcccctgggtcatctataagatgggaataatactatgagttctgcctactgcacagggttcttgaggacacattgagataatatatatcaatgtgctttttaagtagtctgtcaattagataatataaatataattagataattaaaaaatagaaaatctattattgttttgcatgtactatattaaaatcttagggattttaaataaaattaattgatttattgaaagtagatattatctcgtcgtgtctttcaggattggtgagaagaaattaaagagaaaaaatttaaacatttaaatcagaccccactgtgaatccatacttttagaaattttacctttttccattcacatatcttaatgttttctctacctacaactagataccctttttaaatgttggaaacaaaagaagtaaccttggcaaatagttgagaactgagttttatatgaatatacttttctcttgcaagaccaaatacagtttttcttctaaaactctgttattccattttctttcaatgaaatgctcacagaaccagaaggcttgggaagaggctcagagcacctaagagttgctgagtccgtattccttttttcccctgtggctttttatatatgctgctcgcctgagatttctggatttgatttcagggaggtgaaatgttacacccctgagtctcagtgccagtttcccaggacgagtcaaaaactgcagctgcttggaggtgagaatcttccaaggctccagaggccagctcgctgtcctgttcatttgctgacatgctgccgggagcagcttcagagaaacccgttctattcttcgggtgattcagccagtctcaaaataaataggtagctgagtgcagggagaaagaactggaaaccactgaaatttgagtcttgagggctggtctgttctcgggagctgctctgttgaactctaaaaggaatcttgagccctgggcgagggagtggcctgacctggtggaaagactgcgggcctgcccgtggagtctatgtctggccctgctagctcagtcaatctcagcagctcatgtctcctcttagaccctcagattcctcatctacagaaggagaaagaagaggagattgaatgatttttaaggtctttatcagcttctaaaagtttgatttgatggttgtaggagcaattgttctttcaaagcaccatcttctaacctcaggaaggaaagcccaggggcccctgggatgtcctgccaaactgggaagacaaagattgtgactgagaaggtgggggcagggcaggagaagggggaagaagggagaatggatcaaccccaggccggggaaagagatgaatgaaggtccacgccagagtgacatgctctaagtaggggaaatcttcctaactagagttcccatgactttggcaacatttgaaaaaaaaaaaaaaaaaaaaagacatccttaaacccacaaagtactcaattgtccaagccccattatggccaacttcccaaagctggctggtcagagaccttggtgttaattcctcagccaactaaaaaaagatggtgtaagttctgttgacttaattgttggagtgtttctgagtggggccgcctccctcctctgcctcctcacagtattatgggctattctgcattacctgccctacctatcttcataatctagccgcaaacagctttggttgaccacaccacttccctattgaaagttaatactgtttgactcattctgtgttactaacctgaagccaaagaaaacaaggcagagaataactggcttgtgtggagtttggaaagctcttggaggccctgctttcaaaatcctatacagtagctttactatatctctccgctgcagctgctgagaaaatgaaggaagcagaagtggttaaaaaaaaaagttgggggtggggaagagactgggaagggagtggggcggggtccccctccggctgggaaaagacagggtaatctgcggcagtttatgagggctgtctccctgagctgaggtcttgctttcacacaccagagtgttcacacagaagagggactgttgaaggagttaaaaggagaggaaagttcaaaacagttgttgaaaaggcagctctcctattgcctgcgtaacacagaggagctgggaggctggtctcaccaggccaggcagccataggcagagactcaaggtagacaggccagggggaagttgtgtacctttcgaatcgggaaaggattgaggagggggaatgttgccggacagaaggctgtcctgggcgtccatccttgccctccatccctgtctccatccctggcaaggatggaaccttcccttccttcatttcctaactggctcaaatgtggtcaccaaggtgaataggaggcactagtgtcttggaataaacagaactttccctcccaatgttacctggcagacagtgggaccagcatcttcatcaccatgctgtgctctgtgggagtctaggcaaacagccacttgcccattcaggtaactttagaagaggtctccctcctcacagatgcccttctcagcaggtggctgcttctggcacgtggacaacagtgcatagaagtgagcctgatgcctgaatgaggctgtcatgacacaaacaaccggaagccttatttgtgagggagggtcaacgttctgttcaaaacaacttgctgcggttggcttttgtactagtgagtactcaggagctgtgagtggccagggtaccctgtccttctgtaccagccaggacctgctcagccatctgtccaagggctttgcaaggccagcctagaacctcagttggcgtctgtgacaggagagagcgtcagagtcagatgctgttcccctgctgttgggaaagtccccgaggcccagggggcagggcttttagaaataggagggaatttccttccctctttttagaagtacagaggaggagagatcatcctccacactgctggatgagcattccagaataaatctagtccaggaaaggggctcactcattcattcattcactcactcactcattcatttatttgtccagcatttatggaggcatcacccaaccttggaagggccctgcctttacctcggtcctgtccaaacatgctcagtgtctctgcccattatgtatgagatctgctgctgcgggaggggaactgagattcctgcagggaggttaggaggccagtgtggagagcctcagtgctggtaacatgctcacgcaagcagtgtgtgtgcgcctcctggatcttcttctcctggcccccaggtcttgcctgtctaccccaggactagccctgctgatgcctgaactccaaagccatgtcagaagctccaggcagcgttctgtgagtcagtgctcatatctccatagtgcgccacccgccaccaatactttctttctcttctgcaagtcgccttctctttagagtctgtccctgggcaggagctactctgatcaacaaatccatgtcactggtggttaccactctctggttacttttcagttacgctgtaactgggggtttccttgagataagaccttaacctagggagggttgctaatatttgggattataggctggtagaagaagaaaaaccttgaatttgggagctgtctgcacccttcttaagaaactgcctccacttcccccacagagggctacctctggtcaagagcaaaagccagcaggtggcttctctgccctgagctcaagttacctccttagtcaccagacagaaatggacagtgagccctggcgaccggggatggcagatttagattttgagtgctctgcttttaggagaggcccgagtctcatgtgagtgggcgaaaaactccactgctcgtggcaatgagccctggactcagggagcagagttttgtttgggtttttgtcccgtgagtcttgggcgcatggtgcaggggggctggggaggggcaggcctgtgtgcgtctctggcttgaagttgtattggttgttgatcttgccttggcgttggccagcctttcctgtccattgactgttgcttgctacacttgtcttggcccatgtcctgagggcgatcacagaacggtgtgtgtgtgtgagtggatgtatggatgtgtgatggatgtatatgtatgtatgtgtatatgtgtgtatgtcagtatgtgtgtatgtttgtatatatgtgtccccatgtctgtatatctgcctgtgtgtatatgcatgtgtgtccctgtgtgatatatgtatatgtgtgtgtgcgtctgtatatatgtgtctgtcctggtttgtgtctgtatgtgtatgtgtgtctgtgcatgtcttaatatatgtgtctgtgtgacgtatgtacatgtgtctgtgtgtatttatatgtgtgtatccccatgtgtgttttatatctgtgtgtgtgtccaggtgtctgtgtatgtgtgtgtctgtatgtgtttacatgcatgcctgtgtttgtgtgtatatgtccatgtgtgtctgtatgtgtgtttatacatgtgtgtccatgtgtatctatattttgttttgttttgttttttgagacagagtctcgctctgtcgctcaggctggagtgcactggcatgatcttggctcattgcaacttctgcctcctgggttctagcaattcttctgcctcagccacttacttgtaactgggactacaggcacgtgccaccatgcccggctactttttgcattttttagtagagatggggtttcaccatactggctaggctgctctcgaactcctgacctcatgatctgtccgcctcagcctcccaaagtgctgggattacaggcatgagccaccgcgcccagctgcatctgtatgtttttatgtgtatggctgtgtccgtgtgtatgtttgtccatgcatgtctgtatgtgtgtatgtgtgtgcatgtgtgccatctgtgtttttgtatgtctctctgtgtgtgcgtgtgagagggtactcactacaaagaaacaggagaagctggtggactttgcttatgtcagagtgccactctcaactcagcaaaagagcctttgacctattctttttgatttttcactatgaaaataaatgagttttcctgattgatttaatttttttttttttttttttttttggagaggtctccctctgtcacccagtctggagtgcagtggagcgatcttggcttactacagcctctacctcctgggttcaagagattctcctgcctcagtctcccaagtagctgggactacaggtgcgcgccaccatgcttggctaatttttttatatttttagtggagatggggtttcacaatgttggccaggctggtcttgaactcctgacctcaagtgacccgcctgtgtcggcctcccagagtgctgggatgagccatcaggcccggactgattcaacttctaatgagacaattctcatgaaactgctcagttatgatattgtattttttctcaacaagaagtttttctgtagttacatttcagctgaaaactttaattacaacttccttcacctgaaatgatttctgctttcccacaacctagtggagggtgattggacagcaccaatcatgaaggacctgagtactcattcattcattcagccaacattagtgagcctcctaggctccagttggttttataggtgctggagacatggctgtgcagaaaaaatacaaaatccctgtctttgtagactttacagtcccatgggtgcagacagaccctggataacattaacatgtgctatggagaaaacctaagccaaagggctagggactggctggatgtgggatagtctgcaacttaaaaggggatctccaggaactcctcagggagaagatgacatttcagcaaatacttgaagggtgggagggatcaggtccacagggatctcagggaagagcttcctgagcagaggaaacagtaagtgcaaaggccccagggcagtgacacaggggcaagagcaaggtggccactgctgccggagcaaagaggggagctcaacctatctgccttctagtttcaagtaggaggcatttgccttagaaaacaggcttaagaaaatgccacctgacctcaggtgacatgacctgtacttcatgtcacctgagaggccactgtaggaccatggttcgggaaggcccagagtaggaaagccccatacacaggtggacccagtgagtgcttgctttcctgttaccacccacaagagtacaaaagctctttccgaccaaaggctctgctattcctgctggtgattctctggggctaaagcatcacccctctagaaatcgctgagtgggtaaaagggattcctaggaagtggaggtatcctaggggacttgccaggattcatccacctctaagaggcttaggggcatgagctagaggaacaggggcctgcacagggagtgtgggcggggtgggtgacaggtactcacctaagacttatgtgcctactgccactgatggaaaaggtgggcattcagggcagatgtctcattgttttccaacccagacaagaagctgggaaatgagagcctggatgagtgttccgcagagtggctttcttcccaggtgcagcctctgacaacttcctagcaaattttaaggtgtgtttaatgtcccactccctctggactcagccttgggatggtagagggggaggggtgaaagcagaatggaatgtcccagtcagtagggtagcacgaaaggctctgtgaaggcttaagggagagaggagggcacctttgaatactgaagtccaaggtcactcataactaactgtccaaagggtcactgatgaaacagctggaggcagagggagagtgaattcttaggacacctcgtgcaaagctgctgacccccagcacacagaaagatagagcaggccaggtgggatcgcaggctgggcgacctggtggggatcaagacagagctctgagaccaacctgacagctagacttggcagtggctcccgcagccaggtgtctgcctgaaaaaagacaaaagggaaaactttgaaagtcgtaacctcattagaagttgttcaagaaagaccgtgcttagaaccagttgagtagataatggcagcagatgtaattgttgtggatgcttttagagtcccttggagtaatccttcttagtctcttaattccaggcttccagatacggagcctcagtgatgaagagacttgttcttgtccacagcaaaggttggtagaaaagcagatttagaatggagaattcttaacgcctactctagcattcacgtttccctgggaccatgttgtttctctagaggggaggaggattgtggcatctgcattaacacccggtcctgtgggcactcagagaacttaactgctgcatttgtggaacggaataaaggttccatgtaacccttccctgccattccccaaagtctttctatagatggcacagcagaaattacttcctacttgagaatctggggttcaccttagcaatcagactgattatcatgacagtgactctgacagaatgtgcccagttattgtaggagacagagacggtcacacaccggcctatctgcagggcagagtttgggcattttcagctgctctgtgtgtattgaagagttaaaaaaatgaaaagacggccaaatagttatcaccaaaaggaggccgtcagtcattgctcatgaacacagtctaaacacagttcaggcatatttagttcgcgtgtttctccccagcacacagcaaatcagaagcaggcaggagaagggaagtagtaatgcacattggaagcttgagtatcaggaggagctctccctctcatgcagatattcccagcgtgctccctgtatcggcagcctcagcatcacctgggaccttattagaactccaaattctcaggcccttcaccctagaccaacctaccaaactagaatgcccaggtaattccattgcccactcaagcaggtgaaacacagcctcacagcctgcaggtcacagtgtggctggggctgtcttctgattctacacacacactgggagcagaagtgagatggttgaggcagaatgcaaaagttcaagtgctttcgtgtctctgagatctaaaactatgaagcattgtgcacttctccaccctgttcgctttgagttcacagaaatgtgtatttctaggtgcactgagtgtacatcccgagtgtgtgtgtcggtgggtgttgaatttctaggcacactgagtgtacatcccgagtgtgtgtgtcggtgagtgttgaatttctaggtgcactgagtgtacatatctgagtgtgtgtgtccgtgggtgttgaatttctaggtgcactgagtgtacattccgagtgtgtgtgtcggtgggtgttgagagtgtgtgtgttttcagacctgccctcttcctgtaactggccgtgtgagattgggcaaatgacataacctctctgaacctcacttcccacacattagttaaaaaccaaggctgatttctgtggccattctccagttctgaagtactccaaccttgtggtgttgtcttagcttaacgatatgagaagaaattggggtgggggaaagtgaggctacccatagttacgtagcactggacaatatataagcatgcatatataatatgaattagaatgtatactgacatactatataccattatatagtttatattatatagtatatataatatacatgtggtatggtaaataatattgaagaatatttcccaacattaaattagccagcatatggttaggtttgcaattagggagatttattttaccatctgcaaggggcttcaggaagagtcacattcagtactgtcactttgaaatcctaatgaccctgcaacctaaaggttagactgtgataccaggaaaagtaagctgttctctacacacattgatttcttttccattgtcataaaacagtagcaaatcaaaggaagaaaaccccatatttttatatccagattcatgtagtgagtatccaattgactggccaacatcttctgaaatacagatatccttttaaaattgactatataaaattcttatatgcttttagaagaaccacaattttatacatgtatatacagagagaaatatatctttttggtattatgcttttgcatagatttggctcaacggctcatcatgacagtcttctgagtatataccttcctcatttttctgctaagaatctatcaagaaaactagtaaacccatatcggaaacatagactaatatgttgttgactgccagaaaattctttattctatctaaccaaaattttccaagaaacggtggcaatttaaccttatctggtttctttaatggaagatcatatattacatttatgttacttacagccacagatcacaatggtgtcttgaaaaaggcagctcggttatcaacgagatatgcatacctgctcagtttattttgtatggcagaaaagtgaaagctggtctcactatccgtcacaaaatatcataacatttaaggatggcctaatgagcagccaaccccgaaaacaataggaatgcctttggaatgaagtaaaattttgcaaacggcattgacttatttttattatatacaattttttccccttttttggatttttatgactctgcatacataataaaattccaagcaagtactttcatttttttcaaaaatgagaaaatggtactagaagaatttaggacctttttcaactctgcttaagattaagatgtcccagggtgaaatcttgatgtgcccactactttaaagcaccgccctgtaaacattcacagttgattccaaacatgctgaagaagccaagctgccagcatgcaggtgttcagagctgcatcctggttctacccaagggcttgacccagggtcgaattccctgttgccctctaaagcccggtactcagtgagaaagaagaaaagtgaattggatagtagacattttccatactcctctatttaacattcggggggcaaatgagccttttaactgaacacagatacaggaaactgaagacataaagtattcattttccccagcttgaaagtttatatcggaagttcctatatttcatgcaaaatattgctatttggcacatgaggtctgatggtttcagaaagtaagaattagatgttccttcgatctagcttgtaagtgcatccaaaccacaccctgaatatgataatgcttctcatttcccctgtgccttggtgtcacagctctccagcaccattgtgagcctgagggtcaagacccctaccaaggcaataacgttcctactgactcccaggaacacacgtggggagagtggaatgggctcttccccaatcctccagcattaaactcagccctgagactcccagggcttagaaaacagcttagagtgaagaattgttttctctgagagttatgcctgaacacttctgctaaagcagacagtcatcagttaatctctataaatgactacaattttggcaggtatcagctggtatagaaattgctcacaagttaaagctctcatttctaagtatatagtaatgagggggactaattaaaataaaaaacaaagaaacaaacaaacaaaaaatacctcacgttgtgcctgaccacaggactggcttacctggaatgatgattcctgttgggtgtctccgtggcacaggtccccacgcttgctggctaagagagacacaactgccaagagctgtttttccaagctgtggctgtagactctaccacgtcaagtgctgtgtattcagaatgacctcgctcacatcactctcctgggtcacccactgtccttgacacagtgttcttcaaaaatgccactaagtgcctgaggaatgtgaagttttgaaatgagcacaaaacctgccggcagcctttgccgactggcattatttctgaggcagatagagctctccacaatcattgttcctgccttcttctttaccccaactcgtaatgccaggcattagactgtggtaggaggttaaagggctgagttattatgttttgaatggttgttccattggaattgtttgtttttctgcaagaaaactgcagatttttcagtttgatcatcaggaagccaaggatctatggcagagataagaggagggaggagctaaggaaggcttcatccagaggcactgagtcacaccatggctgaccaacacagagcgctctagaaaaaagacattttcatacttctgagggaaagggatgatgggggttgctgcaagacctggccccatggcctttcatccacaaagccggtgcttaaaatacgcagccaagaacaggcctcccacatgcatgctgagcctgcgtgactcaggctgtttgcgttcaagtctcctgttgtgggctggagcgctgaatcagagtccagatttgccttggtgacacatgacaagaggggccattgcatttgaactacataaatattatgcttaagtgtttttcctcattttggagccaaacaggtctcgttaatgataaaatcactgcaatatagtgggccctttttttctggtctggaatttgagacaatgtcaactgtgccaaggggcctggcagcaggaagaaatggccagccatggagatttgcagccatcatgcaagttataccatttaattttataattgtagccattgggagctggactacagtgcacttctcgtggtctgctcttaccccaggctgcgggagtggaatcaagggggcctctttctagtctaggattgggtcagggcatgtgaaatagcactttatgggggcagcgggcaggctgtttctcagtctggctttggggacatttggcaatagggaacagaggttgtgcaatcgatcaaggactctttattggaaccataaggctgaggaagcagcaggaggccattgtctttaaaagagaaatgaatggcccaggcctcctgtggctacctccctaccttggagcctcagctttgcacgacaggactggctctggtttaaggacattttgagaaaaccgtaggccccagtcccccatgagtggcctctgcttgctgcttcctggtgacggttgttttggtgaagagcatgatgaggacacttgctatctatatagacactgaggggcccaccatcccaccctatatagacactgaggggcccatcatcccatcccaccagtcctgagccccctggggaagctcaccagataggctgtagctacctctgggctccagtgggcctattctgctgggaatattggacaagacacaggcgaggccttcctgtcaactcctccttaggggtacatgggggagtcggcttcagggaagaaggaatgcttgtgaaaagcctgtgaggagagggagagggagaggggctgaggggctgaggatgccctgcgtgtacctggaaatgggacctccccagaggctgtgggtttgcagccacgcctcatttcctcttggaaggggccctaccactaagctgcggggcccactttgccgcctctaaaacgtgccagtggctgggtttgcagtaaggaacagccgttctgatgcccctgggaggccacctttcctggctgccacagcatagcccctggcatgtggccatgtgccaacaattaatgcgcctctttccctcccggcatcaccaccaccgccaagttctgtatctcagtgagttgtgcccattggaagtgggtgtagagggttggggagggtgccaaggcccagactgggggagcactctgtggccgaggcggtgaaagggggcccattctgctgagaggacagtggccccaaattcagctggcatatctctagcgagtctatgttggggtgaggggagagagaggggaaagacaagaaaagccccagttttaggaaatccacaatactttttctgatctcttccctccctccttccctccccccatcccctcccctccctgctccccacaataggacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcagggtaagtaccagatggagcccactgcccgcctctcctgcacctgggccaccacccacaactggcccccatgtgcacacaccttcccagaccaactggggtttccccttgatgctcagagaaaggcctcgaaccaacagcaccacctgggagctgttggaaatgcagagtcttgggccccacccaccccagacccaccgagtcagatctgcattgtaaccagatccccacaaggaaaagcactgctacagaggatacgaggagctctgggtatggatatccatattggatagatagctctcttgaattttttaagagttagctttggctatgctatttttttacctacccattaggcttgaagacacacacgcagacacacacacacacacacgtcaagcaaagtgaagatgggatgtttcaagttctcgctattgccagattatttgtgggttttgtatctagtgtttttttattattaagaaatagttgaaatgtatggatgtcatcacatcaagggtgttatttgcaaatcaatagagaatgcaggtccccccagcccatgggcctagctggcaattactaaagcgctgtaagatgcaataattgcctaaggcccactgtgccaaattagataatacaagaagttcatttacactgtagaccagtgacgtcaatgactgtttgctctgtgataccgtttcaaaaatccaaaatgcagacttttctctgtgccatgcaggatgcagctgtgtgtgatatggtttacagtaatatttctttctcaaagtagcaggcttgttaaggaaaagataagcaacacatctggggaaaagggcaggtggccagcaatcgatgtggtagctctttgcccctctcggacagcaggaattagcttccccaggcattttctgtatgtgagttgtattgtgggatgtacaaatatcatctgttcctttgggtttccaggccagtagctctctattttgggttcaaacatgggttctcaggccgggcgcggtggctcacacgtgtaatcccagcactttgggaggccaaggcgggcggatcacgaggtcaggagatggagaccatcctggctaacatggtgaaaccccaactctactaaaaatacaaaaaattaggcaggcatggtggcgggtgcctgtagtcccagctactcaggaggctgaggcaggagaatggtgtgaacccgggaggttggaggttgcagtaagccgagattgcaccactgcactccagcctgggcaacagagcgagactccatctcaaaaaacaaacaaacaaacaaacaaaaacatgggttctcaaaaggcatgcccactgtctcccatggagcttgacagcccatgccattagctctcactgttaggtttctggggaaggttcttctacttgattggaaaatttccaaataaatctttccagaagatactatgcacacagctaagtggcctgtctgtggagtaacccttttgtaaacaaacagaaacctaaagcttgatgttttggggggctgcctgtcatctataggttcatttaggtgtatttaggaagaggatccatgaaaccactggtttcctgttacataataatcattaataatgatttaaaatgtgtacattgattttttttaaattccaaaatacaagcgtatatggtaaattaagtcaaatggtatgttcagtgagcgagatgggcttggggcaaaacaatactttgcttccaaagaggatacaactctcaaggagattctttcatcttgcctttaaggtcatttaaactaattcacataatcttcagaaaactaattcacatcatctattcatgtgtaaaatcaaaaggaagactgttttcttagtctctcgttgcctaactggccatttatactactaggttgattaagggatttgcctttttctgctgatatgggaacaaaaagtcttaagcatttttaaaggcaatggaaaattcagccacatgggggaaaattgatattgtcaccattgagttgctctgtttcttggtgaagagtgaatctaatctgatttccttcttcatcagatatgcctctttaacaacaaaaacaaaaaaatggggggaagttgcacattgagttctcatcctctgaagctcctgggcaaaagcattattgtggaccgtgtgatgggcattcgtcagctctttggagacctatatgcttagtagagtatcaggtttaacactaagcatcgccccttttttgttcctcttgaaaacttttacttctgcaacatttaagaaatcataactcgcttttagagttcctacgggcttggttgctactctaaagaatgtgtgaactatattgctggtgttctttctttccaaaatatgaatttgatattcagtacttcacttgtaaaattttaggaacaacttttaaaaaataagtatccagaatattttcatgtgaaacaacttttccttttccttttgttctttctttcctataagaaaacgctgttttacgctaatcatgttttgagtagacccttgggctttttctcttgaaattggaaagttaacaggtataatatgcaagtcttgttcagccaagaccttcagtttgttcttgacagtaggaaaatgcttattttccaggctcagccctgaaatttctatgttatatttacgaagatactttaagaaatacagcatgtgtttctggctttctttgaaatggcagtggtagttttcagaaaaatatccaatttgtcagagtagttccacagtggtgctgtccagatgcatgaatgtttttcagctttacagaaatgtcagtaaccgggggtttggcgagcttgccgggatttatagaaaggctcaggaaccctaccttgctaggactttgtcagaagggttatgccagctcctctgactctgtcagcaagaaaatactgatatagaatagcaccaatacttacctagaatcacatgtgctggagggtcactcaaaatagacatctcaaattatctgaagcacggtacagattgagagggggcaagttgtcatgccactaaaccactgtttatttgttggggtcttaactattaaagggctgaggtttatttcaacttcctattttaccaggtcttaaactggtaaagccattttgtcatgaaatagaatagaaagccattttgtcatgagtagacccttgggctacacgtttctcccagtcaggacaccatcattaacttctacgatcgagtcttagaattcttttttaatttatttcaaaagatagaacagggcagattctagagctagtggtaccgatgcctgttcagtcacaactcccacctagagatgggtttgggcaacccgagtgagtgattttaaaatttcacccctgattgaccaaatatgatgtatcacatttaaggtgtcgtaatttcctcctttctgggaatatgaggatggagtaatagatgctggtacagaaaactgaaacctagataaactaggaagcccattttgttgttcttctgcatgctggttgtcataagcatgtaggaagaagatttaactctttaactggaccagttgtgagctattttgacgtgggtcagacatttgtacatattattccattccctcaacaatcctgtggtatcatttatagacagagaaatcgaaattcagaggttaaaaattgcccagtatctcaaagattgtaagtgatgaacttggacgcaaacccagaccttccttgctacaaagccagtgcaagtgggatggccgttccctgggcgtgcactcttgggtcaaggatcgatttactacagggctgaccagtgtcgagaagaatcccaatcaccaaaggagggatggaaaaagtgttgggctatccactcacttggcattcttgtattgaacatgttctattataattagatgttgataataagaagaattttggggccaggctgtgtggtgggcaccttaataaactgtctcctttggtacatgtgcatttgtttataaagtttgggagaaaagaaaactcagaataatgaatctctaaataagagtgaaagagggggtatatgagcagggagaaggcttaccagccactctgtttactttattggggccattgccttcctacttttgaagttcattgggaccaagtgcttatcatccaaacccagtcaacatctaatccacttttatgagtatgcgtgcctcactttgagtgttccatatggccaagaggggtccctgacctctcaaatcatctcttgatttttagtattccaagtaacttctgtcttgctaattattttcccccaaaattaaagttacttaggaaggactatattctggtgctgctgtctgcaaaactctgagatactgaaatgaccctgtttctcagttgtatagagttatttaagtccgtctgattctctctttatcatctggatagacaaaaggaagaaaacctttccaccttcctgtaggagaaggagataaatcctctttccagccttggaggtaaaatatccaactgcattgcattgctttcctttctctctccctctccttccctctcttccttactcttctagcaatttgaagtttgaaaacaaagggagtagggactatttgattaccttgaaagtggaggctacaatcaaacaccagaaatcctcatatgtgaatctataaatggtcatttaatggttacacaaagtaacatattcagaatgtgagaaattaatttatataataggctataaacatgacaggtgaatgatttcatttaaaaatagcttttaacaaggtgtagtagggtatgagagcctttccaggtctatagcattataatcttaccccgacaacaagcctgaatcaggtgttcacaggaataaataaaaataattaaaggaaagaagggagagagagagaagaaatgaaaaccagtgggatgactgcagagattcactgcagggcttgatcttagtgatgaaatatttcttctgtagactgcatatgttctgaactttccccttatgcttgtaaatatgtaggccagcacacccatgcactaaaaggtttcatttggaagattaatagtttcagcaaagttgtagttggagcatgtatttgatattgatggctacatatcagaaggcttgagctgggaatctaatagccaagaaagatagcagatcatagtggctaagaaagaatgagggctcaacaggcagactaccttagtttctaccacattcactataggacttttggcaagttacttaaccttttaaagccttagttttcttatctgcaaaagacgagtaataattatactagcagatcctaggaccactgtgaaacataaagcagtggacattagagccagcccatggttaacactcaaaaactgttagctgttatgatcaacatcaataatatcaagttgtcgtagtcttatatattatagactgggtaatatataaagaaaagtttattcggctcatggctatggaggctgggaagtccaagagcaaggtgccatcatctgctgagagtcatcccatggcagataggtggaagggcagagagcatctgtcagagagctcacttttatgacaaagccacctccatgataactaacttactccctcaatggtagcatgaattcatttgtgaggatggagcccttatgactcaatcacctcccaaaggccccacctctcaacattgccatgatggcaaccaggtttccaacatatgaacttttgagaagacacattcaaaccatagcattccacctctgacctccccaaattcatgtgattctcattttaaaaatacatttattccatcccagtggtccccaaagtcttaactctttccagcattaactcaaaagtcgaaagtccaaagtcttgtctaaaccagatatgggtgagatgcaaggaaacatttaaagcaaattccattagctttgtgaaatcaaaaacaagtctactataatacttccaaaatataatggtgggacagacacaaggtagaaattcctactccaaaagagaaaaacaggcaagaaaataggggtaactggtcccatataagttcaaaatccaacagggtaaacaatattaagtcttaaaactggagaataatctcctttgactccatgttctgccttctggatacaatggggctaagactaggcccccaaggccttgggcagccctgcccctacagttttgctgggctcagcccaaacttcacctctctcacgttgaagtcttgtgtctgcagcattaccaggctagagttgcacactggtggctctgcagttctgggttctcagggatagccccaattctgtgtctccattaggcacagccttagtggggactctttgtggcagcttcaacctcacatttctgttcaacattgccctgctaggtactgtctgcagtggtattcccctgtggtaggtcttggcctgagcttctaggcagtctgtggcatccttcgtaatctaggtggaggaagccatgcttccacagcatgtattctgcatgcctacggaattagcaccacatagagaccatcaaggcatactgcttgtgcccttcagaatggcagcctagctatacctaggcccactgaagccacagctggggtggccaaggtgtgctgcaccaggatgcaggaagcagagactagaggcagccctgggcagtgagcccatgaagggtgccccaggcctgtcccctaaaatcattctaccctcctagagctctgggcctatgatgggaggagcaacttgaagatctctgaaatgcttttcggggtctttctcccattgttttgatgaacagaatctggcttcctcgcattcatactaatctctttggcaaatggttgcttggccacacccttagtactctcttccaaatacactttcactctttacatggccaggctgcgaattttccaaatctttccactctgcttctcttttaattgcaaatttcatctttaagtcattcttttgctatcacatctcactatatgtagttaaaagtagccacacagcagcctcaatgctttgctgcttaagtatttcttccacaaatatcctagttcatccctcttaagttctgcattccattaagtcctaggacacagacacaatttcacccagctctttgcaaccttatattttataaatatggcctttactccagtttccaataccttgttcctcatttctatctgcagcctcatcagaatggcctttaccagcattctaccagcactctggtcacatacacttaagtaatcacttaagtaatctctacgaagatttagacttcccctagttctaaggtcttctttcagagccctcaccagaattgcccctaatggcagaaccgttcttggcaatgcaggcttttttctagcctgctcctccaaacttgttcagccttcacggttatacagttccaaagccacttacacactttcaggtatttgttgtagtaacaaccccacatcttggtaccaactttctgtcttagttcttttgttaaatgcctgagactgggtaatttataaagaaaataaatttaattcacagctgggcacagtggctcatgcctgtaatcccaccactttgggaggccaaggcaggcagatcacttgaggtcgggagttcgagagcaggctggccaacatggtgaaacccccatctctactaaaaatacaaaaaaaaaaaattagctgggcatggtggcacacacctgagtcctagttacccgggaggctgaggcaggagaatcgcttgagccggggaggtggaggttgcagtgagctgagatcatgttactgcactccagcctgggtgacagagtgagattctgtctcaaaaaaaaaaaaaaaaaaaaagaaagaaagaaaacaaaagaaatttatttcatatggttctggaggcagggaagtccaagagcatggtgctggcatctggtggggtccttgctgcattaacccaaggcagaaagcaaggggcacaagaaagcatgtgcaagagagcttgcttttataacaaaggcacttcaccaataacccactcacatgattatggcattaatccatttatgagggcagaatcctcatgacccgtttgctccctgcaaaggcctcatcaacaccaccacagtgggatctaagtttccaacatgtgaacttttgagggacataatcaaaccacagcacaagtatattagtttcctgtggctgttttaacaaataaccacaaacttggtggcttaaaacaacagaaatgtattctctcttagttctggaggccagaagtccaaaatcaaagtgttggcaagaccatacattctctgaagcctctaggggaggatacttccttatctcttccagccactggtggcattccttggcttgtgactgtatcagactgtatcattccaacttcttcttccctctttatatggcctcctttgtgtcatctcttttgtctaaggatacatgttactatatttagacccacccaggtaattcatgatgaactcaaaatccttcacttaattatagcttcaaaggcccttttccaaataaggtcacattcacagttctgggggtgaggaaatggttctggagccaccgttcaaactgctgtatctttgtacaaaagacaggggacatcagaccattgaccaggcacagcaggtgagtccagagataactctcccaagtccatcccccagaacaaacatggtagacaggtaaatgtgaactgaacatctcatgcacaaatgccccaatcgtgttactataacctcagtccatcatttgtttgaacgcaacatcatagtatttttatttcccagccagaaaaatgtatgattttttttagatgagatcagatatttccttaatattttctagagcacctataccgatggaatcagaggtcctgacagtgatagagaaagagctctcttccctgtgtcccgggagcagtgccagatggggaaacaggaggcccaggtgcctcttgtcctagcctccaaaagctcatgacagcttagatggtaggaacagaaaaatgggaacaaaagatgacatgatgaccaaagccagacagttgggatggactcaagaatttgacctcccaaagccaggcatgtcactgttgttttgaagcaagctgccttttaaaaaagtgacttgattgccaggcattgttgactacacacccatttctaaaggatggtgatttacaaatcgcctgaagatagtctttcaaatttggacatttaaaaaagaaacttttactgtagtcatgaagtagtatcaaagtttaccacaagtttgtattgagagaagaacaaacaatatatgctaatatgaaaaacagctctacttagaaagctactgcttgggttttcttattaggcatagttctccagactgagttggttttactcatctacatgatttttccttgccttatggaacagaaattcaggcccactcgaattcagttattttagggctctttaaaatccagtatttgtgatttaaatgatgcggagggactttcattacctgtgtctttgcttatttctctctggccctcagaacaccccaccctgacctttaggggaaattgacagaggcagagggtttcacctgcctcaattgtcaccagccctgttacattcttccttccaagccttagcctcacagggaccttctcattattgaacaattgccttcaaagcagtagaatagcccaattgttatggagattaaagataccgattgcaaaactcctgtaaataaaatcttcactgacaaacccagtttcttttcataggcttttcttctgtaatctctttctggcagaacatctcatgttttgatgttagagattcagttaccaaccacagtaaataaagcaaaataataatagaaaaatagtatagaactcaccctaaaaacaaacattggccaaccatgtttattttttgtctctctttgcactcctgagaattgataggggaagaatgtaccacctctaattcaggtgatttctgattagcaagctatggaaagtcttcaggttgagttttagccagttcacgctcccctaaatggcatggaatagactattttctgttttaagaaaaaatagaacaatggcactaaatgcttgactgaatgtttgactaaatgttgactgaatcatggataggaaagattgggcagaaaagacagccactgcctccagacacaggatgccacaatcctgggcaccatcattattccatacaaccttagggtcatttttagggtttagaactttctcaatagggtttcaagattttgaaaagtgtcttccaattctgatctccgtagatcctgttatgggaattaacctttttggaaggggattcttgttcttaaagatgaaattccctactttctttcctggagggaatcagtatgggcagagggaagaggagatggcgattctgacctgtgtgtctcatgtcacctaacacctatggggtggcatgaaacttgagctttaaaacacaccaggggccaggcacagtggctcatgctggtaatcccagcactttgggagaccgaggtgggtggatcacctgaggtcaggagttcgagaccagcctgccaacatggcaaaaccccgtctctactaaaaatacaaaaatcagctgggtgtggtggcgggcacctgtaatcccagctacttgggaggctgaggcaggagaatcgcttgaacctgggaggcagaggttgcagtgagccgagatcaggccattgtactctagcctgggtgacaagagtgaaactccatctgaaaaaaaaaaaaaaaaaaaaaaaaaaaaaacccaccaggaatggaaatggtgcttaattcctctaccgtcttggttcttccacacaatctgaactgggtcactgaatcttagcctccgtaagtcaacatcatcagttccgtttaataagacttgggccactataatgtccagctcaatcctcctggaagtatggaggacactgcaggatccttcagttgatgtcataaaagcaaagcatccctagggaagatctgtgagtcaagcctcaaggccctcgctgagtcagcgctaacttgagtatcaggagctcacccgtctgggacggttaagtctcccagccctgtaaattgccagttcctgctatggatgatgtcctctttaccttacggctttatgtgttcaacctgagtcattctaaagccagatccaagacccagagagcttatgctgtgccagttcctctttatatcactggaaggactacatatgtccagttgctttgggatttttttaaagaacatctcaagataaaaagggaggaagaaataatgtgactagggattgcacttcctggagttgcaggtcacatgagggacacgaacatggtggtttgattaagtctcgcgggattataacactgttgtggccactctcactccattagtgcatctctccgcacatatcagatagcaaattatataatgataaagttattaaaatatctgtaaaagtcagcacaagctcaagggctcgacttggcctttctgcccactaagtggtttatttagctctctcatctcaaggccggttaatcttcatctatactttgttgtaaatcacccgctatgtggaacagccataactgcctgagttttaagatgcgcttctgttggtcgtccaacaaggctggtatcttaaagatgaatgcagaagcttttgaagcatgagactcacccacttccccgttttaaaatgatagcctttgtttgtgattgtgtctatacctgggttatcacagagcagttatgacagcaagattatgacaaggacattgcctggttcacatgtttactgaagggagtaataaaataatgatagctcgtatttatagaacagaccaatgttgctggttcattgaatccccaccaccagtcacctgtaggtgcatgacatggttagggggaagcattgcccggaaggtcctgcctgtggtgtctggtttgttttcacgtgacccagcactgtttcctttaccaccaagtcccagtccctcatctatcatgtaagtgattaaccaggttgtcttcaacactaacattctgtcattctggatactgcagttcccgtgaattaatggtcacccctaactaacattctcaggaaaaccagtagggttgccccagagcccctcactctgctgcttatttggaaggagcctttatagttctgctgtgtgagaggctctgagccaccatatgttcctaaatgagagaagccgttgcccagacatggatctgtttaatttaatatgatttaccacaaattacgaagcatgacttcaaaattgaatttgtgcaaaattactgatggccaattcagtggaagggaagggaaatcttgttattcctattccagaatctcttcctgatttcctcatttgattctttcacgccttggggtaggggaggggaatgcattcgcggctctataaagaattgtccttattttcgaactttctccctggtcacacatggctccctcagaggaagacacagcaccctggagatgttaaggcagaagtcagttcttctgtccatccctctccccagccaggatagagctatcttttccatctcatcctcagaagagactcagaagaaagatgacagccctcagaatgcacgttatgaggaaggcagaatgtgggtctgtaattcctccgtgtcccttctccccctctgcaaaccgtcgtaacaataatagttcctaacacatgggacaattgtgaggattaaatgagttagcctgcagaaatcacttgatgcacagcacatgggaagcattgtgtgtatttattaatccttcacaaagtctttgagatatatttttatcaaatatttagcatggatcccggtacactttcaatacttaataaatggtcaatgttattctttttcactattattgctatttatgtgctcttattggcggcattgttgtatcaccagttagttgtacccatcggtcctctccaagtcacacagctactctgcgataattcccccggtgtctccttattcctcgggagccccagagtggataaaggtattggtggttttagtggtattttcatttgagttttgtttccttggataaacccaaacaggagaccttcccataaccactgttccacaagaccaaatggtaaactgttaaagttgaaaggaccttaaacttctttgctcaaagccctatattttactcatgagacactcgaggcccagggagtttcagtgattttccgaactagaggcagacctaacatccaggttttctggctcctggcccagtgctcttcccattggctggttcgggtctgcctcagaggtagcctcagaacagtctctagggttggtgtggatcattcacttgggcactgaaccatgctgtacgtcacactgcctttttctggaaatacaccatctcagggagatgctaggtcccatggttgggttcagtatcatgtgctgcttctgagtctccatttttaaaaggttgaattcgtgctaaggaggagtgatgcttttttttttttgagacggtgtttcactcttgtcacccaggctcactgcaacctctacctcccgggttcaggggattctcctgcctcagcctcccgagtagccgggattacagagtcgggattacagagtctgccaccacccccagctaatatatatatttgtatttttagtacagatggggtttcagcatgttggccaggctcgtctcgaactcctgaccacaggtgatccgcccgcctcggcctcccaaagtgctgagattacaggcatgagccaccatgcctggctggaggagggattcttaaagcatgcaaggaagggaagtcctcctcaaagccacacctaccctcctcagccccactcagcaaggaagggaaatcctcctcaaagccacgcccattctactcagccccacccagcaaggaagggatatcctcctcaaagccatgcccaccctccgcagccccagccggcaccccagccctgctccctgttggggacaaccagctacaggagaccgacaggtcacttcctgagcacaaagcccacgtgggtagcaggcaagggtgaaccctgacctgtcccattacttgcatgaattggatgcattcaacaaatgtgaatggtcagcctctttggtgtttttaatgaagcagctacaaaaggatttcttttaaccaagtttcaccgtcctgtgtgattttgagtaaataccatcctgtgccgattcctcccacaagcccggccctttaagcctgcttgggggctgtggcttgggctggcgggccagaagcaggatggcaaacaggtgtgcgagtgtgacagggcagaggctggagccacagctgtgggaatacgaggctttggcaggccgaggccaggaggggcgggaggctggtgctgactgatggtcctgtcatcccggttcaggatgccactgccaaacttcatgccaattgctcccaacagagtacacggctatgagagggagagagctgggaccagatgaaggcatccctgtgacggccacgtccttgtccatgaattcagggtcagggtgacgaatggcagggccaaaagctaccctggaatgtcacaggaatttgcagagaccaaatgcccttctttcagaggcaccagagtgggggctcccgcattgacgggtggcttctgggccccctcccttcactaagacttggtgacttggtaatcctccctcctcaatgaaacttatctaagaattgattaggaagagggactggagcatggcagtaactagcagtgcagacctgtcatctccatcttcccctcccatagcgtgtggctcttgccatgtcatgaccacactcccgggggctcgagctctgggcttgcctcagcagtctgagaaccacaagtttctaaagaacaggtatgaggaggagagacttttcttgctcaaagacatggatccactcagaaacagcattcaatggtgctgtgagtttcctcccaagtgtaatgacctcctctgacttgggcacttcttacagtgactttgaacttctgagcattagagatgagtgaatcgcagaaaactagaccccttgttagatggatgagcccagagaggttaagagacttgcccagggtcacacagataccacccatatcagagcgctcagctttcctttcccctcctccccagcttggacacattcctaggatttggatgtagcaatgtgaaccgtcctgagcagtcccttcaaaacagcacttaggcgaaagaggggctgttggaacaagacaggacaaacacccgtgtgcctctgcacgctgctccacccagtttctcatctttatattacagaaaaagagtctcaaataacccaaacaggcagggtatgatctgcagacagtctgcaggcatctgcccaagaagctgccggtcggctggtccatcctcctctgatttatgttgtgtgtgttaagccttaaattgttgagtctctggctggctgcagtggtattactggagggctggtgcatgttttcggctcacagagctggctccggtactggaggtgttggccccgaatcaagtccaatctcacacctgtctgagacaatgagggccttgttagacacatctccagtcgaggaggtgcaggctgcttatttttcacattcagaaccagaaggaggggggtctgggacaagggggatgggagaagccaaggggagacgggaaatgctggggtcagctgcctctcgggccctttccctctccttctccctcctcccttcccccgctcttatttaataaacttctccttacttttggaaattaaaaaacaaacaaacaatactaacagttgccctcttatgaaggataatttcctactgcagaacaaggagctcgtggcctgttgtaggataaattcccagtcatcatgggagtggagcagcccaggggaggagtggggtgaataggcaggggcgcagcccccaccccaccccagcactgaaacttgagctctttgcacactgagggcgcctgtcagtgagaggttttctcttctggttttccctccactgctgacatttcagtgacagccgcagaaagtagaggggactttgtccccagctccatattattcattgatgaaaccgcaaactgttctgtcctggttcagccttcctgtcccctgtgatcagagcagacagagcaggccaccaggacttacgtctgcagacactttgcaaatccagttctcaagaggccctgacatgaggcggccccgggcaggagtccttctgggtacaggctggcacccctcaagggtgatgatcgctctgaaggatcattacttagtcaaagccaccctgaaatgactttctattgcaggaccacacgacgtggaggcccatagtgtaggagtcaggaaaagagcttcccagagttatcaaaaaccactctttactgcgagagccaacagtaaggagcctgtgtagaagagctaagaaaatctcacacatgtagtggccatgtcttgggggcttgagtaactcgacaaatctcccagctctgtttgtgatcaggtaggctcttacctgagccgggaggcatttaggtgccagcagtcactcaaacaaggaatgggcagccctatccttctcatccatacacaacttatttaagcactaagccccattgctgactcctaatttggcctcagcgacacaacagggaaaatccatatgctgtttatttcatttgagactgaggacttaccagagatgaggttgcgccagtctgtttcttgtagtataaatcatttgtagctcagccacccttgtatctctgtatgtacatcagttgacaatcccagagaaacaaaaggacaacttttcagaggcagcagagtgacagacggtgaatagcaatgagcataggcaacctggacttctggctacactccagcctgagtttgaatcccctctatgtgaccttgagtgacgtgtgaagacccaatgtgctcactgttgatactttggccttcagagagtccagggactgcactgcataggttcccttagccctgcactcctggtagaacctgtctgaatatgtcacctttggaggaaagtggccgaagaagcaggtgttgctatttcaggtcagctgatgccagggaggcctgatacctatggagaccatggaaccaccagtttcctgtctccttctctagccatgcctccctgccttgttctgggccacaaggtgctccattcttccgaagctcattcttgctctgaaatgaccaaaaagtcaagccaacgaacaggagggaggctggacactgaggtgggtgaatgctgcagatcttcctgcttgatctctgaacacccatgaccagtcctgcccacaagctttggtccatgctggatgcctacccagaaagttccttcctctcctccccaccacatccccgaatcctgccattcttcagggcacctcacctgccccatctcctccagaacatctttgtcctcactgaggcccagactgactcccttcccgactcctgactgatctgttggtctctgtcactttggcatttccccacacattgccttctgctgttaccagataggctgcatgtttgagtgacgcttcaccaactgtcatggctatgattttccaccatctgtgctgtaagacagtaaaaactcaaccaccaccaccgagatgccatccaggcaggcaaccctgagcgtgcccccacccgctacacactcttctccccagagcacatcagggttctgagatcaacaagttggaaggagacttccaggtgggcaggaacgctctctccttcccaggacccccacgaacctagcccagagctgcagagaaaggggtgcatgagtcgttgaggaaggatttttccttgctcctgggacagcaagtcaaaactgtttgttttaggttttaagttaatttcagaatatcctgccctaaacaatttctttccttacatagcaccaactctctgctggggccctttggctgtttcctttctccattctttccttctcctttcccagatcccagctgggaacctggggggagagcctggctggcaccacctgccctttcttgggccatttcccttcttgtttgtgatgaggaggagcctaggaagtctccatgcttcttggctttctggccctcatcactttcacagccttctgctaactaagctagtgagcccccctgccctttcccattccctctctgaggccaaactctctcatcccagcttctttcttttcatcttccttcctctaaagactgctcagcctcatcggaggctgccttctgaatcctgaccctgctttccacattttgtaagacatctcggccccagagtaagagtgcatgatttacctaccacttccttggatcccaacccctactcactgctagctcctggcagtggcgttcttcctccttccttggtgtgcagatgtgcccctgtgtggcctccttctctaaaagcattctagattgttcttggttccagcacttctgaaacccatccttccaagtttactctttttcttgctatccctcgtattttcccactcctcatggaagcttctttcccacacccaccctgtgccctatggcgggggcttcaggacccccaaccccagccctggagcgtttcagtgctgccatcctgctggcttcacttggtgcttcctccacagcaactacaaaagccaaggaaccttccccagtccctcccctccccagcattctcctagcagaattacattttaattttcagctgaatggatgaagaaccattccaacacctctgtgtcacccacagttgtctaaaacacacaaacaaaaaaaagtctgggtcagcagaggggagaccatggtcactctccttgtcaaccttccctttgcccattctttgttttctcttccctccacctctgttcctctgaaacctcttttgttcaaatcaaggggaaggtaattcagaggtgctgttgagactggtttgctttttaattttttttttcaaagaagacgggaagttcctgttttttggaaaggttgttcatttccaaagaagttacacagccagtcagctataggatgattcctggctgcattttttcggggtagtacacaatacaaaaaaataagtcaatgagagagagagagtcagtcagtgaacacaaagggagatgttataataggcttttgttggtacttgcattttcttgttgaaaaacagagcaaagaccccgaggtgctgaggtgtggacagaagcctgatgttatcaggcccccagaaatcctgcctgcagtccagtggcaggcaggatccagaactggaaaagacggaggcaactggtcctgctcagcacaaacggtgcttttagtctttcgtaaacagcctgtgccccagggctcaaatccttcaaaagtttgcctgggtaattgcatttcattgctgtctggcatgtgctcatcagtctaatctggaggttcagacagccaggccaaagcttgcgagactggaggagagcgagcctgtgaatttaatccacttgaaagacagaataatacaagtgcatctaactcattattttaagtgatgctagtcgaaaaggggatggtgctttccataaaagcatttaaaatcagcacgctgcagttgcagccacttggcagtttaaggccattagaagaaaaggcgcacacaggtgacagtgtgatccctgtcgccgtctgcttgtccctgaaagccttcctcctccccacgaccacctcaaaacacagaaggcaaaaggaatggtaacttccatccctaattttgactttgggttatttgtacatttacagcaacagacaccaacttttatttgagatttggggtcattttggcatcgtttcagggtggagagaagacataaatgaagttaggacttcccagtccatctcaccaagctcaggatctcacagagctataagcaggcaaaggtgttccccaccagaaccatctggacaatgtgctttccagtgacttctttttttttgaggtttagctaggtctttttgttctgtcagtacatggtaactagattgatgggagggttatagtttctaactatcatgtagttaaagcagtagtctacaaagagccagaaggtctgtccctgctctgttgctatctgctgtggagaatagggggagtcccttcaccattccgcactgcagctttctctgagatggggctggcatggttgtctctgctgtctcggaggttgctttctgctctatcattccataagacattagaatgaaaccttaagtaatgttgacggtgatttgcgtcattatctagttacatgtgactcatgcccaggaagcccaggagaggcaagtgctagcctgtaccctcccagatggcaaagccgacggtcagctcaggagcagtcttgttggtagttcacacctgcagctcacccagggctcaacatgccagctctaagtctgggtgccaggccatgagactgagagagcagtcgccttaaaccttacatggggatggagtttccccctgggtgcatcatgactgcagccacccaggattctcacaagggctccagaaagtgctcaccacacacctcatctcctcatacccctcagttcatttgtactgtgcccaggggacaatgctgtgttagctttccccgatcctgaagagcacctctagaagtcacatcttccgtcttgtcatcatggtagctgaaaccattgtggcagtgtgtgctttccctgagcaaggttttctttgacactttagggcacgcttgatcttgtgggcaggatcattctctgttgtaggggccatcctgtgcattgtaggatgttgagcagcattcctggcctccacgtactagatgacagtagcactcccccttcctcagttgtggcaaccaaaaatgtctccagacattgccagaaatcccctggaggagaaatcacccgtttgatgatcgctatttaagagtaattgggaaattcacaaggatcttctagtcaatatacacaggatctcaatgcctgaaaaaaatgtgagttacttagctatctaaacttggtagtaagtcaattttgacccttcagttctgtaggtcctagcattcctgtcttccataggtcatccctcttgttgagcaagagtttcatagttgtctgctatctcaacctctacatttaatttttttaaaaaaaattactccattttagcccaagtatatggcttctatgagaaagccttccttggccttgtaaatcaaagcagttctctggagggaggtttcccactgctgggctgagtatcatctttctcagggtgacctcatctattgaagtatgaaggttgtatttgaaatgccatttactttctctaagtcaataaacgaagctgtggatctgtagatcatcagaggtctgcttattaccaagcggttttgtgtgtgtcattttttaaatcgagatctgtgttggagtttaaaagaattctggcagatttccatttgcctttctgaatcagagtttggggtgagcgagtgtagattgcccctagatgaatctgactttattagtttgtgtcctttgttcagagcaccagggatgagcttatgaaagcacaaatggctcttatcttcaagtgtttcctttatgctgcaaattccacctcaccaacctgtgttattaacccactgcaatcccaattagttcacatcaaggtcaactctttggggtgtgcaaaatggctgcaaacttaagtgaacaaattccccttgtgtagctctcacatgaaggtgggggagaagactgcagcaggggaacttagaagaaagagggagttttctgataccatagaagaaagtgatagtgattccccttggctcacaagccaaagaaatccaattattccaaataattcaaaacttgcataggaacttgtcaccaaatgagggaacattttagcctcttattcactctgttgcttggtggcaaatatttaagaaatttcaaaaaatagagaggtgcaagagagctatttctcaggggcatggaggtttcttgggggcatttctcgggggtatagagggctgtttcttggaggctatttctgtgcatggagaagccttgagtttcagaggtataataaacactactcctccagaaatatgtctgtgaaaaataagctggagcgggtgggtctgcaggacactgtgtttaggaatgaaggctgcctgtcctgccatctctcaggagctcccatcagaacagacagtaaagacaggaatggcatgtctccagttgtggggcaaggcccctcctagtgtgaagaaaatatacttcctggatctatcattatctctagcatatcagaggggggaataaaaacaactggggtggcaaggccctgctgaaagagaaactcattgttctgcacattcagagacttcctagttgtaaagccgttcagagctcttggaggtgaaggggcagccagggaatcacatagagtgaaagacctgtgtgcagcggccaggtcagagggcgtgtagaagacgacatgaagcattcccacagggcagttccctgaggttctgtcctccagctcttgctgcaaggaattctagaagccttggcctgatgtgtgggaaaggaaaacaaggtgaagaggatgcaggtaggaaaagaagagctgtgacaaggtagtcagatgggaggactgcatgagaaaaacagaggaagagagcacagaagcagccctttgatttcactcgcgtttattgaaggggacgaggcacttccacttggggaattctacttccctttgtcaggatatccttcaaattgggagcatggaatggaagctcttaaagaaagaacggttgccattcattgtgggtcacacttcacaagacaaagagcagtgaatcctcgatttgtaaaatgcagctttcagaatctgtgttgtggctggcacggtgcaacactgctgtgaggccctgacgcagctgtgttctgcagggtggctatggtgctccttgtgaaggaggaggctgctgctctgcaggaggaagggcttatgttgcatcctagcggtgcatgctaccccgctggaatagtgcaccttggaactctggctgcctaaggaaggtctcatttctggtggctttgtgagaccaagcctctccctcttctgttacctggagcaacaaccagctaagccaacagtactctccagacactgttatcctttcctggaagggcaggggagagaagactgtttcctgccttcaaggtgccagctactgcattgacaatatcgggcagaggggcacatttcaccctcccaggaatctaagggacagatgcaataacatctccttatggggggaaactgagtctccaaggcattaagttacttgcttcagcacactgtgagtgaggggccaagctagggtctctgtccttacctctcagactgcagaactatgcccttattgtatccttactgaagcccttttggcttttagagagacagctctgggatgaggttcccaaatcctgaaaatgtttggggccagaacaaacaaaagcatctttatgttaagccatatttcatgtttattgttttgaattctccttttcccccattcatatgagtttttcttctgattttattagaatgccatgcctcagagtttgctgcttaaaaccagaatccctggcataaaatccaataagcctgccttagggcccatgtcatatggaagcagaagacaacagagactgcttgctgggcttcaagccactctagaatttttcaaacagttctaacattttacaacatcaaaaaagtgccaaagtaaaaactaaggctgcagctaggagaatgcccactgagaaacccgtggttgggtttgtgtagagaggaaggcttttgagatcactgctccatgccccctcggcctctcccaccagaggtctggctcagggacagcacttgggcacagagagctggggcagtggcagagatggatggggtagtcaccagaggaagcccaggctgcaaactggcatgacacacacctgtgtggaacagatctccatctgagctgggctcaaaagcatcgtattctccaatatcgacaactcataggttagggggttcatcattttgtagcctctgcagtcccagacgtaaagtcacttctttttttttcttgcgtgctgacaccctaaggcattacatggaccctggcaaatctcagccatgttacttaacatgatctgccccagcgacagctcttaactgtatctgtttagccagagatatcacaggtgcctctctaggaaatcccaccggcccctcatcagcacagtggagattggctgtaaagcacggccttccatgcccagcctggactgcaggttggagatgacagtctcccaacccaggccttccaagcatagactatcaagcgtgcacaatcctcttgatatcaggtgccacctcaatggagtgttcttcagaaaattctgtttctttagctgtgtgcagtcctgggagatgctgtgcctcttctgcttgaagcttcccagctcccacttgaggtgtcagtgatttgttttactggagtgagtatcctcattctccaccaagggtccagtctcaggatggaggctgcttgagatatcccagccctcaacacaatatttctggctcatgtttttcaaggaactaagcggggcaaaggtgccagaggagtagaagggagcagaaagttgtctttaccctcctggagaagaaggacatggaggagtggaaggaaataaatagggtggccatagaagaatctaaacatccatgatgtgctggtgttgcaggaatgtacccaacctgtctgtagagctccttcaggcctggaaagttgtatacggggggcagaggtgcagaaagtgcacagtgcagaagatccttatggaaaagatgtctgcaacaaatgtttatttaacaaagtacagagaaagaatctgtctgcaagggaggaggcagcagaaaccagaaggtgccttctgttccctctgaactatggtccctccagctgtgtgcactgaaggccactctccctctgcctcagggacacgatgccaactgagaatgagacatgttctaaaaacacccatcttttctggaagctagtgacctatccttgaaccctccctccaaaagcactctgcctaaatacgtagccctttcccagacgtgtctcagactcatctggctgagggtagcagcctcgtggtgcagggtgaactgtttcccctgggaaccgtctgacagtgctaatgaggaattgcattttgcgtttatagagcacctttcatctgtggatctcaaagctgccccacaaacattaattaactctcacacctgtgaggcaagtgagcctggttacccccatttttagaggtgaggaaacagaggtttgaaaagaaaaggactccagggtgaaccagcagggttgggggcggcctgatgtgaggaaccagcattcttgattcacagggccctgaccacaaagccacaaagcttccccggcgaggtgatgaatacgggtcccggaagcagggagtggtggagaggcggacacagggctcccttcttccttcccgcaggcagcctgccacctcccaggctggcaggtcggcagtgaggatgggatccctcaaaacctgaggcctttaaaacagcatacccaggcagggttctgccccggcttggtctgtctgcttctcttcaaagtaattgctggaacaacgaatgcatctgagctacacatgactaaccaagatgtctgcagccggccagagacgaacggttggcaaatcctggagctgtttcacaacctcccttttttccaggatccagagctggtgctgactgactcatgttatcatgggatttcaatgatatagcaacagtgtgctgagccggtgtctgctacctgggggtacctgtagtaggaataggtgactgctcttcttacttgtgctgtgccggagctttgctccctgctgcagaggccagaggaaacactgcttctcaaagacagtggaactttcagggaaatgtccctttcagagcagagtcacccacccccagggactctgaaaggcccctgacatcacacacctctgacagatgtgatgctgggaagcatctggggtcaccccctttgtctgcaaggggagcctaggcctttcttcccaggggtcccagacagtgagatgcaaaccaccactggggctcgccctaacacatcaccctggaaactgactcacatctctgagtcctgagtcacatcctgttgtgtgttctgaggtctccaagagggcattacaccagctccccatgactgaggtgaatctggagggaaccctgggaacgtccctaccttcctccaggatgaaggagggaaaaaattcctccagggaaataaccagggctgcccctagggtttatatgttcaccaagctgatttgcctttttcaaaaatagatggtagaaccctgtggtctatgtgacttttatttttaaatagctctgagagatgactgaaagacctggcgttttaaagatgtcagccacacaatcaaggaaggggctttctaactataaccttctccaagcccaggatgaagggtgccaccgctcaaggggtgctgttggaaacccagcttctgagggtgggtgtttaaaagaccctagagtggacagtcagaggagggccgggaggggtctctatccatcttctcccagcgcctgtggggagcacgaggacaaagagggatgttttgaacttttcaaagaacaagatattttgttctattgattttgtctattattttcctgtacttaatttcactggttcctagtctaatttttattatttcttctcttctgcttgcttgaggtctgtattgctattttctccagtctcctgaggtggaagcttcagtgactgattctggatctttcttttctaatatatgtattcaatgctataaatttccctctaagtactgttctatctgcatccaaaaattgtaataagttgtattttcatttagttcaaaacattttttaatttctcttgagactttttatttgactcatgtctaatgtagaagtatgttgtttaatctccaaatatttggagattttccagttatctattattggctttttaatttaaatccatgtggtctgagaaaatactttgtatgctttctatacttttaaggatcttaaagtgtgttttgtggcccagaatatggcttatcttggtgaatcttccatgtgagctgaagaatgtgtattctgctgttgttagagtattccataaatgttaattagatcaagttgactggtagtgccgtttaggtcaactgtgtcttaattttctgcctgcttgatgtatcaattactgaaagagggttgttgaagtctccaattgtaatagcgtatttacctatttctccgtgtagttctatcagtttttgcctcatgttttttgacactcagtttttaggtggacatatattaaagatgctgtcttcttagagaattcacccacattatcatcatgtaattcccttctttatccctgaaaattgtccttcctctgaagtcagctttgtataaaattaacatcgctgctctggctttctttcaatcagtgttagcatggtgtacctttttccatccctttacttgtaatctgtataaatatttttatttaaaataggtcccttgtagacaatatgtagttgggtcttgtctttaatccacactgccaatctctgtctttaaattggtgcatttagagtattcatatttaacctaagtattaatataactgcagtagtatcaatcatatttataacttttatatttgttgcacctgattcttccccccacacctctttttctaccttttataggtttaactgaacattttatatgattccattttatctcctctgttagcatattaatcattctttttaaaaatgtttttagttactgccctaaagtttgaaaagtacatgtataactaatctacatctagcatcaaataactaccacttcttccttcctgtttatatcattactgccttttatttcatttatccacatgctataatcactcaatactttgttactattattgtaaacagttatctttcagatcagttaagaaaaataaaacttaattttaccttaatatagtacttttctaatgctcttccttttttatgcagttctttttgacatttctcatagggcaggtcagctggcaatgaattattccagttttgtttgtcagaaaatatccttatttctttgaatttgaaggataattttgctgaatgcagaataatagtttggtagcttttttgttgcaacacttcatgtattctcctttctttgtgtttgcatggtttctgaagagaaagataatgtaattcttatcctttttcctctatggataaggtgttggcttttccccctctctagcttctttcaagattttctcttctctttggttttttgcagtttaaatatgatatgcctgggtgtagatttggtatttattatgcttggtgttctctgagctttctggatctgtggtttggtatctgtcattaattttggaaaattcatagccattaatacttcaagtatttcttccactgttttctttttcttctccatctggtattccaattacacattacatcttttgaaactttctcacagttcttggatgttctttctttttcctctttatctttttgtttggtaagtttctgtatcttcaagttcattggttctttgctttgtcatgttctgtctactaagtaagccattcctcatttctgttagggtgcttttggtttttagaatttgcttttgagtgttaagagtttcaggctgggcacggtggctcatgcctgtaatcccagcactttggaaggccgaagtgggtggatcacctggggtcaggagttcgagaccaacctagccaacatggtgaaaccctgtctctaccaaaaattacaaaaaaaaagaaaaaatagctgggcgtggtggcaggtgcctgtaatcccagctactcgggaggctgaggaggagaatcacttgaacccaggaggcggaggttgcagtaagccaagattgcgccactgcactccagtgtgggcgacagagcgagacactgtctcaaaaaaaaaaaaaaaaaagtttccatctccctgcctacatcatccatctcttcttgcaccttgtcttctttttccactagagccattaacatgttaatcattgttaaattccctgtcttgtaattccaaaatctgtgtcacatctgggtctggttctgatgcttgctttatctcttcagactgtgtttttttcttgcctttcttgtaattttttattgaaagtttaacatgatttatcaggcaataggaacttagtaggcctttagcgtgagttattattctcatgtacccaagagttgggctgtatttaatgttttcagaaggtaccagagacttcaaattcctctagcgtccttgtttttgtctcccatgtcatctgtgagcttctctatgaactcctccttagtcagtatgttgaagctctttcagccataacccactgttataataatatattggatcctgtgagaatctggtggagttcctgaatgaaaaacccacaacagtgcacttcctcctgaaactgtagcccctaggagtgtcttattcgcacactagtctgtactgagcctctagcaatctgtcaaaatcaccattaagtgttctcatcagtttatgaattcagaaattctgctcccagcaagcagacctcactatgattctctatatttgcctgcttctcaaaatttggggttgcagtttgccctgcaacttcagctttccattggacttaagaaaagtcatggattttcagtttgttcagcattttttcttataaaaacaagagtgatgactctcaagctctttaaattttggaactgaaactagaagcaacaggacattctgacatgaattatttaaaagggtcattgttgactctagagacattttaatattgctgcatcaaaagataaaagcattctcctttcttcttgtgtgatatatgccgtgtacacctctgagctcaccactaacctcaactctaccttatccctaacttcccatttcaaatggaagggaatggggatcaaggagtagaaggcctgttttacccattattgatgattaaaaagctgaaaataacccatcacaaaatggcctcagtaaagtggctgcatcagacatcatttagcctggaaaaccagtatgcataaaggctcaaatttaaatttttgaatccagtgttttttatttattattatttttttttttctgagacggagtctggctctgtcacctaggctggagtgcagtggcacgatcttggctcactgcaagctccacctcctgggttcatgccattctcctgcctcagcctcccgagtagctgggactacaggcgcccgccaccatgcccggctaattttttgtatttttagtagagacagggtttcaccgtgttagcgaggatggtctcgatctcctaacctcatgatccacccgcctcggcctcccaaagtgctgggattacaggtatgagccactgcgcccggccctgaatccagtattttttaatagaaacatgagttggttgagatactgagttcctgccttctccatcctaatcccaaatttccaatctttggaaatttgcccctttaccatttaatctcctgagcccagctcctctccagcctgaagagtgtgtctgtcaagactgtagctgtgaacaaaacactattacttgagccttatcctggagcaaatgtgtgtggtctcaccaatgaacatcagataagtcccttggcatggatttcttttcctttttagtaatacaatcataaaggttattcagacttattgagcatttactatggccagaaattgtgatacttgctttccatatagtttatctcacttactcctattaccctttgaagtcagaattctaactatgaatcagagaaaataagtgacctgcctaaggtcatccagttggtttatggtgaaggcaggatgcaaactgaaatttgtctgtgatttgagttcggtgctttccctagtctcctcctctcagaggcagaacataagcatgtaatagataccactagggttcttgtttctaccttgggaacagctgtttgcaagtccaaattaggcagctaatctagcagttagcccagatacagcccttgggcaccctagtagctgtaacttccagaaggcaggaaccttccattcactagtgagtccccaaaacagtggcccaagtgaagcaaaaatgtttgttggaaatatgagtgaatgaaaaagtaatttcatgaacacatgaatgaataaatgaatgaagcaacacccagtatgatgattaatgccacaggaagatgcctttccaagcatcacaagatcctgggatcttcactgactgtaagtgcctgtggggcagggaccatgttggtcttattcatcactctcctgccaggtaaattagcacattcctggcacactgtaaatgttcaataagcttttgttcttttagatggattgacttatcagaggcaactctttcaagaacaagtagccctgtgctctggagaatgatttacagtggttctcttcctcagcctggggccttttctggataactcccatcgtactctcctctacttcctcttcctagaatacacaaatttattattacaggcaccactcttcaccccacatctgattcttccctgactctgcttaatgtacaagtaaagcaaagaaatactgtgtaggacctattggaattagaatcctgctctgtcaccattggaaaggatttagggatcacctccttcggaggtgagaataagaaagtgtcagtgagtaatccaatgtcacccagttgctcaccagacagaaagaccaagagttcacctctcctgcctattagtccagtgctcgggtggcccatgagttcatgttggccctgtcagaccaaagacagtaatgaatattaaacccagaatgcaccatattatcaggccttttttgtttttgttttctattagtaacacaggtagaagaggaaacaactaaaaccccaacattagaggctcaccatccccaccttctggcccaccactggcaatgaacccaagcacaggtcactgtggtctcatgaaagaaaactgatgtgggggttgggtgggcttcagggtgttgactgccatcttcccctccagcacctgaaaagctaagttatggtgtgaagtcagaaaatgtggaatctgcaagcctgtctttaaaaaacaaaaaaactcatagaacttggactttaatcataaagatcattttaccaaagcatattttttaaaggctgtgaaatattatgcaacgtttgcatggtttaattatgagtttagaaaagcctagcacgactttttcactacagtaaaacatgacggagcatgaatcatggcatagtactttatgcttagtgtggctttagacatggggttagaggtgtgaggctgtctacacaacaaggcgtgaattactgtactgcagttcacaccccggggggctttatgacagttctgaaacctcttttgtttgcttttaaaatgattaaagtattggagtactatatattcacttagtaaatgtgtgtatctagtatatacgcatgtcttatacaaaatatctaagtatatgatttttttttcacttggagcaaaatacttgcagtagcatggggatattgaaccgtctgctatttctgtttgcctttagtcattggaaacactgttagctgtaagattacacaggagcttcagccaaggttgaacatttattttctgctgagtttaaaatggaccagctccttttgttccttgccagctctttaaatcctctaaaatttggaataaaatgaagacctttctttaatattagatttcaaagattccaagttaaactatttgcctgggaactaccaggttttttaaacttaaaaaatcagttattttcactcacacacaaaaaagaaagaaatgaatcagtatgagggagggagggaggctgtcaggagaatactggggaggaagacttgggtctccaaatgtctgattctgttatccactgtggcagcttcaaagagataaacagaaaggcaaacttgaactgctggaaatgaaaagcccctggaggaagcagatctgaatattttataatgagcagaaatagctcatttctttatgtcctgacctatacaaaacttatacccagtattttcctaaagaagtctgctcttcctacactgctacctgcaggatcatgaagctctggctatgaagacccttgggagttacggtagttcactgttatctttgtccacaaagttgggacataaagagaaaattaatgtttaactccaaagaaatgtaaaactgtcttctagtgggacagtgtccaatttaagtttccttacacatttgcctaagaatagcgttggttttcctccccttttcatctgcaaacagtatgatgcttttgaaaattaagactcctttgaacgctggagtcaaattgacaaaatccactttgtctaaatcttttgaagtcagacttttgtctcttctctatcccaggcctcttataatggcaatctataaaatacctgctaaaaactctgacttttaaaagttgcaaactcgaagtcctgaaaaggaacagaaggcttgggttgatagggccagttctactgctgggtttgtgaactagtcattagacctcattgccggtttcccagccagaccttctttcctgtcatccttgggagagaattcgccttactataaaacatttaccagcccatggaatactttttgccaaaggtaaaggtataaaaaaaaagcccaaaactctacgttcttaccgaacacagacaggtgatcccctgagtttataaaatgtttctgatgatgataattgtaattattggcaaagctgaaatcatgtcagcagtcatatgatacttgaagttctcaagtgctgcagttcaacagtctggacattaatacttctaccttgaaagtgtaatccattcctctcatcattgttagcatgattaaataaaacctttggaaggaatagttatcaggtgaaaatctccaagaatcagtctcttttgggggaaaataatccaacagaggcagatacttggacttgagtaggcttattaaaccctggtacataggccacatacatgtatgtgacatatttgaacaagggccactcatttcttattaaaagacattttttaaatcccaccccactttacatataattgacctttctgattctcttcagatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaagtaagccacttgaaaacacattctttgcagctgagctggggtggaaggtccaggagactagaggtgcatgaaggagttggcagaacattattgagtaaaacatggtttaaaggtgacctatctctactctgagtcccatgcccatgcactgattttcttggatacataagaggcagagattgtggatgtgaaggcagaagtggcttggagaagtaggttccttagacatctaaagttgttcacatttggcaagaaaggatggtgactgaagggttaagaacaatataaaaagccaaagttttcaacttttaggactcattattccaaatgaattctggactaatgggactggtccatgcggtggtggtaaattttcacagatcacatggacagcacacgggagtacatgtggaatgggaaataaatacagccgccccttggtatccatggaggactggttccaggaccccccatggataccaaaacccatggatgctcaagtccctcatataaaatggtatatttatatataacatatatatcctcccatgtatttaaatcatccctagattactcgtaatacctaataaaatgtaaatgctatgtaaatacttgttatactgcattgtttagggaatgacaagaagaaaagtctgtatatgtctaatacagacacaaccatccttttttttaataatatttttgatctacagttggttaaacaggtgcagaacccacggatatagagaaccgactgtataccccaaattagacattccaactaagcgctgttcatacagaggccagaggaacagcgtgaaaaactcaggtgtcatggttagcataattgttgttaatatgagctcattaagtattagtcatttaacctatgagccctttgggcttggcactcacctttgctcgtgggcagggaaatcagagttacagagaaaaattcctttgttgaaggcaaaagaagaaacttagtgtttggggctttgaaattggagctgcaccaaactgtgaaaatacttcagagaacttcagtgttatgatgcctgcaaacacactcgcatgtgtgttgggggaacggggcgggtcttgcttttcagctcttgggatcaaattatagcagattagggggcaggcacaggggcagtggagtcatgtctgccattttaaatgttgtgtaatgttgtgttttccagacagttgtgattacttcaggtttcaccagatgccttagctgctgttcagagcttcacagaatgccttctaagagcttcacaacggcagtactattgacatttggggccaaataattctttgttggggggggtctgtcctgagcatcggagaatatttagcagcatccttggcctctagatgccaatagcatccccctcaccccagttaggacaataaaaaatgtttccagacattgccaaatttcccaaggggcaaaactgtccccaggtgagaaccactgccttccagtgttcttgggtggtacagtaaaataggaaaaccaacttaagtgcttggttttcacattacttttggccattaatgccaatattttcatggtacattctgctccaaggcattgagagtagcacaggtatcttggcatcttgtttagcttgtggtttctagaagcttatccctcaagaacaaaggcacttgtcagcttttactgattgttctcagggcacccctctgcacaccggctacggtcttcacctgaaataatgcctgttctccttcaaatgttcctgctatgggtctatcctttggaatttattacataagtcttttgacttggtcatcacccaagatcagcaccttatagtccaagaaccctaggggccaactcctccagctgactggtgttcagatggtagggtgactttttaaataaaaggaatgagtaacatgtgcactccaaagtcccatatcacagttacatttgtgaatatcctggacttcaatcacccaaggagtaagagagaacattttatggcatgggagtgtgaagtagataaaaaccatgcctcatttcagaacccaagaatgattcttttctttttggagggaggacagaattccagatgagctttcacagtggcatagaacagtatgggagactgctcttcaatttggcagaactccctctgagaaatcaagcctggagcacaggcctgaaaagtgttgtcataaacctggaggcaggaggggggtggaatacataaaaggaaagtggctgcctggccgacagctttgagaacctgacactgctctgtggctgctttgccttttaatccagcccgacagctttgtgctctgcccctcttcccggccccagccccacctgggcttccttctgcgctggggacttggactctgtctgtctctctctctctatcctttgcagacagactccacaccttgtctgaaaagagttgtcatctagaggtttacttttttttttctttttcaaaaaaaattaatgtttagctgccaacctgggcgacagacagcatgcattaatctgagtcatgcaaaagctccttttaaggcagccattacctgctcaggttgtttaatcctctgggggcagtaggaggggccctgtagcgaggctgctttcatccatgtcaagctggagagcgaagacttgagctgtcatggcaaatatttagccccatcaatgggaaaacacttccaaccaaaatacctggacctcctaagccccagatttcctactcttaaaaactctctgtgaatatcaggggatcccaactccccccacacttctgctgaatcaggggacaccaggccagccaaaaggacagaagagctacagctggatgggtgaactgcgcagactgatgggtttgaataagggatctgagacaagacacaaagatgaaaaccaacatttgaatatagcatttgaatctgagcatatctagaaggcctaagatattgtattatcaaaatgtgtgtaaaaaagatagtttgaccaaatggatggtcttttgtagtatgacgttgctcatgtgtacatagaagaaggatcacaggcagcattgcagctctttcttttggatgttctcctcacaagtgaaagaactattttcccccaacagctgagaccataacatcattccagtacttatgtccatgacaaatcacggactcactctggattccagtaacttggtaccatcaccacattaccatgtagtagttggaacctactggcagagcatgtccagacattgctgtaaaacagggtgacctttcgttcattttccagtggattcacctttttgtctcagggcaaatgaagcaagaggaataatgggcagagtcatttatttgtgtccagagtattgcatcagatgacaacaaactgactgtatttgcctaatgcttttcctcctgtcccagcttctccgtagactctataaatctaaatggaaaaatggagtaaagcttcctgttaactctcaaacatgtcacagctctccatgtcagcaaaaacaagtgacacagggcttgctcacagatggccccaaagagcgggcagggatgaaccctgtggaatgaggtgtggcctggctcgagaatgactagagtgtggccaaggaagggcagcctcagaaccactgtccgtttacaacgttttccctgcccacatgtctgcctggctttgaaaagattaacaggagtgtttgtttgaaagtcagactcctggtttcctcattagtgaagggatctgctacagacttgggctgtttctataaactttaattacctctgatgaggagtgtatcccctcatcacattcaccccaaaggtacagaggagttcatttttaaaaatgtgttagagcaataaaaggccattagagggagggaggatggggtgtggaagagacgagagagcgagcgagagagagagaaaacacactagctctccctgctggaataataggcttgaaatatgaggaagttgatcaactgccgctgccttccaaaaacagattaatccaccttggtagctttcctttcagagcaagcttttggctctgtcgactttctctatcagcctgaactcaaaaggacacaggccacatgccatctgagcttaagagttattttgtgtgttgatctgagaacttcacattttaaaacaatgaattcatgtttctactgtttgttgctgtctgtggatttgctgatataaagaggagagtcctagcctggtcatttaatgaataattctaaggaacctgaacttctccagggtgcccttctacatctgcagtggtggttctcagctggggtgactttgcttccgtcaccccacccgcaggatatctggcaatgtctggagacattctgagttgtcacaagaggggcgggcgatgctactaacacctaatgggtaaagcagagatgctgccacacatcctacgatgaacgagacagccccctccaccccagcaaatcatgatctggcccaaaatgtcaacagtgtcaacagttgagaaactctgatctacagatatagggaaccctgcctaatacacaaatcctccgtagttcccaagggcggcctgtaggtaagaaaaatgcagagagagccagtgaaccacaggacagccctaaagccagttggtgaaactgtaaatccataatcctaacaaaataatgtacagtcgtaacaaagtgagttttagagacaaagctttacaatttctggtaaaatttccacatgtgcaaaaaacagagtagataaatcaaggtcctacatctacttgtgttaacaaactagtgaagtgcataatagagaataccaggtgaactcaaggcagtactgtttctaaaattgtggaactagtatgaaagtagatatggagaggaggagtggtaatggtattccctgacattcgctcagcagttgctactgagccatgcattcgcttaaatactaggaaattatcaatttttcaactgtcgaaggcctataaaaatggcaattttctatcattcaacctaaatactatgtgtaatgtattattatatattaatattgttaggatatatattatgtataacatattgtgttagtagtaacatatttgtgcatcctttacattagtgtcaaattatcatctgctatattaatatcacagattaatttatattattggtatattaatatattgatcaaatagagggtcagcaaacttttttctgtaaggggccagagaataaatattttagggctgggcacggtggttcatgcctgtaatcccagcactttgggaggctgaggcaggtggatcacttgaggtcaggaattcgagacctgcctagccaacgtggtgaaatctcatctccactaaaaatacaaaaattggccaggcctggtggcgggcgcctgtaatcccagctactcgggaggctgaggcagtagaattgcttgagcccaggaggtggtgggtgcagtgagccgagatcacaccactgcactccagccttggtgacagagcgagactttgtctccaaaaaaaaaaaaaagaataaatatttgctctgtggctcctgcagtccctatactgaccacctgactttacagtagtggctctaaagcaaccacaggcagtacatgaaagaatgagtgaggatgtgttccgaagtatggatggacactgaagtttgaatttcctgtcattttaacaggtcaggaagtattcttttttggatttttttttcaaccatttaaaaaatgtaaaatgcattcttacctcctgggacatgcaaaaatgccagatttggctggcaggctgcagtttgccaaccctaggattatatcaacattttatatacgttatacatattatagtatatactattgcacattatatctatactatacatattatgctatactacatcatttcatatatcatgtcatattacattacatgatattctatattaccgtattatattactgtatattataccatcctcctgggcagtagcagcctcctgatccccgtcctcctgggcatagcatcctgggtgacctcatctttttgggtggcagattctgggtagaaaccctctccctaggcagcagcatcctcagtagcccccatcctcccaggtggtagcaatcctgtgtggttccaatcttcctgggcggtaaattctgatagaaacccatctccctggacagtagcatcctgggtgtcccccgtcctcctaggcggtagcatcctgggtggtctccatcctcccaggtggtgtcatcctgggtggtctccgtcctctcaggaggtggcatcctgagtggtccccgacctcctgggcatagcatcatgggtagtccccatcctcttgggaggtgacatgctgggtgatcctcgtcatctcaggaggtggcatcctgggtggtccctgtccccctgggtatagcatcctgggtaatcctcgtcctcttgggagtagcatcccgggtggtccccgtcctccccagcagtagcatcctgggtggcttcccatcctcctaggcggtatcatcctgggtagccccctggggcagagggaagagctgtggcctccgcaacctcctactcacttccgctccgttctcttgcccgccctgcagcggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggctt

SEQ ID NO: 16927 - DNA, 25814 bp, Human
acatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttgggatgcctaaacaggcgtatcgcttgaggccagtaattcgagaccagcctgggcaacatggcaaatctgtctctacaaaacaaaattagaaaaattaactgggcgtagtggcatgtgcctgttgtcccagctacttgggaggctgaggtgggagaatggcttgagcccaggaagcggaggttgcagtgagccaagatcatgtcactgcacttcagcctgggtgacagaaccagaccctgtctttaaaaagggagttggtggggagaggttctagaatgtcatgtagcaaccagtttaaggactgggactcagggatccaactcccacagtttccctgtgtgaccctaggcatttgacttagcctttctgagcctcaggttttttgtttctgaagtaaaaggattggactaggtaatctccaagatcctaggaacccaggagaaagatgagaaaatgtacaagaatgaacactcaggtggaaatgctgcaatcctgagaagctcccaggatgaatgaaaggcacaggacctcttacccctcacccctgcccccctcaagagctggtttctcaaacctttctcttaggccccttcaaagggggaaaactaaaaattatacaagttatagttcaaggactttaaatagattatttatatgattgctcataaggatgaggctgtgaggagggaacaccttatttaatctaatgaaattccataggaaagaggccttttgtatattgaatcaatttatctgccttctcagtgcatctgtcatattctgaaagattctgggttgatcttttgcgataacctctatggctgtgagtgtgtgtgtgtgtttgtgtattttttaacattttgtataatgattggaggttggtaaaaagtaacacaacagtacttttttaatacaaacttggtgtggtcttgagttgtcttccattggagagcgtacgtgtgccacagattggtgcacctgccggcatctctaggattgcaccaactccctctagctcttcttggtggcctgcaggggcctagggcgcattcacttccctctgcttgactttacgtggtgttctagcgtcagacatcaggcgatgccgtgcattacccaagacactggacagctccggatcttcccgtctaaccactaatcaagttaaaaagaggaaattaacgctttcttagtagtctctgaaagaaactagttatttgcgtaaagatgacttggttttgtgttgtttatccctggggagaagggtaaagaagaccctcaaactggatttgctgctgaagtgcttttaactcacctgtgcggagagcggacttcaagagagggcgtgccggtgctccggacaaaacctggggaatactgaaagccaccaccaccaccgtcattccagcatgcagatctcagtcctgggttggtgttgtagggcatttatttatttgacttgacggcgcctttcaaagcttgcgaggatcccttcctcttcctcgtgtgcatctgccaagcctgtgccccgcgcctcgcgggtggacccgggctggtgggcggggcctgcagcggggtgggagcccggtcgcccggcccctccccaccccgccccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcaggtgaggggtccgcggggagggggcgcgcttgggaaccgggaggccccgcgagatgccgcccctgatcccatccctgggcgccctgcaagtgacttaagagccttcggggcctcgggagagaagatgcaaacgccacggccggctgctgagacgcaactaggctgctgctgccgtcgattctgtaacaggagaaagccccatccgcgcccggattacagaccgtctgggccctaaactcagggggagactcccggcgtcttttgattccctgtcctcctgcagctctctgctggcgggcgtctaaataaagtagcttccccaaaagacccaagatcccaccgtggctgtcatctgacccttctggagactatcagttcaagtggaggcccccaccagtccccgagtgccctgacagccctccctgaccccaagtctgccccctcagtgccagccctccctacagatgtgcctcccatcacccgctgcacctcccctccttccggttcaggcccgagcaccctgaaatctggattctgtcccccagcgccccagctccatggcttctaaacctaaatccattgaaaccttttctgtcctctaaattgactgcctaggttccaataacaccatggtcacctccttcctttctcatgaactcttccctggccttccgggatacccctccggtttcccgccctgtcaggctgtctctgcttgggaccctcctgctctgtcaggtttctatgtagctaattgtgatgcccaaggccttttctctccttccctggcactgttcctttgggggatttcagccaaaccctggcattaaacacgggctataggcccatgactcgcacatttatatctctcttggtaccagttgggtgatgggtggtggtttattatagtcttctacttttctacttgcatgtaggtttcaaattttcttttctttctttcttcttccgtttttttttttgtttgtttgtttttttgtttttttgtttttttttgagacagggttttgctctgttgctgtggcccaggctggagtgcagtggcttgatcttgcctcactgccacctccgcctcccgggttcaagcgattttcctccctcagcctcccgagtagctggaattacaggtgtgtgccactacgcctggctaatttttgtatttttattggagatggggtttcgccatgttggccaggctggtctcgaactcctgacctcaggtgattcaccttcctcagcctcccaaagagctgggattacaggcgcgagccaccatgcctggccaggtttcgaattttctattaaaaggtttgaaaataatttctgtctctagcccacatctcttcttggtgtgacctctgggctcattcatctggctgtctccctgacattcctacttcagcctctctccagcatctccaacctaatgcagctcaaatgggactcgtgagttccccagctgagctccaatcggggcaccagctgcttaagcccaaaatggacattgacctcagcttttatgcatcaaatgtatcaggaagtctccagtttgtttttacgtctggaaatatatctgaaatccatgtgcccaccctaccccctcatagctttctgccaccagacaaatccaaggctcctttgtctgtccccattttactcctgcccctccagaaatttctcctcacggctgttcaaagaaaatctagactcctcagcacagccaacctgtctctccctccctcacccacgtggcctttgaagacatggagccatagaggagaaccaagtgctggatgtgggctttttcatgggcatctgttttgaggagaaaagttgtaaatgtttttgtcttattttcatagcattgggaatggtaccacctcccgaaaatgtcagaatgaattctgttaatttcaagaacattctacagtgggagtcacctgcttttgccaaagggaacctgactttcacagctcagtacctaaggtgggtctggcctcactattggcaggaacgcaccggaggagccagccctgggctggtcactgggttgggccacaggaggaagggagtctgactacggtcaccgtgtgactgtgacaaccctcagggagcctccctgccagccttttgctgtctgggaaattctcgtggccaccttttctcttttaggttttctagttgtgatggttgacgatttgactgttaatcacagggctgctggcagatacagacattttatcatgcgtatgtagatataatcagccatagtggtaacctcatgctgtgcccatcccagcttgtttgtcacagttgatatattttaaaagaaaaataccactgctgtcatctctaggtatgagtagtattgctggaagtcagcaatgttgagtggatgctacccaagaaactgagatatgcaaagcggtcaggaagccccttgctaccatatatcacctgttcccctccaatggattataacatcatgccccagtgccatgcgcgatgcacataatttgcataatgagtgctcagtttctccgtggttccatcctgaaattaaaagtaagacagctactgactgttaaaaaccccattctcggacaacagcaggggctgtgaaggaagagtgagtgtcaccctagacggtcatctcagtggtgatctgaacgccctctacctctcctgcctgtcagtgtttccctacgcctggtgaaggaagtcagtgccagcactcccttggcagcctgccaccatacgccacatgctggactgcaggtgacacacctttaggccaggcgcaaacagcagcaggaggcccaaggctgacaagccaacacacctgctttctgtgtgactcagaaacatacgaagatagacaagtccttcagtgaggcaggaggaaatttcttcccagatccagctgtcatttcacaaaaatccccaaggcctgctacatcagagaagaagtagaaaggtgaataagatagtcctcgtctgtgcattgctggcttttgttttttaacttttagttcaaaataattccagactaacagaacatttcaaaattttaagtagaatacaaagaatttccaaatagcctacaatcagattcaccaatttttttttttttttttttttttatgagacggagtctcgctctgtcacccaggctggagtgcagtggcgcgatctcggctcactgcaacctctgcctctcgggttcacgccattctcctgcctcagcctcccgagtagatgggagtacaggctcccaccaccatgcccagctaattttttgtatttttagtagagacggggtttcaccgtgttagccaggatggtcactatctcctgacctcatgatccacccacctcggcttcccgaagtgctgggattacaggcgtgagccaccacgcccggcccaggttcaccaatttttaatgttggtcacattctctcccttcctctctctctctcatgccctttgtgctgtaatatttcactgtgtatttcacaagaacaaggataatctcttacatcacatagtacagtgagaagctcaggaacttttacattcataaaatacttgtatctaatttacagtccatagtccagtactgtcagctgtcccaaggattgaaggagggcatactctataattaatttttttcctgatgtgcattttctagtactgattggctttatcatttgctttctgtgctgtctctactcagtctgaatagccacggagattttactgtggaaaattaaatttcttctctgtctgtctgtctccctgtagtttttcttgttctgtgctgtgcttttgggtttgtttgtttgtttttcttttttttttttttgagacggagtctcgctctgttgcccaggctggagtgcagtagcgcgatctcatctcactgcaacctccgcctcccgggttcacgccattctcctgcctcagcctcccgagtagctgggactacaggcgcccgccaccacgcccggctaattttttttagtagagacactgtttcaccgtgttacccaggatggtcttgatctcctgacctcgtgatccacccgccttggcttcccaaagtgctgggattacaggcgtgagccaccgcgcccagcctttttttttttttttctttgagacagggtctcactctgtcaccaaggctggagtgcagtggtacgacctctgctcactgcagcctccacctcctgggttcaagcgattctcctgcctcagcctcctgagtagctgggactacaagcacatgccaccgtgcccaactgatttttgtacttctagcagagatggggtttcaccatgttggccgagctggtcttgaactcctggcctcaagtgatccacctgcctcagtctcccaaagagctgggattacaggcgtgagctaccacacccagcccatgccatgcctttttgccattatagtcgaggcacttggctttgcatgtttatcttttatgttagcgatcccaatgacttcatgaagtgacttcatgagggtatccacacctgggttccaggtctcccccgcgtggaactacagagtgagtatggcatgtgctggagaaaacaaaatatgtgctggccgtgtccttggggaagatatttgatccctaaagatgtgattgcctcatgtggctctacaaaagagttgtttagagtttagcatgagcaattgcacagcacaaactctctgttgtttgcgtgcattggggcagggcgtccagagccgggggcacttcagaggatgtactggtgattttaatataaaaacatccaaaacaattagatgtaaatatgaggaatgggtcatattacctatttaatgcggggagaagtatttgtacatgcaataaaaataacctagtgaaggccaggcgcggtggctcatgcccgtaatcccagcactttgggaggccgaggtgggtggatcacctgagatcaggagttcgagaccagccttaccaacatggcaaaaccccatctttactaaaaatacaaaattagccgggtatggtggtgcatacctgtagtcccagctactcagaaggctgaggcaggagaatcacttgaacccaggaggcagagattgcagcaagctgagattgcaccattgcactccagcctgggtgacagagtgagactccatctcaaaaaaaaaaaaaacctagtgaaaaagatgttattgcaaaacaacttttgaaatactgcacatgctggacaattgatgcattagtttaaaagaaggaaatgggccagtaatcccagtactttggggggccaaggtaggataatcatttgaggccaggagttcaagaccagcctgggcaacatagcagcctcttgtctctacaatttttttttttaattagctggacttgagttggaaagaaggaaggcggaagggaagaaagaaggtagggaggaaaaaaaatatggccacatgtgagaaaacccccttaatgaaatgaccgctggattttccaaatgatgggatgttaagcagccgtgaagaaatggttgattgacaaatatttgtggtatattaagtgaaaaaatagcatgatcccaatgatctctatctactttttgcaagggatttttctaggtatcactaagaatgctgtgagatgtgatgtgctaccttagactatgaagtcaaacagatctgagttcagttgggcagatttcttaggctctccacgcctgacccctgtgtacttaataaatgttggctgttgttatttttatcaccatcactttcatcatcacttctgggagcaaccaaattggttttggcaccagaagatgtcttgggggaccaatcagatagctcctcacttttttattttattttataaatttttaaattaaattaaattaaattttttgagacagtgtcactctgttgcccaggctggagtgcagtggtgcaatcacgtctcactgcagcctccacctcccaggctcaagcgagcttccctccttagcctactgagtagctgggactacaggcgcatgccaccatacccaaataatttttttattttttgtagagacaaggactcaccacgttgtccaggctgttctcaaactcctgggctcaagtgatcctctgcctcggcctcccagagtgctgggattataggcgtgagccactgagccgggccagctcctcactttttgcaggatgagagcctgggcttcctttgatcacgtggagccaattacacctccttggctgttgcgagcttagattcaggagattgtatttccctagcatccaacaggcatgtccaaatgtcatctcttttcttccacttcactttctgtcatgttccctttagcggttgctgtcggggctggtgttctgactgagactgatgaattgttttataatttttccagagtaattgcaatgatagtcatttataggacaggacagtcacgggtcacttaacaactggggtagattctgagaaatgcatcattagacagttttgctgtgtgaacgtcatgcagtgtacttgcacaaacctagatggtgtagcctcgtatacacctaggctatgtggtttagcctattgccccaggctgtaaacctgtacagcatgttactgtactgagtgctgtaggcaatcgtaacacaatggtatttgtatacaggcatatcacagagataaggcagttttggttccagactaacacaataaagctaaaaccacaatagagtgagtcacatgaatttttttgtttcccggtgcatctaaaaattatgtttatactgtagtccattaagtgtgtgatagcgttatgtctaaaaaaatgtgcacagcttaattttaaaatatttacttgcggaaaaatggtagcaatcatcagagccttcagcaagtcataatccttttgctcgtggagcatcttgccttgatatggatggctgctgactgatcagggtagtggttgctgagttgcagtgactgtgacaatttcttgaaataagatgacaatgaagtctgctgcatcaactaactcttcctttcatgacagatttctctgtagcatgagatgctgttcggtagcattttactcacagaagaacttctttcaaaattggaatcctttcaaaccctgctatcaactaagtttatgtaatattctaaatcctttgttgtcatttcaacaatgttcatagcatcttcaccaggaataaattccatctcaagaaaccactttctttgctcactcattagaaacaactcttcatctgttcaacttttatcatgagattggagcaattcagtcgcatcttcgggttccgcttctaattctagttatcttgctgttttcaccacatctgcagttacttcctccactgaagtcttgaaccccttaaagtcatctatgagggttggaatcagcttcttccaaacccctgttaatgttatattttgacctcctcctatgaatcaccagtgttcttaatggcattttgaatggtgaatcctttctgggaggttttcaatttaccttgcccagatccatcagagaaatcactatctatggcagctataactttacaaaatatatttctttattttattttatttcattttattttattttttaagatggagtctcactctgttgcccaggctgaagtgcagtggtatgatctcagatcactgctgcctccacctcccaggttcaagtgattctcctgcctcagcttcccaagtagtgacaccacaccaggctaatttttgtattttttttttagtaaagtcagggtttcaccatgttggccaggctggtctcgaactcctgacctcaagtgatttgcccgccttggcctcccaaagtgctcagattacaggcatgagccactgtgcccagcttcaaaatatatttcttaaataataagatttgaaagtcgaaataactccttgacccatgggctacagaatggatgttgtgttagcaggcatgaaaacagcattaatttccttttaaatctccatcagagttcttggggaaccaggtacattgtcaatgagaggtaatattttgagagaaaactttttatcctgagcagtaggtcttaatactgggcttaaaatattcagtaaaccatgctgtaaacagatgtgccgtcctccaggctttgttgctccatttgtagagcacaggcagagtagatttggcataattcttaagagctctctgattttcaaaatggtaatccagtgttggcttcaacttaaagtcaccagctacattagcccttaacaagagtcagcctgttctttgaagctttgaagccaggcattgacttctcctctgtaactatgaaagtcctagatgacatcttaatagaaggttgtttcatctacattaaaaatctgttgtttagagtatccaccttcatcattttagctagattttagctagatcttctggataacttgctgcagcttctacatgggcacttgctgcttcaccttgcacttttatattatggagatggcttctgtccttaaaccttatgaaccaacctctgctaacttccaacttttctttttttttttttttttttttgagatggagtctcgctctgttgcccaagctggaatacagtgacacaatctcggcttattgcaacctctgcctcccgggttcaagtgattctcctgcctcaacctcctgagtagctgagattacaggtgcatgccaccatgcccggctaatttttttgtatttttagtagaggtggggtttcaccatgttggtcaggctggtcttgaactcctgacctgatgatccgcccacctcagactcacaaagtgctgggattacaggcgtgagccaccacacccagccccaacttttcttctgcagtttcctcacctctttaagccttcacagaattggagtgttagggtcttgctgtggattagactttggcttaagggaatggtgtggctggtttgatcttctatccagaccactgagactttctgcatattttcaataaggctgttttactttcttattattaatgtgttcactggagtagcactttaaatttccttcaacaacttttcctttgcattcacaacttggctaactgtttggcccaaggggcctgttgtggcctgcaatatgccttcctcactaagcttaatcctttgcagcttttggaatagggatgcccgaggagaaggagagaggcaggagagtggacagtgggtggagaagtcagaacactcacaacatctattgattaatttcactgtcttatataggtgtggttcatggtaccccaaaacaattacaacagtaacatcaaagatcactgatcacagatcaccataacacatataatcatgatgaaaagttttgaaatattgcgagaattaccaaaatgtgacataaagacatgaagtgagcatgtgctgttggaaaaatggcaccaatagacttgctcaatgcagggttgctgcagaccttcgatttgtaaaatgcaatatctgtgaagtacagtaaagcaaatcacaataaaatgaggtatgtctacatctaaatgtatttaaacatagaaaaggtacagtaaaaatacagtatcattatcttagggcatcaacgttgtatatgtggtctgtcatctaccgaaatgtcattatgcagcacatgactttattgaaaatcattgtaatatctttattttggtaaatttttgtaaatcaatgtctcataaatcacatgcccctgttttcaaaaatacgtaatcaaggaagcaagctttcttggtcaagtatgctgaatactcaaccccttggagaggcacgtagtcattaagatgttcaagtctctgagaagttctgttttgaagacacgtatttctatgtttaacacagtttccactcccgcgccgcccccccctccaaattaagtaccagtcagcctcagggagactgaagccagaactctcctgattgacctatctttttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattggttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagcatcaaaaattgttcccaggttaggtggagattgcagtgagccgagatcacgccactgcactccagcctgggcaatagagtgagacttggtctcaaaaaaaaaaaaaatattgttcccaggttagatttggagggtcatggtgaccaccagagtcccctaaatatgagatgagcatatttagaatatcaggaattgaaaactaattaaaccatatattagcaattgagagagtaaagaagattagaggttaaaagaacctaattcacaaaattcacatacagcccttcaaaactcacatagagaaaagcactaaaagaattgtctctggctaggcatggtggctcacgtctatgatcccaacactttgggaggctgaggtggtggatcacttgagcccaggaattttctttttttctttctttctttctttttttttttttttttttttgagacaaagtctcactctgacacccaggctgaagtgcagtggcgcgatctcagatcactgcaaactgcctccagggttcaaatgattctcgtgcctcagcctcctgagtagctgggacttcaagtgcctgtcactatgcccagctaaatttttttgtatttttagtagagacggggtctcaccatgttggccaggctggtcttgaactcctgaccttaagtgatccacctgcctcagcctcccaaagtgctgggattacagacatgaaccaccacacttgtccttgagcccaggaatttaagaccagcctgggcaacatggtgaaaccctgtctctacaaaaaacaaaaaaaataccaaaaaaaaaaaaaaaaaaaaattagccaggcatggtggagtgtgcttgtagtcccagctacttgggaggctgaggtgggagagtcatctgagcctgggaagtcaaggctgcagtgagccattatcacaccactgcactccagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtacaagtttttgctcctataattgctaactggcttaccaggtcctaacttgtcccaaatcctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacaagttttcttgtctggttttcagacgagcactttagaatgatggaagcaggtccattaacagccctgaaaaagtaacagcagccaaagaagaatacaggacataactcaaacaccatgattgcctggaaccatttatgaatcattctatagctattattgagtacatctgtgtaacagctgcattctgagcactgaagctacaacaatgaacgagacaaaatacctcatggagcatatatgtgctaatcaggaatacagataataaataaatagatacatattacatgacaggtagtgactatggttcttaagaagactgaagcaaggcaataggacagaaagtaatgggagctgcacttctacatagaatggtaagatacagtctctctgaggaagtagcatttgagcagagacccatatgaagtgaaggagccagccacatgaatatctagtaaaagagcattcagaagggaaacagctttagacattgttggaaatatatatggttaattatatatgttaaacatgtaaaggtggccactaaaaataatagagatgccatctgtagcttccatcctgaaaaaggaaataaaattcaagccaacaaaaagcaggaataaaagaggagaagacaccaaaaacataaaatagaaatttaaaaagaaatccttatagaaaatacaaaatagcgtagctggaataattccaaatgtatcagaaaccacaataaacataagtggactaaacttcattaagaaagacaaagattatcagattttttaaaagaaactaaatccaactacccttcttagccatgtcaatcaatgtcatgacaatagtatatcaaagcagtgtacttccgtggactaattgttctgcatggttatgaaaaattaatgttgaagtttttaaaatgtgatttttgattgtcattttgcttgttcttctgcttagccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctcaagcttcccagactcctaagggatatgtgtagagcagactttcaggacaaagtctgcacagtgacagcagacctttccctccctgaagggcagctgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgacacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtcctttcctgctgccacaacaaaataccacagactaggtaacttataaacactagaaatttatttctcacagttctgcaggctgggaagtccaagatcaaggcaccagcagattcagtgtctggtgagcactggcgtgctctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtgagcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgccactgcactccagcctggacgacaagagtgaaactccatctcaaaaaaaataataattaaaagaccagtttattttatttatttatttacttttttctttatttctgagacaaagtctcgctctgtcaccgaggctggagtgcagtgtggggtgatcctggctcactgcaacttccacctcccaagttcaagcgattctcgtgcgccaccacgcccggctaattttttgtatatttagtagagatggggttttgccatgttgactaggctggtctcaaactcctcagtcccccaaagtgctgtgattacaggcacgagccaacacacccggcctgctttatcttttttaaaaaagaagtgatggcttgtgtgtcatttaagctggagaattcaggaaccaaaatggtttgtgggcaccactgtcagtccttgatgcaccccctgagtggcctcagggtccctgaactgagaggagcacctgctacctgctccttcctattttaagtctaaaacggctattatcactgataaatgtgaaaaaaaaaaaggtggtgcccttccactgcttagtcatgttcttatttttgtctccattactagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccaactcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatcctaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaataccagtaatcacccatgaactgacaaaatccaaacattttacaaaacaaaagggtatgagccattgaaaacctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcatacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagtaatgactggagttgggaaaagggccgagttccatttactcagaggtgttttaaagggagaacgagggccggggcaggaggatcgcttgaacccaggagttcgagaccagcctggccaaaatagtgggacccccatctctataaaatattttaaaaattagctgggcatggtgacacatgcctgtcgtcccagctacccaggaggctgaggtgggaggatcacttgagtcctggaagtcaaggctgcagtgagctgtgtttgcactactgtactccagcctggacaacagaacaagactctatctcaaaaatgaaaataaataaaaggagaatgagggagtagaaagaaagaatgcgtggggagttgagcagaatcagggaagtgaaaaaaattttaaatcagctaaggggatgggtcagtgccgtgaggccctctgtgtctgtgaaccggtgtttatcaaggctaggcttctaccctcccacagagacagggagacagaggccctgtacttcctgatgatttcaaaagaatggctcgcagatcattgagaaaaatatccctgcgttgtgggagatacatacatgtctcaaagggacagaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctcttagtgcaggggtttgtttgttttggctttggttttggtttttgaggcggggtttcactctgtcgcccagtttggagtgcagtggtacaatcatagctcactatcacagcctcgacctcccaggctcaagcgaccctcccacctcagcctttcaaattgctgggactacaggtgtctgccatcatacccagctaatttttaaaaaattttttttgttgtagagaaggggtctcactatgttgcccagactggtctcaaactcctgggctcaagtgatcctcccacctcggcctcccaaagtgctggggttacaggtgtgagccaccacacctggcttagtgcaggggtttggatagagttgttcacgcagagtttctgtttttctcaatatagaacgagatggtgcctgtgtttaactcaggctcaggtgtccaggggagtatcacttgctgtgtcaaggcagaagtggtatatccagacctgggaggcccattgctacactgccagtagtaggtacagtggatcagaattcttgcttgttattcttttgatgtatgtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcacctagggcatcgctccttctccagccttcactgcccaaagccccaggtccctgaggagcaaaggtgatggttctagggcaggaggggaaaaacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagaaatgaaactctggatagtcactgacactagagaatgaaaagattccaagcccggacccaaaggaactatctttggtctcatttcccaggaagcagactctaagatagagatttgtattcaaaaggcttgatggggaacatccttgggaataataccctaaaggagtgaaggtagccagatgtggcagagagaggttgagctgtcacacagccacaacagaggcctcagccaatcccatgtggcctctcgagctggggtggccctttagagatgtcctaagctgaggcaagagggatgggcgtgtgaactccacattggccatgcgctggatgtgggctactcccaggaaggggccctaagctagggtgagaggtgagacagcagcagccaggagctaggagcacgagtgcctcattcctgaaggcaccacagcctccattacagtcacccctgggaccacttggatctactggaagcagctcctccaggatctgagttgatctcgtttcctggggagggttacaggaggaagatgagtggaatgcactccagcccccaccgctgctgctggtgtcgggaccacaaaggaatgcttgtgggctggctccttcctccgctggccctgagggcctgctctcctctcccgggaggagtctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccagggggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctactaaaaatacaaaaaattagccaggcgtggtggcgggcgcctgtagtcccagctcctcgggaggctgaggcaggagaatggcgtgaacccgggaggcggagctggcagtgagccaagatcgcgccactgcactctaacctgggcaacagagcgagactccgtctcaaaaaaaaaaaatacaaaaatacaaaaattaacccggcatgctggcgcatgcctgtaatcccagctactcgggagactgaggcaggagaatcgcttgaactcgggaggtggaagttgcagtgatccctcacaccactgcactccaccctgagcaacagagcgaga

SEQ ID NO: 16928 - DNA, 524032 bp, Human
  misc_feature (1)...(524032): n = A,T,C or G
ccctaggagtgctaatagaagaatccctctgctggttggctctccaacacccatgagcaagaatgtatgcccttgtgcctgggggcattcatactagcctatacagtcatggcaggggttcatttgctaccccatggttatcatatggggttagagaaatatataaatcatcaaatacaatcatcaagttgctcaccccccttgagttataagtgattctgtgaagtgactctgttaaccatctaccccgaatgccaaactccactgaggcataaccatgcaatgaggcataaccatgcattcgtatcccagtggtagagacattaagtgtttccattaccagtgataaattacagttttgttactaaagaaagggcagacaagacccacacacttttacttctaatgtgacttgtatgaggagggaagaaagccaatgccaacaagcccccaaatgtaacttggcctgggtgtagttaggcaggggagcaagagctctttttaaacactgtgcctgtcagcagcacacctgattgacagccgctgaaaatacttaagaagctcagggtgagaagagatggacagcgatgggggatgggaaactagaatcgaactctgtcttcagacagcagatagctcattaaagctaccggaaaaaaaatctctaagggtgcagtctgttcggctgcgtttacaaaaaacgagtacagccaagacctgggagcccgacgccctttgtggagacaacgaattctcctaattagatttcatgacgtacctcctccaaaatagctgaacacctaggaacaccaaacacgcttttcaaagagtctaagtaaattaacttttcccctgaatatgtcatagggaataaaggaagtcttccagaatcaaacttggacaattctggtagatatgcaagaggaatgttcgtgtccaacatctgtatttataatttcattgtattttttctccaaaataaaagaaatggtagagtcacctttacatttatataaaattatcttcatccctaagtgataaaagaggacacaaacacaaagtagacatttccaacattctgtctgctccctgctgagatggttgtaagttgcattgcaaagcttaactgttacatcaaaaagccctccaagagggcgaggctttgcgctttatagattccaggggtccgacagcgggagaagctgctttcagactcatctccttgccgggaagattgatttccccagcgttctccagcttcccaggactgtggccaccgcgctgagacccgaggcgtcccagagcgggacgcggagacagatcgctttgtgagcgccaatctctgcagcctctgggctgaagctgcgcccggcgcctgccccctacccggcctcactcacccctcctcctagagcacgtttccgcacgtgctcaggaccccttccacggcaaaggctcctccccctccactttcttagtaggtctccatctccagctcattcatcggcagccactgcttttagacagtttcctatctatccttcctttttaaaaacaaaaacagccgggacagggcggggtgggggggcgcggggagaaaaggcaggagatttaactccaacttcagagcaatcgtccccggctgcccatctgacaccagtgggtggggtgcaatctgacacttcccttcctttccagaaacgtgagtggagctggcgcgacccttgatctgggggtggggagacgggggagaaggtccgcacttccgtcctcacgactttctccccaggagacccggtatcagtggcgagctgccttctctcctcgccgcttgcaggtttggcgcctggaaaactcttcacgttctgctttctcctgctcctggctccgccccagctccagccccggcattcctccagctctacacgtcctggccgcccccttcccgctgcctctagagcgagcgtacggggtcatctccgcgtctgccctgggcccaaggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgaggtagggaccagcgctgcgcgtcccacggcccaaggaggaggcccccaggcagtttcaggagaccgcctttaattccattacatttacagagcaaggcacccactaaggggtttccgtggtgtgggttttcctcttctacttgctaaatggtgcctggaaatgggatgtccctagtggccacccgcttgtgcgtcttgtaggacttgttggctctactttggagcagtcgtgggagctggagaaagagatggtgttctggttttctgttagtgctgcaggcaatttcaaagggtcaccttatcccttcacccaatgttgatattttttccaactcaaatatctattgctaagctgtttgtaacgattggatgaaatatattttgaaatatgtctgccatcttgttctgtagagaattcagaaacattattttggagggtgtcattgactgtatgagtgagtgtgtgtgtgtgtttgggtggcaggggggacaagaattctctagttttcaccttttctttccctgaaggggcaatttcagaaatctatggtactgagtattagtttaacctaggagaagaagaaaatctctgtgtaggggtgtgaaagatcatggaaatatgctgatgcctaaattccatttagaacaattagtagtttagtgaagaatcaacaatacataggggactcagagggagctatcagatacccttaaaatatttgctgtccagttaagaaaaatagtgaattgacctattgggaaactgtcactgatgggcgctttgaaaataacacactttcagagaatagtaattgttttaaaaatgaacagcccctatccccttcggtccacaaactctataggtttgccttggatctgtttccataagggaagggagattccatcagttgtaatttaatattttaaagtacagttagcattacagaaatgaaatgaaataccatgtaattgctggagatttaggctaaatacacaaccaaggaaaaccgtttgaaaatagcatctgagatcatactcagctgtgttaatgtgagataactgttagactttggctttagtaaaccgccttagaaaaataagcatcatttatcagaattattagcatcacatattattaatgttagttactgtgtcaaagtaactgaggctgttaggtgttgggggtgcagattacaaaaaactaacaaattttgctaggtcttttgcccattttcttgagaaagataggcagtagaaaggaaagtcgaggcagagggcaagatgttacctccaaaccagggaactcaagattagaaagagcatcaaaaattgaaatgttgaatttctcttggtctttaggaggggctggattctcattgtatttcagaagcacacattatcagattaatctgtacaagttgagagaaagagaaatacaaaagcaagccagcattttggattagctagctaacattcgtgcttaaaactaattgcatcattaagaacatttctgcttttcttagcaaccatatacatacttggaatatagtatacagatgctgctcattactgttatgaccaaaaggcatgtggctgtagatgatttcacttgttgcaaattatcttcttatccattagcatctcataattaatggacaaggatctgaactgcagtgatactgggtggcttctattccatacagtgggcagtctgcacaaaactcatctaccatgatttttaccttttcatggtggttaaaactaaggatgtagccatctagcaaaaagccagaattttctcatagaatatgtgtgtatgtgtgtgtgtgtgtgttggaaattcctttatgcttgaggcaggcatggagtgattggatagaactctagcatgtagctccaaccctggttttgtttaataaaggccaagatatcctaacataacccttggatctctaatttaatggcctggattacctttcaaaggtttaacgccctggaaccctctgaaaaaccaagaaaatgtatcctattgggcactgcctgtccttttcacttgcaggcaagctgagtctttggtccttaaaggagagtctttactaatgacatcaaaatgtcagccaatgagcatcttgcaaggctgcttagaggccctggagggaatatctggttcatatagatttggttcttgaacttttctggttgctctggctcagggtttctcagccttggcactattgacatttgaagctgaatgattctttgctacagagctgtcctgggtattgcggggtatttagcagcacccctggcctcttcccactagatgcgagtagcactcctccagaccagtgtgacaacaaacaatgtctctagacactgctgaatatcctctggggatcaaaatcgccctaactgagaactgctgcgttagtgaggttgcccatagtaccccatgctggccatcaagagagtgcccacagaagtgtttacagctggcctaaactttgttggcgccttcgtttgattccaaaaccacgaggatccctctggagtcatgtaccccttacagtctgttcaaattttctatttctcttccattgaatccatatgaaatcctaagaattcaccttcaggtttagccattgatggatctcatccatttcccactttgttctttcagaatcttgtctgcttttaacgtaaattgtccatacaacagcccctgctcccaagactctcacaaatgcctgcagctttgttacttgtgctcgttcaaagcttacaaatgaccattttatggcctaaacctgggaagtgttaggcaaagtcagctacgatcttgttagcatttcctcactacgtgtttcaggattgctttaacaaaatctgattcctggacatgctgggtagatcatctattgagtagaaacatggaggagacaaagggtaaatggtacgtggtaacacagttggaacgtgtttctcaacttgtgttcttagcagccaagctctgcccctgactctgatcacaggcaaaggaataaagtctcatttcaatcctgagcttctcctaattcttgtggatcagagctgggattatgtccatagctaacctggagtttgccaacttttgcaacccataattaaaatgatttctatatatcactggcgtctatacttttcttcattcatggcacaagcatttcttgagcatacgcatttctgtaggtactaggaatgcagagaggctaaagagctcatagtctaatgaggggacaggtgagttaactgatagggggaatacagaagatcagcagaatgagggaacagagaggggcgggtgatgattcactgtgctttggggggccttgaaaggcttcactgtccagagaacatttaaacttgatcttcaaagatgactgccatttctaaggagaagaaggaaagtgatgccttcatgaggcagaaaagagtggacaggcaaaggcgcagaggtgttggtgattctacagctcccaaaaaagaagacttagagggccctaagcgcaataatttgtttggaggagcaggttagggcacctgcagtttgatacacgtacaaccacatggcttttcatgtaataaaagcctgaccgaataaagtcagaaatcagacctgttgggttttttttttttttttttttttttttttttttttttttttttttttttgagagagagagagtctcaccctgttgcccaggctagagtgcggtggcacgatctcagctcaatgcaacctcccatgttcaagcgattctcctgcctcagcctccccagtagctgcgactacaggcatgcaccagtagagactgggtttcactatgttggccaggctggtcttgaactcctggcctcaagccatctgcctgcctcaccctcccaaagtgctaggattacaggcatgagccaccacacccagcctctactggggggataattatgggtatgaacaaaaatgagagactggtcaaagcacattactctccaaggagcccctgggcatcacaactgcagagagtgaaggcatattgagtgttgcccaagtgaagtttggggtgcctggagaagaggatgtatcttgctgtgtgcaggataatagtgttcaacaggtaggatagtggtaattacgaagcgtctcactgtgctcatctcaggagtttggacttgtgtagagcagtgattcttaacctggaggtgactttgtccccaggggacatttggcagtgtctgaagacacaactggaagtggtggtgtattaatttcctatcactgctgtaatgaccacaaacttagtggcttcaagcaacacaaatttattgtcttacagttctggacctcagaaatcccaacaggtttcactgggctaacttcaaggtgttggcctgactgtgttccttctgaaggctctaggatctgttgtggttccttttccagtggcccccttccttcattttcaaagccagccaagttgcatctcatccactcttcttgtgtggtcatttctctctctcgctcttttcgggactcttgtgattacattgggctcacctggataatccaggataatctcattattttaatgtcagctgattagtgacttttaattccacctgaaaccttaagttccctttgctatgaggtattcacatgttttagggattggggcgtgggcatttttggtggtatattattctgtctaccacaggggagttcctaccggcatctagtgggaggccagggatgcttcttttaaataccctgcagtgcacagccccacaaggaataatcatctggcagtcaatgttaggagtgtggagactgagaaactctgctgtagagagtgggagaaattggtgatttttaagcatgaggtgtaacatgatcagatgtgttttagaggtaaactggtgtctgggggagcatgggttagaagcataaaacaagtggaggacagatcctcagaggaggtgggcatggggaaatcatgccaagcatgcatcctataaataactgggagttggcatataaacataatacttttatatttcccacttctctgttttagtaaagtttttcttgctctgttgaactccttgaaagcagaactgttactcatctttgaattcttaaaatctggcccctgtactctgggggttttagagagatcatcataaagaccagtggttctcaaccaggagaaagtttgtaccacagtgtacttttggcaatgcctggcagcatttttgattgccagaactggggcaggagtgtgctactggcgtctagtgggtataggccaaaggtactggtaaacatcccacaacacacacaacagcccccacaaacaaatacttatcttacataaaatgtcaatagtgctgaggttgagacgccctgtatacaagaaactgaattccaggttttgcttttcagtaccattttctctcatgcttgtggctttactctttgtcattttcctcttcttatctagtatatgtcaaccaaggctttgaaattcaaaaaaatgactttctatgggtattgagcatatgaaaaaaaataagggatttctaaatatatctatagggaagaagtgaatggtaaatatataatgatggaaactggaattaaattttaaaatgcagcagagaaaaatattgtgtttaaaaatagaggctcattcatgtcaccaaagagaaagtaattagaataagacagcttcaaaaagaaattgacaaaaagtgttttacaaggatttttgtctgaaatcagtataatgccttaaggtttttttaagttaggaaaaagagttattcaactttcacacatacactctctctcaggctatctctctgctagaattccttctgaaggcaatttttaattttaatggagaatactgtgaagatagcttctcagatgacttagaattgagttttcaccaacattttgagatttgagggttgggaagagcaaagtttagactcagaaagaaccttgggtagcatctagctccaaattgcttattttacagttgaagagagggactgtaaagcttaagccactcaaactcaggcaaagagccaagggcagaaccaccctgaaatccttcttgactctctatataaactgccaagcttctggaaaaagtaagtgaccacgactgcttttattctctggtgagcaccttaaaccttggcaatcagtttttatcctgattacgtactgaaactattctctcaaagttccctaagttccaagaatcttcttagactcctttggctagacttctgggcaaaactgagagtaccacgtcccctccctgctcctcctatccccatcacacacagagaatcttggtttcctccttacctttcttcccactcctctgactctgggattgtcttggccaaccctacagttctgtgtttttccttcaggtcattgtccctcctattgtctcattcacttttgtgacttcaaccatcatccctctgggggagactcctcactctgtgcctacctggaatcttgtagttgagctcccaatatatattttctgatttcttcctagatatctgctcatggatgcccaatggactcaaattctacatgtttgaaacagaacaaatcacctcccatttcctctgaacatgtttcattttatgtattccttattttggttggtatcgctcttcttctgcttgcctaggtttaccaggccagaatgcctttactcctcccttttttgtttcctcctttattcttccataagttttcgaacgctgcagtgtgtacttcccatttgctccactctagaaaggatttgaagtggagtgtgtctgagttcttacatctctctccagctgttcattcacaatgtcactgcctagtttgggttctcatttgctgtgacccccttcttggtcaccctgccttcagtttctccttgttgccatcttggacttatcctcaaaagatgcaattgtaatcatgttaacccctgattgaaaacctttgatgggtctcagagtgtacagaataaaatccaaactacttagctagtcatttcaatgccttttacaacatcatctcagcctgccttctcccaggaactctagtccagcaaagccaagctggccactcacacagatagtcatcaaatatttatcgcatgccagctatgcaatggacactaggaatgtaggtggagcaaataggtatggctctgcaaggtgcttccagtttatgaaagcagtaacttcaaatcaattaatctctatagttttttcagagtgttaattgcattttgacgagaggactgtggtagacagaacaatgtcccccaaagatgttcatgtcctaatatctagaacctgtgaatatgccactttacatggcaaaagaggattttgcagatgcgagattatcgtggattgtctgggtggggccaatgtcatcacaaggatccttataagagggaggcaggaaggtcagagtcagataaggagatatgaggatgaaagtaggcagagagagagaaagagggagagcggaaaggagggagggatagggcaatgagagagattttgaagatgctacacttctggctttgaagatggaggaagcagccacagcccttggctgtagcagcccctagaagctggaaaaggcaaagaaatggattcttagaaccttcaggaggaatatagctctactgacatcttgatcctagctcagtgagacttctgaccttgaggactgtaagagaatatgtcagttgttttatgctacaaaatttgtggtaatttcgagcagcgataggaaactgatacaaggcataaacaggtctgggatgtctcagctgaaatcattggatgaggaggcatttgccaaacaaaaagaaagggcacagagctcctgcgagaaggaatggcgtgtatttaagagggaacatagcatgcttcaagaatttagagaaatccaactagaatggattatgggattgggaagatggtgaagaataagtctcgctggactttgggcttaatgatatggattttaccatttaatgtaaagattccccacatagattttgtttcctctccttctcactttacttttgataacttggtcccatatctacctgagaaggctccatttgtactttatggctcagccaggtgcctccaaataaatgagcttgactctggtacatgtcatgacacattcaggatttgcagaaacagaagctcatgttttcatagtgagattcacattcttccaatctggtgcttgaaaaagagaaagtgtgtttcatatcaaaatctagtcaatgactgagggagtctgcatgcagatagcagttctcccagattcccagaggcttgcctttggggcgtgacatcttgttctaaaatttactgcatcctctctgagccattacttagataaagagagtgagactgtgattgtaactatgttacgacatggcagaaaaacccttggaatgtaatgtgtgaaaaaatgaaattagttgtgttatctggtaaagaacgatgttttcattagctattagggaaacgtgaatcaaaactacaatgagatatcatttatacccactaagatggccataataaaaaaagatagataataacaagtgttgacaagatgtagaaaaatcggaactctcatacactgctggtgagaatgtaacatgacgcagcagctttgggaaacagtttggcaattcctcaaaaataaaacagttactccagagctcagcaattctacttctgggtatatacctaagagaaatgaagatgtatgtccacaccaaaacatgtatatgaatgttatagcagcagtattcataatagccaaatggtagaaacaattaaatattcatcaacggatagatgaatggttaaacaaaatgtgattaatgaaaaattactcaacaataaaaaggaatgaagtactgatgaatgctatgccttggatgaattttgaaaacattatgctaagtgaaagaagctagtcacaaaggtccacatattgtataattctatttatatgaaatgtctagaataggcaaatccatagagacaaaaagattacttgttgtcagaggctggtagggagggatgtggagcgacagctaatgggtataaggtttcttcttagggtaatgaaaatgttctggaattagatacaggtgatggttgcacaatcttgtgaatatatttaaaaaatcactgaattgtatactttaaaagggtgaattatatggtctgtgaattttacctaaaaatgatatttataattttcagaaaatatgttgttgccacatcttgttttcaataaaacataaatataaatgtagaagagtagttatatagtcagttgaagcttcatgtattcaacatgaaactagggaggtagtaacggctctgggagattgaacagagtcgtcggcagccagccatgggattttctgagattggttactgtggaaattcgatgtcctgattattgcactttgaaagcaagcacagagaagctattaaaagattgctttttcagagaggcagagattttaaaaactacttacaatcttgaaaaattgcctggccttatctcacctgaactattaaaaagcctaagattttcaggagccgttagaagtaacagtaattctagaaaccacctatcgaatgatatgctgatggatccaagaggagaatgctgagcctgagaagctctcctcatctttagagaaattggaagtgaattgaattatgtggcttgatggaccaagaaaataacatgttttcatttctgtagaagtggacagctcatggaaataggtgaattaataccacctataggagctgaagtgtcaataagcattggatcagttctcagcttgtattgctcataacttcatctctcaggggtttgaaaaacaattgggcaagctggtactttgaggcccagatatagatggagtaggggaaagagaagccttaggcaacaatagccatgctgcctcagcgtttaatataacaagggctttgatatagctagtaattttgtccagggaaatcctggactgggccagcagactttctgagcaaagtgtaattctgctcaaattagaacctccaggtgatttcttgttcacttatttcagtcaaataatcgttgatgggtgaggatgatgatgatggtgacaaacaaaataacaattagtatttgtagaatgcacgccagtttagtgttcttagaacaactctgtggggtgatagtatcaaccttcattttatgagtgaggacactgagactcagattcagaggtaggcagatttagctgcagagaaaatgaagtgaatcggttcagctagactctgaaccagactgcctaggtttaaatcccagctctgttttgtgacattaaacaaattattaagccccttttttgccttagtttcttcatctatcaaatgagaatgatgaaagtgcctacctcaaagagtttttgtgaggatttcatgtcataattacctggaaagtgcccagcacgtaggaagtactaaaagatgcataggagtgcaaggctaaataacattagagatgtggtcacacactaggaagcaacaaaggtaagacctaagctaaagaattactttagtcaaaaatagttatcgtgcacctactatgtgtgccagaaactttggtcagtgagttaagcccagctgcatgagacaacagcaggaaacaagtggaactttattttgcgagctgttaaataaggtatagttttcatggtaggcattggagtgacagcaggctgtcactccaggcattttggcctagtgacttggaacacaggaatttgtcagacttgtattgtggatttggtgtaacccaagacatgccaataggccaaggggctgccttcattccagtacatggtaacttcattgcatttagacactttttagtagaatatttagaatgttggaaactgaaaagttcttagtcgagccctgttctttaactggtaaatggcagtgtgcttctcatttcaagccaggtgtgtttttatttccacatactacagtgattacatgagaccaagttgactgcttttcaaggcccatctcattcaacatctttccagggtaaaaacgcagcagcactaagttaagacaatcctatctacaatcagattctctttttgctcaaaatctaaatgtaaactccattagcatttctagactgattttagcattctacgagcaaatagaatattaggaagaaaaagtccttgaaggtcttctgtctattccaaacatccatgtcgtgcttaaatcccatctatgacacccccagtctatgcctagctatcacccacaaacagagaccttcatggttctgcctttagattataatagacataaaaattctccatggaactgtgttcacaaccagtctccctgaaactttcatcatgttacagacaaattctgcctctctggttttccagaaaatcactaatactgaattattattgttgctagggaagtacgggttggcctagcttgctttctgagcatcaacacaaaagtttgggtcatattttctttctggcagatgagaattgtgaatatatccaactacaactggaaaatattttaaacgaaagttaaactcttgcccccaaaggtattttgcaaactgcttatagaaactaggtttaggcagggaatcctttacccattgcttgtttttgttgggtttgttgaaggattccctattcagtaaatggtgctaggataactggctagtcaatatgcagaagattgcaactggaccctttcctttcaccatatacaaaaattaacttgggatggattaaagacttaaatgtaaaaccgaacactgtaaaaaccgtggaggacaactgaagcaataccattcagaacataggcatgggcaaagatttcatgacaaagacaaaaccaattgcaacaaaagcaaaaattgacaaatgggatctaattaaactaatgagctgcacagcaaaagaaactatcaacacagtaaacagcctacagaataggagaaaatttttgcaatatatgcatctgacaaagttctaatattcagcatctataaggaacttaaacacatttacaagataagaagcaacgctattaaaaagtgggcaaaggatatgaacagacacttttcaaaagaaggcataaatgtggccaacaatcctatgaaaaaagctcaacatcactgatgattagagaaatgcaaatcaaaaccacaatgagataccatctcatactagtcagaatggctactattaaaaagtaaaaaaataacagatgctggcgaggttgtggagaaaaaggaatgcttatacactgctggtgggagtgtaaattagttgaaccactgtggaagacagtggggtgattcaaagacctaaagacagaattaccatctaaccccagcaatcccattactcggtatatacccaaaggagtataagtctttcttttataaagatacatgcacatccctgttcattgcagcaccattcacaatagcaaagacatggaatcaacctaaacgactgtcaatgatagactggataaagaaaatgtggtacatacacaccatggaatactctgcagtcataaaagagaatgagatcatgtcctttgcaggaacatggatagagctggagaccattatccttagcaaactcacacaggaacagaaaaccaaataccatcatgttctcacttataagtgggagccaaattatgggaactcatggacacaaagaagggaacaacagacactggggcctacctgagggtgagcagtgggaggagggagaggatcaggaaaaataactaatgagtactaggcttaatacctgggtgatgaaataatctgtatagctaaacccccgtgacacaagtttacccatgtaacaaacttgcacatgtaccccaaacctaaaataaaagttaaagaacctaggattagtactcacagtctctagattcccgctgctgatgcaatgagtcaggtttctgcatttcatgatttataagagagctcaaagacagatacagttttcatatcatatcagagtgttactctagatatttcagcaagtcctcaaggaggtgtgttgaatctggcttctaatgttttaatatattgtcaataaatgatattgtcagaatgtgtcaaaatgctgagaaagtaaacatgaaaggtgatatgaagattatccacaggcttgaaggtcacaaagtgtgatatgaatcccagaccagctccagacactccaaggcatgagctcagcaaatatattgttgttctgctgcaatggcaatattttaatcttctaatttatgattgaattgtaaatatattactttttctcatgtagctgaaagtgtatggtgaaagataggtatagtgttatggaagtaatcaaatatttaggtttttgttcagggttctttagctgaaattagttattcagagttacaagtttaaaaaatgtgaaatagttcattttctttgagctattctgttttggtgctccctggggagagccggatgcaggagagtcaatggatcttgattgtctagtttgcctttcctcatcaagaaatagccttttttacagaaaatgtttaaaatcctactgtgtattttactctccttatgaggttatcatttctaatttatataaagatatagtagatgctgcttatataaatgttcattgactgaatctaaaaccaatctaaaaataaagttattttttaaaaagttcattgaataagaaagttgaatgattgggccaggtgcagtgactcacacctgtaatccccttgaaagcaggctgaggcaggaagatcacttgaggccagaagtttgagaccagcctgggtaacatagtgagaccccatatctacaaaggaattttaaaaattaaccaggtgtggtggtgggtgcttatagtcccagctacttgggaggctgaggcaagaggattgcataggcccaggagttcaaggttgcagtgaaccatgatcgtgccattgcactccagcctgggcaacagagtgtgactctgtcttaggaaaaaaaaaaaaaaaaaagaaaagaaagttgaatggtcaagaagaaaattaacaatatatttgcaaagattccttccaattaattaattaaatgtttctatgcaatatttttataatgcagaaagttgattttttcattttatttaaaaagacttcttacagagttttagatcacactctattagtataatttccctgtctatatgtacatacatgtaacttttaacttaataactgctttataataaaaaatgaaaggttggctattaccatatataattggagcaatgtggttacattatttttatgaaaatacaagtttttaaaactttgtgaagaaaagataagagtggcaaaagctctgtttcttagtctgagttttcccaaaggcaggatctgggtgaaagcagtttatttgggaggtgctctcaggaaggagtaatgaagaaaaagggataatgaaatggggaaggaggggaagtaaagctgtatcttggaagttgtaattgtggaaaaagggatgattcaagttccaccaggactgctggaaaatgtgtagaatgtctatcgagatgatctacccatgttttagttctctattgctgcataacaaaccacctccaaacttagtggcatgattctgtgggtcaggaattagatcacagctcagctgggtagttctttggctctgcatggcattggctgggctcgctcacttggctgcttccagctggtgtctgggatgcctggaaagttcaaggtgtcttcattcacatgtgtggtgcctcagtgatcctccatgtggcccttctctctccaactgactagtttgggcttcttcactgaatgttggtctaatggtatttgatcagagtgagtcacagggccagcccagattctagggcaagggaaaaagagtctaccccttgatggaagaagtgacaaagaatttgtggtcttctttaatctgccacgagctaaaggaagggaagctggagaatgtctctgttggtttccatcttccattttttaagattgcttctggggttttaacttccacatgcttcttacatatgatgaggtgtgcactagagatgaatcactagcagcacacaacgtcagtccgagcttgcacagaactgcccagcacagttgtagcagaactcaaaaactttagcacaggctcatgggaagtagcatttagaatcagtcacccacaatcttagctactcaaaaacataactgaaggacaatatgatcttagacaagcctaggatcaaatctcagtgccactatttattaggtgtgaatttcagttttctcagttgtttaaggggagtataacagtatgtactttgtaggagcttgtgaaatgaattggttgagggtacacaagctataaggggtcatgtagaagtatttattgtttattactttaattcgttctcaaatgttataggaaggtgtacatcaattttataatgcttcagcgggaagaggaaaggcaacaatactatggtaaatgtaaagagcaattgtaagatgcaactttaggttttttaaactgtagggaaaataagtagtagttgaagaattatgatacaatgtagtttatcctctacattcatgggaactaagaaacaaactttggcaacaggtttattactggggcaatcttggtaatgtttttaattaatactttaacaaaacttataattgatacataacagttgtacatatttatggggtacagtgtgatatttcaatgcatgtatacattgtataatgatcaaatcagggtaattactctgtctaccactgtagacatttattatttgtggagataacattctataccttctagctatcttgaaatgtacactttattgttattaggtatagttaccctactgtacaatagaacatcagaacttatttttcctgtctaactgtaactttgaaatacttttaactgaaatatagaacttacttggatttttatcagtttttccgctaatatccttttcctgcttcaggacctgattgatgcagaatctcacattacatcaggttggcaaggcttcttggtctcctccaatctgtctttatttatttttcgtgagcttgccacttttgaaaagtattggtcaggtattttgtagaatgtccctcggtttcagtttgtctgattttgcatgattagaatgggatacttggaagaatacataaaacatcatttgaacaccaagtgtcactgtttatctatgttagtaaaatacaatgtttcttttattgatgatgcttttcacccaatcagcccacattctcctgtcctgtctgcctggtagcatggccatatgcgtgttgataagatgcaatactgaaggctgtgctgagggactgaagaaagccaccttataacagtgacctcattagcagccaactgacttcattggcccttcagctggattctctttctctgtaatttggattcgcctgcccttttttttccattacatgggaagctctctggcaggctattgctttgtctgtccttattgccgcctcggggcatcaacagcatgtctttgggtgctgcatttgttaatgtgggaggctaagagaaatccaagatgaaaatactccttgtcattcccctgtcagaagggggaggaagagctaagctttgagtacatattcatttacatcagcagcattcttctgtgctcattggttgcttacttctctcttattaacagtgctagaataaacacacaaatctaccaaaatattagcagtgtgtgctgttttctttcacttgccaggattgttttataataaataccattggaaaaaataccactggcaagcatcctcagcaattacgttaacatctctagagaacaaagtatggtatcggaaggtgctttgcaaagaggagcagaacgtgtctggtttatactgcattccttgaatatactgatcttgttacctatgagtttgattttaacttaggtatttctcttgattgacaaaaattgatgccatcattttgtatgatattcactaattaaatatattttggaagacaaatataaaggttcctttaaaatgaagtgacactaaaacagatgttcataatgtgctttcatggtaggaatttgtagattaaatcagatattcatgtttgtcaaaatattttagtcaaatggaagaaatgagttttctcaacaattttgtttgtttggcttatgtcatgtcttagtttatttcaactatcatttctatcctttagaggtaaaaattgttatttctctccccagttgaaccctagttccatatttctgtttgcaaacaaaatgtttctacttgttgattccaccatcacttcaaactctaaatatttaaaataattaccaaccctttcccccaacaaaggaaaagtaaatacatgaatatacaaaccgcaaccagttctttctctaaaccttcctgttttcttctgtgataaccatttttgtaaccttggaatcttgaacacatttcttattgttcctcagcgtttatattctgtattgaaatgacccccaagacttgtctcctgttctaggcaatgttcctatttagccttttctctctgttccaccgggcatggcccttgtctctcatgctgggtgatatggtttggctctgtgtctccatttacatctcattttgatttttaatcctcatgtgtcgagggagggagagacctgtaatacccatgggtattacatggagagaggtggttggatcatggaggtgatttcccctatgctgttctcatgttagcgagtgagttttcaagagacctgatggttttataagtgtgtggaagttcctccttcgcttttctctttcctgccaccatgcaaagaaggtccttgcttcccctttgccttccaccatgattgttagtttcctgaggcctcccagccatgtggaactgtgagtcaaacctcacagcaatgtgaaaacagtttaatacactggaccttctaactactttcctggatgatgggttaaccttgttttaatccatgctttcctcttccttaagcattaataacatcatttaataataattaacaacatcatttaatttcgttatgaagtccctgttacaatcaagacaaaatctcatctgtcatatagacccttcctaccatcatcagccccttgcccatccttttctagtaggtcttctttgttcctactcctctccttctcctctttcctaattccaagcttcttctttgcagtcttcaacaaccttattcaaatttcacagtcatctctttggctctaaaagccaacgagggagagcacccaaggactttatttgaaagtttagagacaaataactttatttgaaactttatttgaaagtttagagacaaataaaatacgtatgtttgtctaatttctgagacaatgacttaaaataaaaccattttccatgtaaactgtgatagcatctttggggttgggcaatcatgaattgctgagaaccttggtagccacttcatattgttgaattatagtttctcttttttagaaatgaagtaacgtttcccccagaagctactgtggatgagatgtttggagcattgagtagtccatattaatataagggatagcaaaaaaaatgattttttttcttttggagtataattctatggattttagtacatgcataaatttgtgtagccactgccacaatcagaatacagaacagtttcagtgtccccaaaaaactgtcttgaatgattgctttatcattcctaacctgcccctactggcaaccactgatctgttctccatcactatagtcttgtctgtttaagaatttcatagaaattgaattgtacagtatttagccttttgagactggcttcttttgctcaatataatgtctttgtgatttgtccaacttgttgcattatcaatagtttgttcttttttattgctgagtagtaagttccatgatatggatgtccaagtttgtttttccattcacccgtcaaagtaaatttggcttgttttcaatttgagggcaattagtatggctataaatgtttatttacaagtttttatgtagatacaagttttaatttctctagagtaaattccaggagtaggattgctgtgtcatatagtgagtgtatggttaactttatgagaaactatcaaactattttccagggtggttgtaccattttcattcccatcaacaatatatgagagtttcagttgctctgcatccttaccagcacttggtattattagtagtttctatttttttcactttaataggtggtatctttaatgagtggtatcttgtcatggttctgcttggaatttccctaacagttgatgatgctgaccatattttcatgtacttattggccatccttatatcctctttggtgaagggtctgttcaagacctttgcccattttttaaaaatcaggtagatttaatttttgtaagaaaattcttcctagatttctctaggtaagaacataatgaaggcatctattttctagcaagggtggctagaagcagaagtttttagcttttacaggcagcagtggcagcaaagttgagtttctgatgagagtggcatccatctggtaacagtgtggttgtagtaacatttaggtttgggaggcaacataaattatagcatctggagcttgaagatggccaaattcagttaaattaccagatcagctccattatgtggttttgaaaatttttctcggaagcttggttctgggcctctccatgatccccttagctagctgcccaatatcttcacaactccatttttcattaggtggagttagcttctaagaacctaaagtacaacattgaattacctactgcaccagttatctatgaccacgataaagttgtataacagacaaccacaacacttggtttcatgcaacaatggatagttaattttgcacatggatctgtaggtttgtgtagtctggttgatgtggaaagagtgtggcggatctctactgggtttgctcatgcatatgcggtcagctagcatgttgttggggataattcatgctgatccctatggcctcattctccagcaggctagctcagatttgtactcatggtggaagcagagttgtaagagaggaagaagatgctccaagcctcttgaggcataggctagaaactatgcactgtcacttgtgctatcttctattggtcaggctacatggcagcccaaattcaagggattgggccatagactctatctattaatggaaatttcttccacaatgtaagggattgattctgtaatcaatctcctttatatataaatggtttggaattttgaaatgagtgcagtataaaaagagaacccagaaaaatacatcaaaatattataatatctctgagtgaatttaaatcctcttttgcatttttgtactttaggttttctaaaataaacagatattacttggtgtaagttaaacaatagttgtaaaaaatttataaagtgttttggaaacaaagaagagggagtgattaattctggcgttagaaaggtgctaacattttttcccaaattgcaagaattgtaaatagtagtccttcagggagtaaacttgtccagaatttttttggcataaaatattaaatacactatttgtagatgggaacctctgacttttaccaaacctttggatattttagacttatttttttacaatagctttgtgctaagaagaaagactgtagaagggaagacaaggctctggtgttatcctcttaaatttggaagactggaatcatgcaggggaaaggactctatagtatgaacttttgtgtgtgtttgatgttgagtagacagcttggtggtggatctatggatggggcaatggctatagaaaacagcttttcttcctcaatgccttctgacaaatctcaaatgagttgttcacaaaaacaaaagcagggaaatgctacaggagaacccatattaagtagatttcagttatacccattatttcctttattgttttaaaaaaaacagctttattgagatttaattcacctaacatataattcacccatttaattttaggacatttttatcacccccaagaagaaaccttgtgcccattaagcagtcattctccactgttccttgccctcagtttctgtctaatctactttctatctctgtggatcttccagttgtggatatttcataaaatggaattatacaatatgtgaccttttgtgtctagtttattttacttagcaaaatgttttcaagattcatccatgttcatgttatagtatgtatctgaacttcattcctttgtatgactgaatgatattccattgtgtggatagaccacatcttattgatccattcatcagttaatggatagttaggttgtttccactttttggttattatgaataatactgctatgaacattcttgtgcaagtctttgtgtagatacatgttttcagttctcttgggtatatatgtagcattggaatttctgagtccattgaggcttaaacaaatttattgcttaggcacgtttggcaaatatgatagttgatttttctaggaatatatattttttggcctaaacacagtgaatataggacatgttatgagtaatcattctaggagagttcctcaaaagcagagctgtagatacgtttaagtgatggcacccaagttggaataggtctccagcatctgtagctaagtattttgaagtgattgtgcaaattctgtggattgtttccaagatgtactacatctattaaaaattaaatcttatagttaatattcaatatatgatgtattgcatatacttggtatcagcatgcattcaaacgtgaattgaaaaagagaaaatggatccgtacttatggtctgaaagaagtaaaagaaagggtaaaatcggtctgtcaagcaatgtagaaaaactctggatgtttgctatctttttaaatggtatttttttttccatggggagaaaacacatgatgagaaaagaagagaaagcaagtgatgatgatatgattgataattaaatgcagctgagcagaaacaacgtggacacgcttagaatttgctttagtactttctatgcttccttcccgggaggctgttaaaactcttcagcataagagcatttaaacaaagagaatattgccttttttccttctactgcatctattcaaacatgcagaatgtatgtcttggtgaaatgctccaaagatagcttgtggaaatatttataatgcgtgtaccagcatttttcacataatttaaatacatgcttttaaactgtttattcttctctgaagttttgcaatatctatatgaccaaatttattgcatcatctgctaacttgaccgagctgttaatgtgtgatgcgaccttcttcaggttgaaagtgacagtttagcatatcacaaagaaaaggttatccttaaatgttgagactttgagatactagccaccgttgtcaatatgccaagtcccaggctacttgctgctcatacttaaggacaagataagtgtctttggaaaacattttctcccatttgggccatctttttggaaccagaaattgctctgcttctatgcaagggaagagaattttgctctctccattccctgtatcattttggcaaatccttgttactgttaattcagggggactgccaatttgaaggatgtggtgaatgtcaaagtaagaggccatatttgccccatgtttctcctgaggcagaatataatttttacattgtgatcctttgtgaaatcagataactaaggaccactggttccaaagacaagtcttctccctatatttttttcccacttactagtccagaaaaaaaaaatgggttactcaatctctgtgccagcaagtatttgttaaacacccatgcccctgtcacttacacaggcttgtgatgtaaaactgccttaaccttcatacagcttaccattctaggtaggtaggacacagggaaatttacagaataacacatcaatattaaactgggataaaactatataaggatgcctgccaattccatatatatttagataagggagaatttgggatgactgagagttaacaaagaagacctcacagatgggggtactttgagctgcctctggaggtagacagaacagaatgtcaatatatgaattggagactcttctgggtgtttgaggttggggaagaaacaaacaatgcctccaggagagaagcagcctaaacagcaactccaaggaagatgggtatgaaattcaccgtgtgtgtgaaattatgacaggagtcccagttataggataaagcagcaaaaccagaaagcaagtgtttagacatttgagcaaacctcttattttcttatctgtgtttgccccgtcacataatttacagtagaaagttatttaaggcgaggcagcactgttcttcatcagacttgcatttatgtattcaattttggaaacactatgacttttggaagcaaagaaacagagttaggctgaacgcccaactccagtgtacgagaatttttcttcaactcactgaataaatgagtattttggggtttttgtaatgttcagatgggaggcaaaatgcagacacaagcctagaaaataatgcagatgccaagttgatgtgttcttgagcaatggacattgaatcaacaaatagcctgatgagagagcagtgagggtgaagtagggagtggaatattcatgtttcctttcccggggcactgttcttacatctcctttacattttgttagatttaaaactaaggaatcagaagctgataaaaaattactgtaagagaacacattgaataaaagagtggtgagaggattcattcctctattaacatcagcagtcatctaaacatgtactttttttctggcacaaaatcatagctgtagcatgaccttcttgcttactaaagatcacttaaaatttttaacaaaaaatggcttaagcttgaaaggaggcttttaaaatgttaagtatggttctgatctacttttaaaaatccaatggttaaggccaggggcattggggttagaagttggtggggggtcaggagcaggttggtgattatctttctctctctttctctctctttttctccatgtctctgtccctttcaatctctctttttctttcaatctttctcaatcccccatctctcttaatttatctatttctttttctctcacagatatatactgtaaagtatataacaaaaatgaagtcccatgataatttgttgctaaaccacagtgcagctgtctaatcaagaaggcatatttttttgtggcacatatacaccatggaatactctgcaaccataaaaaaggatgagttcacttcctttgcaggaacatggatgcagctggaaaccatcattctcagcaaactatcacaaggacagaaaaccaaacactgcatgttctcgctcataggtgagaattgaacaatgagacaacttggaaacagggaagggaacatcacataccggggcatgtcgggtggtggggggctgggggagggatagcattaggagatatacctaatgtaaatgacaagttgatgggtgcagcaaaccaacatgacacacgtatacctatgtaacaaacctgcacattgtgcacatgtaccctagaacttaaagtacaataaaaaaataaggcataattgtaaaataatttatactcttttcataatctgccccaatgtcccttgtttcagacttatgttttttcccttgtttcagacttatgttttttctcccttccattcctactgccttgtcactttcttaccctttcacattccttagactctgggtttaaattcctgatttttggcagtcagaaatcccttcaaatgaggctgtcaatccatgcttcttgtagcctccaattttcagattagctaaattataaactttcccatttacaagtgtggcattcctccgcagcctaatgtttatctaaaaatggtgttcattatccattaggtcttattcactctaatttataaatttagtagtttgaccacttttactagtgaatacacttatttaaaaatactttttacatttaatttttgtggatacatagtaggtgtatatatttatggggtacataagatgttttgacatgactttgtatttaatagtcttgggctatatataatttttcttttatctgctagaaattactatcttcttcctttgggttggggactaaaacttgcatttaatatggaggggtggtaataatttggccctgttttctctgtatgcttgttgactccttgttcttaggacacatactgggaagaattatttttgcaactgaaaacaagtagagattttaatagggggtatagaatgaatttcagatgacagtaatcactaaaagtgtctaaacagttcaaattagttgtgtgtcttgtggacaactcatctaaatacctgaagtttggttatttgcacatagaacctgaacactatttcaagcttcaggttttaacgtgtgctgacttgtaaacaactttcaaaaatttaaggcaggcaagttcacctcaggccactgaattttcattgcttctgtgtatatttttcagcgttacccttgttcttttttgactttgtcattttcttcagtccaactgaaaatgttagtcagaatttattttacattagagtatatattcctagatgctaaatccctgagaacaaccttttctacccacttttgtttcttctggtgatacctatttacattttgctttcaaagggtgcccaaccactggatgccatacttgtgttattagctatctctatctgcctaagcctctggtttgcttcctcttgggaattaaaaataagatttctcttgatttcattgaaaaatcatcattctttcagctttgaccatattgttttgataaaaacagctgatttgtattattgaacatctttctcatttttctttctccataaggagaaattcatcacgatttattacctgaacatttgtgaaaccaatttgagagaatcccaaaagaatcattttaattgaagccacctaattacttgtaattaagaagacttaaaatgccaaaaaaaaaaaatcaaaattacagctaacaaattcagaggataggataaaatcaattactgaaaaatccaattaggtttggggagaagctgaacagaattttatttaaacccagtaaaatgtctttgagcttttcacatggacccatttgagttcaaactctttattattaagagttaattttatctttgttttctggtagtgtagtaggtttgaataggagctcttgaataggagtgcaaataattaggttaatggtttttcttttcatacgttattagaggaataatacaggaggaatgaaaatgaaagcaaaatttagaataaaactttaaaaagtttatgaattgttaaagctaactgttggactcccagcagtggctgggaaaatggtaggattttatgccaaatattattattgttgccttttgccagagtttagtggaattgccctgaacatcaacttggccatttcaactctcttatgtttgaggtctgctgccagtagtcagaccatgataaaaacccatgacatgctaagtaatggatgctgggcaataaggatctttctaaaaatggctcttaaaaaaatcatcatcttgcaactgtaaatggcctgtttgttaatagattatttttctcctttcagtcaagattttctgcgtaagtttacagcctataagtttataaataaagtactacattgaagcaacatttttattagtaggtatttcaacttggatgttgtgagggccttttaatttcactttgcacaaagtgaaattgtagaaatattttaaacaaattgatcatggcctaaaattttctgcaacatatttggttgactgaagttattgttaaatttggcctgaccaaaatttgaatttcatattttatggttaccagtgtactctttgtaacaagttgtgcttctcttgtgatgacaagaattctgaaagatggttgatttagtacttcgagtttcacattatactgaaaaatgtggatgcccacctgagccttgatctgatgaccagggaaacagcagcactttttcaaaatcttaattgattttaaacaagcaaatcatttaattctgtgagccttacactctgtttcttaaaagaaaactggagaagaaaccctatctcaatccttgtccttgagaatcctagaaaatccacataacccttttccccaagtcattggagaccttttttcatcctacaaactctagataggcttgttaccgggaagctttaggagccttcctagtacctactgtagtatcttgctagctctacagtaaagaaagaaaataatatgaaaaagtgctctgatttatagcccatatctctaattggctattagtctgcgctgacagtaaaaatattaaaacaaattacccttttaagttaaattcacacccaatgaatgaacaaataatctgaatgaacaagcattctcttgttgatggtgatagtaattattatctgttgagcaggttgacttaatttagtgaacataaatggcctctacttagggtgttcatataatttgttgtcaaaattgtagcattttggaaagtgaaaagaggcgctattaataattacactaaaataacaggcataacctgaattgtccctgttaaccctcacctggaatgtattgttctccttccttccatgtgtagtcaagtgctacccacttttgacggcccagatgaagttttctctaagaaggctctttagagtactttgtttatattttacctgaattaaggcattgaggtgccagcatgtcagaaattaagatgttttatatatttcaaggaaacaattgttgctgttatttgacatgtatttgttctctcttaccaagtagaatgcaaccttcttgagcacaagggatatgtcctatccttctgtcttgctgaagcacttaggtatattgcaacgcccaaagtgaagagagaacacattcttgctgagttgctttaccttcatagtaacattcctctctatgtttgtgaataaaataatggatattggtgccaaaaatgctggttatttaaagagatttcttctgggtttataatcttatacagtagaaagggataagaatcaagccaaatatagttaattatggcctgagtacccatttagtcacccgatgtttgaaagtgtccactcagatttagacattttaacaacaaccagacctttactagcagtactttatcatagaaaggatcatttgagaatatcttaattgtagcattctgagcaaaattataattaaattttactaagtatttattaaaaatataaagtggatatttttctaattataaaagtaatatatgctcattttaaaaaaatctcatagaatacaaaaaaatgtagaaacaaaaccaaaaaccactcataatcctttattatagagataattacttggactatttgggtatgtttccttgaagtagtcttttgtgttatttatatactatacagtgatccttgccttctggcattcacagccttgtgtaatcccctccgtataacttgcttataaccaataagagatgacaactttgggaggacatcacttacatgatgaggtcacaaaagattgtgaagtttgacttgctagccggttctatcttgctggatttgatgaagtaagctgtcatactggagaggtccacatgacaaaaaactgagagtggcctctggctaacagccagcaaggaactgatttctcagtctcataactcttaaggaattgaatcctgccaatgaccatgtgggtgagcttgaatgtgaatccttctccagttgagcctccagatgaaacccccacttcagtgacaccttgatcatggctttgtgaaagtctgagcagaggactcagctaagctgtgcctggattcttgacccacaaaatctttgagattacaaatgtgtgtggtttaagctgctaagattgaagtactttattacatagcaataggtaactaatataattacagagtgtctcatttatagtttaatagcatttttacttaacattttcttattaaaaatctcctgtgtcattaaaaattactgaaaatatgatttttcttttccaggtggaaaagaatcacatagtaaggatatgccaaattttaattattcttatctaattggatatttagattatttctaattactggctactatgactaccactaaagtgaacatcctcatacatccatctttcactacaatgactacatatcttattatcccaacaaaattcattgccataagataaatgatccaaaaggtatgcataattttaaggatttaggaatattgctaaattaccttccagaaagttaggctattaaaatgcctctgagtatttcaatgtaccttggccagcactgaatggttaaacaaattagtcaacttgagaaagagtatctctttgtgattttaatttttattttattatgtcttcatatgattattagttaaagcttattaagaatttaaataaaaataattaccagcctgggcaacataggcagaccccatctctacaaaaaattaaagaaaaatcagctgggcatggtggtgcacacctgcagtcccaaacctttgggagcctgggagacagagtgagaccctgtctcaaaaaaaaaaaaaaaaatagccaagcacatggcttaaaccactcaatccataagtaaatatacacataggagaatgcttttcagtgaacatttatcaagtgctccttatttgttttacaaatattaacttatttgatcctcacaacaactctgagtcaggtaccactataaatgctgttttacagaaaataggcaaaaagcaacttactgagagcagcacagctagcacagagctgggagctggagacaggcatgcccttgactgatatgtaatagacacccccatttcaaacaaaaagccacatccattcaccaaattccaaaggaggcatcaattccttcattatagatcagaaaaatgaagctcaatgcatcttgtctagtgaatggttcaaggttgtgcagcttgtcagtactgtgatttagaactcaaatgctagtctgtccagacgccttccacttccacatttcctatgaggaataagcacacaaagcaggtgctcagtaaatataggttgattgaactccaacaggctacatgcaatatgaaagggtgatggaatgtcagtgaattggaaacagtgggtatagtggagtgatgctaaaaatgacccatcatggcaggtcacaggaggtctcccagtggctcagtccctcagaagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgtgaatgcgagcctcagcccagccatcctgtggccactcagtgccttggggagcggcttattcctggatacagaggcaatgcctttgtcttacaattcgtgggagtatgtgctttaataatggaatgcttcctttgtgatttaagagtgacttatagtaaatttttattaaggattcaatgtcctattgagaatatatatatgaatatatataatatttatattcataattgctttattagatcagggatcatgtttgtcttgtttatcattttattccatgttccaagtgcagtgcttggcatacattataaatatcaatatttgttaatgaatgaatgcataaatgaatgagtgaaaaatgaccacaaagagcacatgtagaaagattaaagacatatgttaaattgaaggatagaagttggtagtcagagaacatttgtaggtcaagcacttccaagtgatggcagatatctaagatggggtgaccacactcatgaattgcaaatacagaattctctggacctaagagaactgtggaactgtgaggtaattgtatgctctgatgttgaagccactaaaggtaatggcagatgaaggtggtggagatggaggaaagtaggcaggttccctcctttcctagctgtctcttggaatgaactaagtaattttgtatagatgtgtaaagatagtaaagatagaagatctgtaagactcgagctctagctcgtgtatacacacacacacacacacacacacacacacacacgtatctgaagcatggggatgatcatatgacagtaataataattaaacacttactgtaagcagatgaccaaaattagctgtggttggacattatggaatgattagtacacataattattttctgctaataacaagacaggaagtatttatacccacatgaaatatttaagcagggagaaaacaattccagttttgccaaacgtttcttatatccattttgtggaaaagactccgtactagggaaaaggagttgatctgttcattgctcacttgctttcacgtagcagatttttagcgacacttagatggtgagctctggaggaaatggctattattattctagttcacagcagtacctaaaattgtgaatggttagaatctcttcatgctctgatgacccaactagctgtagagtatcacagaaagaaatgttgtcttgctaccatttgcacgtatgcaaaatatgcagagaatatagctgttttaaaagaaagctttgtaaaaagaaactagtaagctttcaataagaaatcctttaaatcctcagcattacacaataatacaattccctctttacagattcacttatacctttactgaatcagaagatgatgttgggggaaaagttgcttttcaaatgtaaccataatagaattttccctgtatctttcaaataattgtctgtgaaatcactttgtgatgtctatttcagaagcttagccatgacagcacaatcataaatattttcctctatgtcaaccattttagatgacagacagatctatctagtacattttgttttcttctaaaatctcaaatactacccaagtcagctgtttttaaagctgtggcctaataaacaattggatattgaattgctttattgcaaataaaaatgcctcatctttgtttcaacttattctcaaattaccagtgacattcacttttatattacattgttaatgaaagtttacctgtgggtctaaaaatagagacaaaaagcagtgaattgactggaaaactaaccattagggatattaattttttggaaaccagtagttttattctgaatagtgtacactacctgaaggcttgaaggttgcatataccagtctctgaactccatagtggaaatgatgtctaccatagcaatcatcacttaatgagaaattactacttattacgccaggtactgagtgaattagattagtaattgcattttatctctcattaatctcatgtaaataatgttaattctccactttacagatgaggaaactgaggaccagagattagataatatgctcaaaatcacacaataagggcaaagctaagacttgaagccagatgtgggttcctaatcactttgacctaattactgggagaagcataataataaagacaatttattgtgacctgtgtattatgtattaatgactaaacagcatttttgcatgtttaaaaaaatctctgtaagtggtattatttgataggcattattctgcaacatattttctttactcagcatagttctaattatccattttaattgttatataatattccattttatgagtataatatcaattattttatctcttttcctattgatgaacagagtattcttcaaaattttcttggctattcttcaacacttcttcatttacataagttctatggtatgcttatctagttcctgattaatcatgttggaatattgtgtggaattgttttgcatttgtatattaatttaggaaaattggcacacatatgatattgagacttcatgtcatgaaatggtatatctctccatttactaaagtaatattatatgttattagcaatattttaaaactttttcaacataccctgtatgaattttcttgcatgtattcctaggaaccttaggattatcattgattttttttgtatggtatgtttactttctaatttgttattactctgatatagcaagggcattgattgaatgttgatcttgattaaacaaccttgctgaattatctaacttgttctaatagtttttctatgaatttctgagattttctttggaatatcatcatatttttgccagtatgggctgttttatctctttctttccaattcttagacatcttaactcctttatttttgttttgttttatttacattgattgtggccttcagaaaagtttggagggaaagtggtgatctaacatcttgtcttagattttaaaataatgtctatcaagttaaaaattgggagttctttaatttttgttaagagtttttaaaataatgagtaatgaattttatggattttttggtaaatacaatgagatgcagatataggttttcatgtgtaagttactaatgtggtgttttcatttttagatttgcttttccattgaaccatccttgcattcctgatgtacattttatgatgcattaagaaatacctgctatattttcttccagactttaacatctgtgttcattgtcaggtagttcctcatattttaattttttatacagtccttatcaaattagtataaagaacattttagcttctttcagagaattgggtaatttttttccattttctgaaatagtctgtacagatcataaaaccctgtgagcctggatatcattttcaaggcagacttcaaattgacaattgaatttctctgatggttatttatttgttctggttttatgttttctcttgagtagtttttgtaatttatatgtttcttgaaaattatccattttatccaagttttgaaatttattatattacattcatattattctgatttaagattttattgtatttgtattttttgaattcttaatattgtgtatatgtatattttattttggcatatctgacttacaggttgccattttactagtttgtcagtaaaaaaactagcttttgcttttacatatattttattacatcttgttttatatttcatcaatttttgcttttctcttattctgttttttcatggtattttattttatttatttgtgaaaatgtgttgagaatatattatagaccaggcactgtttagagatttggcatacacttagtacaaaatttcagtagttattggaaacttaatgactcttttgtaatttttttcatttttcattttcatggatacatcacagttgtatatatttacggggtacatgtgatattttgttacaagcatacaatgtgtaatgatcaaatctgggtaattgggatatccatcacctcaaacatttgtcatttatttgtgttgggaacatttcaaatcttctcttttacctattttgaaatatataacaaattactgttaactatatttgtcctattacagaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatggatattcagttttcctagcatcatttgtggaaaagactgtcctttccccattgtatgtttttgtacctttgtgtaaagtgagtaggctataaagtgtggatttatttcagggctctctattttgttccattggtctgtgtctatttttatgccagtaccatgccgcttggttgctatagctttgcaatatattttgaagtcaagtagtgtgatgcctctagatttatactttttggtcaggattgctttggctattctgttttctattgtggttgcatacaaattttaggatttcctatttctgtgaagaatgtcattggtattttgatagggattgcattgaatccgtaaatcactttgggtaagatggatatttttacaatattaattattgcaatttatgaacataggatatctttccaatattttatgtcttttatgtcctcttcaattttttttttttttttttttgagaccgagtctcactccgtcgcccaggctggagtgcagtggcgcgatctcggctcactgcaagctccgcctcccgggttcacgccattctcctgcctcagcctcctgagtagctgggactacaggtgcccgccgccatgcccggctaatatttgtattttttttttttagtagagacggggtttcacccgtgttggccaggatggtctcgatctcctgacctcatgatccacctacctcagcctcccaaagtgcttgggattacaggcatcctcttcagttttttaaaatcagtgtttcatagtttttattgcacagatcttttgctttttggttaagtttattcctaggtattttttggtagctattataaatagctttcttgatttcttttttgagattgtttgctgttggcatctagaaatgctactaatttttgtatgtggattttgtatactacaactttactgaatctgtttatcaactctaacatttttttggcagagtctttaggatttttttaaagagtctttaggttttcctaaatacatgattatattgtctgcaaacaaggacaatttgacttattcctttccaatttagatgtcctttatttattttcctcgtcttattgctctggctatgacatccagcactatgttgaataaaagtggtgaaagtgggcatccttctttttccagatctcatcttttgcaattttatcagcaaatggtaaaggtaacatagaacatggttctttgacttataaatattaagattttacttaggttgttgataattactatatttttgttccatggtctttattgaatatatactactaaaaacttggcatagagccattaaaaaaatacaaaatgttttcttggaaacagcaaaatttctaatccatatacacatttcaaggttaatattttatacttgtgactactagatcatttatgctaaatagtacagcttaaagataccataatgataaccttttagattaaccaacatctttgatctaggatcaaggaaatttgatttccctcaatcccttatttttcagattaagcagttaaagtaatcagtcatttttgtgacacagcagggtccaggttacaatagttctccccattttttatggttctagacccttctcctacctatcttcccccaaccccctggtttggtaactatttctctgaacagtctttctgtttctttggtacatttttttccatgtataattgatttattctggtcatttacaattcctattaaattctctaaatgcttttccttgcccaaatttattattcatctcttcacttgaaagtagaattttctttcatagtgaaattaaaagcaatatattaaagtgggaagtatgaggtaaaatattagaacaactaaactcaagggcatttggcatttctgagagtgaagcagcttacataccacagcaatgtcacttgtttttcattgatgagacacacaaaattgtttcctttgtcctatgcctttcccttgaattcacatatctttttgctgaaatgaatcctttcatagttcttttaatgagtgcctgtgggtgttaaacagtcttaatgttttatattttgtaatatcattattttaacattgcatgatggtttctctgggagtagaattttatattggcagttatttttcctcatcactttaaaaggcattgcttcaggttcttctaccatttgttgttcatgatcagaaatctgtgtgtatgatagtaacttcttcacaggtcaaactgtattttgtctctgctaaattttaagactgatattttgcagtttgactaaaatgtgtctaggtgtaggacttatttgtatttatgtttctgaatactcatagggtactttcaactgaggattctcatttttttctgattctggaaaactcttggatattaatgttcaaataccgttcttcattaaaaaaaaatctctaaacataagttctaaattttaagtaagcctttgaagctagaggctctcaaaccatctgccctgattcttaaatgctcctttacaagttttgattactttttctctttttgctggcttctgggtaaattttttggtatcaaaatctaattcactaaaacacttaccagctgcctcaaatctaaagtttatcctatcttttgaatttttccttttaaaacaccattttttttcaaatcttatttatattcacctattcttatctcctttctgcctgattttgtgtcataatttgtttgatttttatacatgtgatttcatctatcttcctgagtattttaaacatgcttgttttgaagtctttgtcaagctattttataaaattaatttcaccacagtaaactcatattctggatattgatatattggctgtcttcttcagtgttatatttcttcacatgttttgggattttgattcacaggctaattttgagtgaattttttgtttgtgttcttctgtctcttgctctctgttcatgtatgtccgttctctctctctcacccactttctctctctgtatgagcttctttttgtggctggtatttttcagttgatgtccaccggggtccccaggacaaaaccacattttaggtgatggtttggagctcctgccctatagtaaaataatgcagagccagtctccaggccaggagcagcttgtttcagatctttgtctagacagaggctgtgttgacgtcttttaaatctgtaggtttttaggttttaacttcatataaaccaggttttctcagtagggcactgttgacattttggaccggatgattctttgttgtgtagagctgtcctttgcattgtagaatgtttagaaacatccccagcctctactcactaaatgcaactagtgccaacttccctccagttatgaccaccaaaaatgtctccagacattggccaaatgtcctctggggaagaaagtcactgactcccccttgataaccggtggtaaaacctgtaaaccctggagtcaattggcaatgtctgatgttagcttcctttatcaaggaaagggtgccaaatccagtccagctttaagcctaaagcctggcttcagcctttcatagtaagtagaggactttgtcgtctcccattggaaagagatttctctgtctcactgcctgatttggggctcagcacccatcaggctttggcttcaaccacactcactattactggtcctgaggatgtatatcttaatttatattctggcattgtcttttcagtattcttttgttatatttcacttatcacaattgcatgtttcgagcaatggggacaccatatagcatgaacttaaaattctttcttaaccagaagtcatagaaggaagtttttcaaaaaaagtttgtttttttaattgcacttcttggtagttcaacattttagatgccttattaccttatgccctgacttgattatgcttttgcttcttctttatttgtgattaacaaaagcctccataaacctgctttatttgtagtcaaattctatatttggagtattgatcagactaataaaaattagatatttttgaatgatttctacagatatctctatgactttgtgtatgacctcattggaattgagcacaggcattgcatttgggaaattaagacaattaggagattgtcctacaaagtcagagcaaaggaagcctgtagttagttataatacagagggacagtgaagactgtgagggagaggagggcagcaggaggcttagaccttgctggaaaatcctcaggaatgaagtgaaatgtagccaatttggaacctaccccagccctttccctccatgttaaagttagttaaatcaattccagtgcctatttatagttaagccttggttttgattaatgatgttggagagagataggaaagcggggaggacaactgttaggaggaagggaggaggcaaagctgctgaggctgatatgctcatctgttgtttgaaccctactctttgtcacacacagatttctggccaaatatgataaaaaaatatttttgttagagggcagtaatccatgtcaacattttcactgtatgccaagtgaagaaatcaaatacctaaaccctgaattaaccatatgataaatcatggttccctttttcattgagtcatccagcatgcatcatcatggacacaacctaagacttaaatgtctttagaagttatgcttttatacattaacaaaaatgaaattattaaaacaaacccacattaatggttaagcatagattgcttttgagctgcaaagagctttagagacacacaactggtccaacatttaatattgtctggagaaaaccaagatttgagagtcctaaggacttgcttaaagctgcacaatatcttggttgcagaacagggactagatcccttgtcttccctccaatccaaagatctggttacttctgcccaaaagataatcaattttaattttggtagctagccataaatacttttctggttgacttattctctgcttttaatgttggaaatagatgaaagtttatagttctcataaattagcttcagttactaaggagattagtgtattattaatccctcctattttttcaaaaaaacttttactaaaacccactttccttgaaaactgatattttctaaagatttagctctccagctatgcactcaaacagaggattgtgaatggggattgtctgcattaaaaaaaaaatcctttctttcttgttaatcatgaatttaaatattatagaaaggtagagggacatacagtgactatgctcctccttccacttaggtggctatgtaaaatgtcttttccttgatatatgtaattgttgtttactcacagtaattttatgtcagaatctcaacagcatgggttgggtaatgactatccatttgtttatctacaggaaaatggtattgtgtatgaagcaagttcattatataggacaattgaatttttatttcataactttatcttctttttctctttagtgatttctctttgtggccccatgcatattgtgcagattaattaatcatgcatgagctcggtacaatctacaatgattcactgggtaaagcagttttagggaatgcattgtattataaatgtggaaatgggatagacacctagaatatatcagctatcagtgaatgtccttaatcatagtcatatagatttctacttactaaaatgaagtcatatattttggtagaatccttcattttgaaggaaagctgacatgcaacgtaatttatctgtgtatgtgtataaagctgtattaatttcctgttgctgctgttacaaattactgcaaacttagtggcttggaacagcacaaatttgttatcttacagttctggagatcagatgtctaaaatggatttcactgggctaaagctaaggtgtttgcagtacttcgtttattctggagggtctagggaagaagttgttccactgtctattccagcttctattacagaagctgcctgcattccttagtttgtggccccttcctccattttcaaagccagcagtataacttcttctattttctctctgacaatgcttctgttatcacatttccttcttgctctcctgcctccctctttcccttataaatactcttgtgattattgtgaaaccctaagggagtaaaaagaaaaattagaaaaatgggcttacctggcagggaacagaaatannnnnnnnnnnnnnnnnnnnctgcagatagcagacagcctttctttctgctgtcttgcaatgtatctccccttctcctctaaataaatctgcctttctaaactcattactatcttggtaaattcctttaccaccagtgcactggcttcagataatcatcaaccatgacaattatattgagcctacctaggataatccaggattatccctcatttcaaggtccttaacttaatcacatcttcagagttgcttttgccatgtaaagtaacacaatcaaaggtttagtggaaatctttggcagggggttattttgcctatcacaaatgcgtatgaaattgggagactattttgaaatagcctgtactcatgctactttgcatgatgaatatgacacatactatttaaactatgtattttctatagcagcaatctctatagcaccaatggtcatagaaatataatgtaagctacaaatgcaagccacatctggaaattcaaatgttctagtagacatatttaaaacataggtgaaattcatgttaattatatattttatttaattcagtagatccaaaatattatatcaacatgcagtcaatataaaaatatcaatgagctattgatattctttgttttatactgtcttcaaaacccagaatgtattttacacctacagcatatctccatatggattagacacatttcatgtgctcaatagctgcatgtggttcatggctctaactttggaaagcacaactctgtagccaaggtttttatagctccacacccatttaagagttatattgtctactcaaaagaatgtgatatgatggctaagacattgaataagacccgggtttctcaacactggcagtattgacattctagaccaggtagtttttggttgtgggaagctgtcctttgtattgtgggatgtttagcaatatctctggcctctaccactagattccaggagcaaccctccagttgtgacaaccaaaaaagtctccaaatattgccaaatgtcccctgggtggcaaaattgtgcctagctgagaactactaggctaaacatagaaagtgtgttagtctgttttgtgttgctatgaaggaatgcttgaggcttggtagtttattaagaaaagaggttggctgggcggagttgctcacacctgtaatcctagcactttgcgaggctgaggtaggcagatcacttgaggtcagcagtttgaaactagcctggccaacatggtgaaaacccgtctgtactaaaaatacaaaaaaattagctgggcatggtggtgggcacctgtaatcccagctacttgggaggctgaggcagaagaattgcttgaactgggaggtagaggttgcagtgagctgagatcacaccattgcactccagcatgggcaacagaacaagtactccatctcaagtaaaaaaagaaaaagaaaaaagaggtttatttggctcatggttctgcaggctgtacaagaagcatggcactggcatctgcttggttactggcaagggcttttgtgctgtgccaaaacattttggagagggtcaaaggaggaatcagtcacttgggaagggggaccaaacccagggtatactagttataacaatccattcttgccagaaataatccattcccttgagaactaatctgctgtcactagagtgagaacagcaccaagccattcatgaggaacctgcccccatgtcccaggcacctctctctacgcttctcctccaacactgctacactgtgggccaaatttcaacatgagatttggcagggataaagaaactatatccaagccatagcagaagggttggttttgaattctgttctccatacattactgtgaccttgaaagaggagccactttaaattgttaacatagtttcatcctctttacaatgggaaaagtattatctaggctgcttgagcctcaaaagagacagtgtagataaaacagctctgtaaactgtagatactctgtaagacaaactcagcattgtctttatttgtttatgttcagcacttgaatgtaagtacagctatttcagtactgatgtattttctcataatatttaacttattttttaatgccctatttataatgattggactacagtgtagacaagatgttttaggtgttttgttttcctgtctgtgggtgctcatgggagtacagaaataagtagaactgggtcttttcaatgagttgatcaaatttgaaataactgggagttgttctgtggccttctcagctctgatagggtacacctgcctaaggaacttgcagagatattctgcaaattactttgtttgacccaacaattattgaacacccattcctgttaggaatagtgctagttcctgggagtagaaaaaagaatgagacaagattctatccctcagagtgcttgcaagagtagtaggagaaaaggcatagacattaatggaaagtatttggatggaagtggtgcttggaaaagagtcaggagaatgcaaagagaaggttgcaaaatgacgtttacaggaaggtcagagaaaggcctgagaaaggtgcagaatgaaaaagtgcatggactggtttgacattttgggaaatggagcatagcatgaaggaaagagagagaaaaggagaacataggagtatagcctccctaagaaaggtgggtccccttttgcaaaggccaattcttgggagaaggagtaagctaggagttcttagcaactgggaatgggtccaccagcagtaagggtctgtggcagcaccacagcatccactataggctctaatgtgtctccaccttttttttttcattattgccccctcaaggaagctttttaaaacattttttctctaatctccccagcctccacccatgaaatttacatagcacagatatcctatttatctgtttgtgttgtgtatttctgtgctttatacataaaaataatacgttttcttcgcctctcccagtaatcgatttttacccccttggtggcgatattgcctagttgagaatacatgtgctacgtttgtcactcatgagctgtgttattggctttggttcccttgactcaaaaatgttttaacagtcattctgtgtttcagggtgatatggtttagctctgtgtctacactgaaatctcatgttgaattgttaatccccagtgttagaggaggggcctggtggaaagcgattggatcatgggggcagatttcccccttgctgttctcatgacagtgagtgagttctcatgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctagtaatctaagctgattgaactagctaaaggacactctgtgaaagtgtgtgggaatgtctgtgggtctcaaaagtagagatggagccagatctcagaaaaggctgaaacctaaagttagaattatatatgcatcattccagaatctctcattgctttgtatttgctttattcatctttctctgttcactgtccttctcagattctcaatttccatggtggccaaaaggtagcctatcctcagaggttatatcaaatgagccctgttcctcacagagccgctaacagttcttcagctttgcagtctcaattcccagatgcaagagtgtgattgaccctcccttgggtcaggttaacgcttaagtttggtcacacataatggaacaaatatggctgctatgggccaacctttggaatagggatagagcgagtagattagtagatggaaggtcccagagaaaataatatcatattgttggcttctgaagctatctgctacaggcagtgatcactgatttttccagccagaataaaccattcaatttcaataaattatgggcattttagataatggaaaccttagtgtttaaacaatgttctttccttattctaagtttacagctagtaggcttagttggttggtacataaacaaggagtgataacttaagagtgagaatgtagaaggactagctggatcataatgccacttactgaaagaacactgaagaacactgaaagaacactggagttgtatcactagggatgctgagttattatagacctctcctctatgagaagtgttatttcttcccatcttagttcaggctgccatataagaaatgtctttgactgggtggcttataaacaatagaaatgtatttattatggttctggaggctggaagtgcaagatcagggtgtcagcatgtttgggatctggtgacggtctacttcctggttcacagatggacaactgtcttcttgctgtgccctcacgtggcagaaggggcagatgaactatctagggccttccaaaggctccacctcaaaataccaccacatcggggactgggttttaacatgtgaatttgaggggtacacaaacattccgtttatagtatctcccatcccaggtaacagctgtttagatcagaagtggatacctgacccaaatgacaacctggtttttctcttctgaaatttagaattgagattggaagaccttagtcagtttggacatctacagtgtgccagaagctagcagttgggtgtacagtatttaacaagagagaagttgctgctcacttaaaacatgcatttcagctttatgttcagctatgtgcaggcaaacagacacgtggaattatgatgattttcacttcctcctgaagccagctgtacatgtggcccttccaggtctgtgagattgagatcacattatcagtgatcacactaggaagattaagctaatttgaggtgaatttttattacttaaaaccaagaatgtgtgtgtatctttgtttatgaaatgtttttgataatttatttgattggttgattagtctccatctttttaaaaagaggttaaattctttgagggcttttttttttttgtacttttctgtccccagggtgtgccacccactatgcttggcatattatagtcactcagttgtcactgcatgttgtctggtgcccctgagcactcagtgatatggagtgagagaaagaatggttataacttgggggaactccaagaaaacttgatggagtgagtagccttgaaggatgaaaaacttttaagtggaaatgcaagggcaaggagtgagacaggctattgtaaagaggggatttactgcttgttggtttgaattgaaaaaaattcattgtgcgcttcctttggaaggttttttaagattttttttctcagctgcagagtgaatattaggcagggacatataaattattagatcttcactagatcccaactagtgattcattccttggaaagataagctttagcaactacatcttttgtcctaatggaaataatcctatttgttcctcatcatgcactaagtcaaggggaaagaatgctggataactttttctcattgttgtgttcagaaatgtagttacactccattttagcaagcacattatgccctagcttcttgccgtttttcttaagagtgtgtttcattccctacaaggtcttctattctcttgtaaagtgtcttttattatgggttcttagtaattgttcccttcattagttagaaaagttatgttttagagccctagctgtagaactctttcctctttatgctaagatggattatatgaaaacaatctgattaaaactaatgcatatttagaattaaaacacaaaaagttgcacacaaatgtttatagtagcaatacccataatagtcaaataatagaaacaactcaagtgtctgttgacttgtgaatggattaataaaatatggtacatccataaaatggaatataatatggcagtaaaaatgaagtactggtatatgctacaacatagatgaactttgaaaacattatacgaagtgaaagaagccaaacacaaaagaccacatattctatggtcccatttatatgaaatgcctaggacaggcaaatccataaagacagaaagtaggttagtagttgtcagggcctggggagaggttggaggaggggatggggcatgaatgctaatggacatagatgggatttctttgtgtggcgatgaaatattctaaaattaagtgtgatgatggtggcacaaccctgtgaaaatactaaaaacctctgaattttatcatatgtatcatatgtgaattatatcatatgtaaattacaccttcataaatctgtttacaaaataagacatttctgtgtgtgtatgtatgtatgtttctttgtgtatatatttacatatgtttatgatgtttcagatgttggcaagtgcagcaagcatcattaccatgggcacttcctccatatgaccgctggaggaatttagagtgcatataacaatccagggctctgccattggctgtgtgaatttggatgggtcatttcatctttctcagcctcagtttctcacctgaaaaatggggataagaaaccacctttgcacagtccctataagaattaaatgaaatggtgtatgtgagatgaggtgactcactcattaggcagagcaggcacagtgcctggggctcacagtacttcaagggcccatgaaaatgttttaatttcttttaaatgcagaagaaagaaagatgtccttttaggtccaataaaaagttttaatgtataatactaatgtatttgtctttacaccaatctggtcatacagcatattttgtatttttttttttttttttactggaggaagaggcccatgaaacaaaggtaactcaggcccatggaaggcatcatggacacttgaacgtggcagctcaatgacacaggctgggtttatcttattgctctgcaaattcaacagaaacctcctctaaaatcataccaacaatttagcaacagtgtaagcagtctgtgttgagcagctcacctgcacacgcctggaggcatacacctagaggagaggaggaacactgggttggccagcctgggttactggcaggttcttccatttagtagtgcccagcctcctctttcttctagggcatctttgccaccattgctcccatttgttgagtccctgttatgaaccagacacttcatatttcttatctctgatcctcacaatctcctgtaaaggtgagtagtgtcctgaatgtagcagatgctgttgatgccctttccacttttcttctgcctgatattccctgcagctttacagtgtgcagtttttggtatgctgataggttgccactgcaaggtcctgccattgtcttctttgccatagctgcctctcctgcttctcttccttcttaaactctgcctgagggcttcctctggcatcccaggagcttgctttattgtttatagcggcaacctgaaaatgtcaagcggggttaatgcctcagagaatagccctcaagtaatagtggacagaagtaagtagaaaaatgccatagctccctcctgtctagtgagtgattctgaggtgtgttccttctggtttctcagagagtgctttacaagattgagccccacctgtccatagcaggaacctattcatctatgtactttttgacttttttttcttcttctcacatttcacttcctcccttggacctcttgagatcacttcctatgtaaactccctgcatccccatacttctccagggtcttcttttggtggaacccaaatttaagataatgagtttgtaaatgtaaaaactaaggctagggagaagttggggaacttgtcccaggaccactgcccctaaccaatggagccaggtttgcaacctacatctatctagtcgcggggcattctgtctttcagccattgcagtaagtactattacaagccaggagttgcttttttagttatgacggaatctgccattcctggtgccccataggtggttagccatgccttaggtgggtgtattagtccgtttttacactgctgataaagacatacccaagactgggaagaaaaataggtttaattagacttacatttccacatggctggggaggcctcagaatcatggtgggaagtgaaaggcacttcctacatggcagcagcaagagcaaatgaggaagatgcaaaagcggaaccccctgataaaaccatcagatcttgtgagacttactaccatgagaacagtatgggggaaaccgcccccatgattcaaattatctcccacggggtccctcccacaacacgtgggaattacgggagtacaattcaagatgagatttgggtgggggcacagagccaaaccatatcagtgggcagagaccatacagctgaaaggacacagagtcatgatgtctcatagccagacttgtccagcttcaaagtctgggtttcttctccaaaagcctcatgcttcatggtggttatgatggtagtgatgatggtggcgatgatgataatattgatgatggtggtgacagatttttcggttgtcagagtttactaggcacctattttgagcctgaaaatgtgcaatgtaccataaccatgtcctcagatttaataatccaattttgcagaaaaaattatttttatattttgaacactaaaatgtaccagaaccatcattttctcattgatactattattccattacttaaatttatttgtacttgaaggaaaagtatcatttcagtcactgtgctcatataatcctgccatgtttgccgggttaccttagggttacttactctagagttgtagctgtgaattatcactttgtaaaactgaaatatatttatgcaatggtagtaagtgggagagtaatgaaaaccaggctttatctatttttgtccagtaaggacaaaacattcttaaataataatctgctgtatccacaagatataattgcatacagattgcagacttaattcttaaatcagcgtttttgaagaatatacccaaagaaaaaccaattatgattatttccccttatttttcattgaagcctgtagtatcagatgtgctgttaggcttttgcactggttcgctcaaagctttgttgaaagaagccagaagattacaaattatttgttgccccagctttttggctacaatcaaacataaatttaaagtagactgtaaggtcactgtcacaagctatacttttatacatggcataacttaacagtaaccaagccaacaataagaagttgattacattccttcacggctattttaaaaatacatacttacaaaagaagatggagattttaaaccctgaacataacctcagattctcagttactttgtctataattctgttagcttcatgaatttttcctctgagtaactccaacatcatctaacccatctctgaacactaaataatggtggaaataccttctcagtttgctttctattagggaaagaagtatggaatcaactattgtgctgtaatcaccaccagggatctgtccttttatatccattcatttctggatctggccttttcggggtacttcagaaacaaaatcctgcctctagagaagctccatcatttgtacattgtcactgttcaacatctctttggacctctgttgatatcattgcttgagatgacagactatgataagagaaacaaggttctctataaggcagcattgactgcaggaagaggtgagaattgtaagttgtcaaaatgcaaagggcaaaaaagtagtctgccaggaatatgttcatacagattattatatacacttactgtctgtaacagctaagcattcaaagattacaatgaagatgtttccaatatttttaatgggaactatgaattagttcatgagttggcaactgtaagaacaaaatcctacttaatcaaattaatactgactgaggcagaaggatttgagcatcttgttatgagaaattggaagaatgaaagaaataagaaaccgacttgagagaatgaagtattgaatgaagtggttttgtaacgtgggatttgtaatcagctacattttgagcaacatttatgttttgtgaagtggtcttcctaatgtatttaagcttttaaattacccctcatatataggtttcattcaaaagtgaaagtggtacctaaattaaacaatgtctaaactttctattgggttcagatgaagttttaagattttaaagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacatgttcccacccaggctcgcaaaggtccccagcagaactgaacctcagtggcccacaatgggaagctgtgctacgggctttcttcccttgccaatctcacttcacactcccctactggtgtttcctgggaacatcagcaaaataaactccatacactcatatgcttgcccactgggctcaatcctgccagaacactttgggcgatagtatagaacacctctcagagttatcccaactggggaccagggaggttgatgtatttgcccaccaacacttcatttgtcattggtaagggcttcttccaaggacattaactttctggtatttccacttagccctgcacaggaggtcttgctccttcagccagaagaaaagccctcaggcagagatttacaggtgttcccggcaggcaggcttcagcaaacaaggtggaggtcgagggtgaggcatcaataatatctgttccacaagtttaaattttataaaagactttgttattctgctgcaacgctgagattttccctatttgtttctgggcttggagcttatgaaatagaatgcgagagtgtttcttcccccatgttcaacgctgaaagcatctggtccttgacagtctggttaatctggtgtgttaccatccagatatactctgggattcttacatagtcaaaattacaactgtccttctgcatactgatactgttttcctttggcttaccttggattcccaggaattcatgtatgggcagcatgctgtgcctgtattctggtcaaatggcttttgagagtagtgcatggtatcttggctatcactgcagagccacccacctatgagagtttccagaaaaaagagcttccctagaacatagggtattatgtcactgaaagcccagacttattacaaattgccatctctgttccatttactctctgcattctttattttgcacaagtagaaacattcgttttgaaaccacacatttcattgttctgctgtgtttcctttttgtgtatgttcttaaggtgtgcaactttataatttgatatacatatacattgtgaagtaatcactacagtcaagtttatgatcatatccgcacctcacatagttaccggtttgtgtgtgtatggtaagaacacttaggatctatccccttagcaaatttcaagtatacactattgttacctgtagttaccatgctacccaccagagccccagaatttactgatctggcataactgaaacttgtacttcttgagcaacatctctccatttccctgttcccccagcccctgaaaactaccattcttctctcggcttctgtgagttcgactattttagattccacatataagtgatattatgtagtgtttgtcttatttcatttaccataatgtccaaaaacacatggagattcttcagaaatttgaaaatagatttttgagtattgttaccataaaaaattataagtgtttaaagtgatggctataaaactaacccaattcgatcattatattatgtatacatgcactaaaacatcacattgtgccccataaatgtctacaattattatggagcaattataaatttaaaaaataaaaaatagaactatcatataacccagagattccacttctaggtatttacccaaaggaattaaaatcaggatctcagagagatacctgcactcccatgttccttgcagtattattcacaatagccaagacatggaaacaaccttaattcccacagatggatgaagagatcaagaagatgaggtacacagacacacggtttattactcagtctgaaaataaatagctttatttatttatttatttatgtatttggagacagggtctcactctgttgcccaggctggagtgcagtatcatgatcacaacttactgtaaccttaaccccccaggctcaagcaattctcccatctaagcctcccaagtatctggaaacacatgcatgccccactatgctgggccactttaaaaatgtttttgtagagatggggtcttaccatgttgcccagactggtctcaaactcctgtgttcaagcaaccctcccacctcagcctcccagagtgctgggattacaggcgcgagccaccatgcctggccatggctgtgtttcttaaatggaaattatgtatttagaatataaaaatgtggtacatatacatcgtggaatactgtgcagccataaaaagtatgaagtcacgtcctttgcagcaacatggatggagctggaggccataattctaagtgaattaacataggaacagaaaactaaacactgcgtgttttcacttagaagttggagctaaatattgagcacatatggacataaacatgggaagaatagacactgtggactactagaatggggaggaaaggagggggtatggattgaaaaactacctattgggtactttgctcactgccagggcacaatatacccacatagcaagcctgcataggtaccaccatatctaaaataaaagttgaaatttaaaaagaaagaataataaaagtatgtatatgttttaaagaaagtggcactgtaagctggtattctttgtaggtttttgtcaacttaagggtcagtgtataaagcagctgaattcatcatcttcccatccccactcatcctcttccagagtttccatccctgtgaagggcaccaggtccactgattgctgaagccaggtacttgaatgtcagtttctgcccttctgtcctcccatgtgcccaccctacatccaatcagttatcaagtgatatgtcttccattttctaaacatctctccagttttcctctctccagtgtcccatgtgagatcacaccaagacctgtggcagtcttaggactggactctctgcctccaatttgacccatcagcaatgcactctctccttttgttatttgagtgattttttgaaaataaacatctaacatctacttccctgcaaaaatgttttgatggctccgcattgctcttagaatcaagtctaaactctgaattcacttctctactttttcatccttagccccaactctctatcctctcctcaattttttcacaaacaaaacacacttttagcttcttgaatatgtctcatggcccctcacttgtaagtccttactcacgctcttctctctgcctggaacattattgcttagtcttgattgcttgtgtttctcaagagccaagttcaagccctgacctgctgtcagtttctgattaaaaatgttgattttggctttgctttttatattaacagtgataaactctgtaattccttacggcttacagaatgatatttgcttctcccatggggattcaaagtaatttttaatgcaacatatttgacaaggaaaaaagggcagattcaatactctactatcactaccaatgaaaaaaggtggtagaacagatactaatcagctatattaaattggccataaacttcactcctactgagatatttctcagtggtcacagataagatggagacttagttaacacggatttttctagctgtgccatatttttttaaagctattaacatttttggctttgaacttttctttttctctttaggttgccaggaattggcagaccatttttgtctaattataacagtacttggaccttatgataaattcacagaaaatcactattttggaaatggatgcttaaaaatgcagcaacaaaaatgcatgcaattgaaattaatcacaaatatttctgagtaaatgttatgcttaaagccctgtattaagcctgtgaaaaacacagataagctcataatttaaatcaaagggtatagggtgaccaactatcccagtttgcctgggactgagtgggggaaggagtcctgagaaattgaattttcagtgagaaaaaacagaaggtcccaagaaaactggtacgagttgatcaccctagctacatatcaaaataatagcatgaattgttttatgaaaagtgccacacattagttttaacaaaaaataattacatgcttgggtcaggtggggaaagaagagatatcaagacactcacaagccaggaaaatggctatgatcaaagacaatgtgctttgaaacctttgagtatcaaagataagtatgagtcatgagaccagagaatttagaagaggccaaatttgaacaccttccaaattccaagcctgggggccagaccttattctctaaggacttgggtgctaattttggagaatttggggcaagttggaccaaaaattattataaaagcaatttttatggaggagtagtctaagttcttttttatttttaatatactttaagttctggggtacatgtgcagaacgtgcagttttgttacataggtatacacgttccatggtggtttgctgcacccatcaacccgtcacctacattaggtatttctcctaatgttatccctcccctactcccccaacccactgacaggtcttggtgtgtgatgttcccctccctatgtccatgtgttctcattgttcaactcccacttatgagtgacaacatgcgatgtttggttttctgttcttgtggtagtttgctgagagtgatggtttccactttatccacgtccctgcaaaggacatgaactcatcgtttttttatgactgcatagtattccatggtgtatatgtgccacattttctttatccagtctattattgatggacatttgggttggttccaagtctttgctattgtgaatagtgccacaataagcatatatgtgcatgtgtctttatagtagaatggtttataatcctttgggtacataccctgtaatgggattgctcggtgaaatggtgtttctagttctagatccttgaggaatcgtcacaccgtcttccacaatggttgaactaatttacattcccaccaacagtgtaaaagtgtccctatttctccacatcctttccagcatctgttgtttcctggcttttcaatgatcgccattctaactggtgtgagatggtatctcattgtgtttttgatttgcatttctctaatgaccagcgatgatgagcattttttcatatgtctgttggctgcataaatgtcttcttttgagaagagtctgttcatatcctttgcccactttttgatggttttttttccccttgtaaaattgtttaagttctttgtagatcctggatattagccctttgtcagatggatagactgcaaaaattttctcccattctgtaggttgcctgttgattctgatgatattttcttttgctgtgcagaagctcttcagtttaattagatcccatttgtcaattttggcttttgttgccattgcttttggtgttttagacatgaagtctttgctcatgcctatgtcctgaatggtattgcccaggttttcttctaggatttttatggtcctagatcttacgtttaagtatttgatccatcttgagttggtttttgtataaggtgtaaggaaggggtccagtttcagttttctgcatatggctagccagttttcccaataccatttattaaacagggaatcttttctttttgatccttcttttttttttttttttctcttgagacagagtctcaccctgtcacccaggctggagtgcaatggcacaatcttggctcactgccacctctgcctcctgggttcaagcgattctcctgtctcagcctcccgagttgctgggattataggcgtacgccaccatacccggctaattttttgtacctttggtagagatggggttttaccatgttggccaggctggtctcaaactcctgacctcgtgatctgcccgccttggcctcccaaagtgttgggattacaggtgtgagccactgcgcccgactgatcattcatttttaagagaatgaagaaatctccagaaagttgtgtttactaagaagactgcatcatctcaggctttgttttttattttgtaaacaagagcaagtgttcagaaccttcttaaacaactagcaacatgacaagcaatattgaaaactacaggtgtgccttattttatataaaactgctttgtgaaatacagatctttatgtatgaagcaattagaacagcatccccaacctttttggtaccgggaattggtttcgtggaagacagttttttcataggtggtgggtggtgggggtggtttcaggatgaaactgttccacctcaaatcatcaggcattagattctcataaggagtatgcaccttaaatcccttgaatgtgcagttcacaagagtccatggtcctacgagaatctaatgccactgatctgatagaaggcagagttcaggtggtaatgttcactcacgcaacgctcacctcctgctgtgaggcctggttcctaacaggccacataccagtactggtctgtgatgggggagctgatgacccctgaattagaaggttatttattgcatgagaaaggcatttttcttttctaaattaaatagcattttaaaatagtgttaaatatatttaaaatagcatttattatataatgtaagcattgatttacttagctgtgacttctctgctgaactgagacctgtagggtcaatagtggagtgatgaaaaattggaggaattgtattccaggtaagggaaatacatacaaaggccttgaggcaaagggagcatggaaaattttagaaagtaaaggaagctctgggtgactagagcatagagagtagggtggggctgagagaaataaagctgaagggggaatgggcctgggatatcatgaagggcatgtcaaattaattaaggacttccaacttcctcactgtttacagggggctttgaagggttttaagcagggaaccgtatgtcaaggccagggccaacttcatcagcatgtgatgaatgcccattgtttagagaggcccaatgtttgatttaatgctgtttccaccattttggaattttaaattttttgaccaagtggctctgcatttttattttgtgctggaccctgccagttacctagctgatcctggccaaggctctaggtcattgtgtgtagtgaattaatacctactgagaggaccatgtttttctgctcactgctttttttcctttaaatagactttattttttagagcagttttcagttcacagcaaaaattgagatgaaagtgcagagttcccatacatcccctgtccacccactgcaacagcttctcccattatcaagaggtttgcaccaaagtgatacctttgttacaactggtaaacctacactgacatatctttatcacccaaagtctatagttaacgttagggttcactcttggtgttgtacattctgtgaatttggaaaaatgtataacacgtgtccaccattatagtatcatacagaatagtttcattaccctaaaaatcctctatactccacctactcatcctccctaaagtctggtaaccaatgatcttttactgtcactatggtttggtcttttccagaatgttgtataactggaatcatatggcatgtagtctacttggataggcttcttttcaccgctttttcccctgctagtatcagataattgtgcaggccactctacgagagccaaaggtcgtatttctccttctcctggaataatcacaagaacaggaggttctgcaggagcaattgactttagaggattaggggacaaataaacactgaagttttattcttcaggatttttgtatttctagaatagttcaaagtatgtacagagttgacagatcttttcaactgactggtcattcgttgcaaattccaaagaaataaactgtttaggaaacaactaactgatgagttacattcaataccctttctttgattccagacactaaagttattttgcatgcccaaattttgtactcagagacattacttctggggtctgtctagaagtaaaggcacaaatatgctgtaatagaatgctgccaggtagtgagggtcatcttctggccagaaatttcaccagaggctcttcaaaccttgcttttcccaaatgcagcccctaccaccaacaggttcctctgagctaacaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcctggtgggaggtgattggatcatgggggcggtttctcatggtttaccacgacctcccttggagctgtcatcataatagtgagttctcacacaatctggttgtataaaagtgtgtagtaccttattcccacttcctgttgctctggacatataggctctgacaatataggcagaaggcttcacccttcgccttctgccatgattataggttccctgaggcctcctcagctatgcttcctgtacagcctgtggaaatgtgagccaactaagcctgttttctttataaactacccagtctcaggtatttctttatagaaatgtgagaatggactaatacaatgggagaaaatatttgcaaactatgcatttgacaaaggtctaatatccaacatctataaggaacttaaatttccaagaaaaaacaaaacaccattaaaaagtgggcaaaggacatgaacagaaacctttcaaaagaacacatacatgtggccaacaagcatatgaagaaaaagctcaacatcactgatctttagagaaatgcaaatcaaaaccacaattagatactatctcacaccagtcagaatggctattactaaaaagtcaaaaaataacaagcactgtcgaggttgtggagaaaaagaaacacttatacactgctggtgagaatgtacattagttcaactactgcagaaaacatggcacttcctcaaagacataaaaacagaactaccatttgatgtagcaatcccagtactggctatatacccaaaggaatacagattgttttattataaagacacacacacacatatgttcattgcagcactattcacaatagcaaagatgtggagtcaacctaaatgaccataaatgatagactggataaagaaaatgtggtacatatacactatggaatactatgtggccataaaagagagggagattatgtcctttgcaggaacgtggatggagctggaggccattatccttagcaaactaatgcaagagcagaaaaccaaatactgtatgttctcagttacaagtggaagctaaatgatgagaacacatggacacatagaggggaacaacaggcactgaggcctttctgagggtggagggtggagggtggggcttgtacaacaagcctccatgacactgatttccctatataatgaacttgcacatgtaaccttaacttaaaagttaaagaataaaatatttgttgagtttcatgttacacatctgtagttattatagtcataacactttagagctgcacagactcaaatgatcagcactgccagacgttctgacagcaaaattatctgaatagataagagacttaggtgggcttttgctcagtaaatgaggttgtttatattctttgaaacagtacggcaattcataatactccaacacacgactgcctgtgggcagaccctccctgttcaaggtactgtgtggggtatcacagaatgctgttcaggaagatatcactggggccttctactctcaaaggggttgataaacacttgagagcatgaggatgaatacccaagggattaggtatgctttgggctctgaagctggccacatcagtaaaatatcacatacttggcaaattagatctgagtaatcaaacagaataattcagcatctctcccccatagacttttagtggctgacattagttttcatttgatgataattactgatcacagtaatcctcacaactaacagtttttcacttctgtaactttcttatatagatctggcacatttcttagtagtttacagatttacttttcgtttgtttcttggttgtgtttgcttatctgggcgaaatatatttttcctatatgttctcaatttggttatttatgacttataggaaatcgattaacttgtaagtttgtcttgtatctagtgacattattgctttcatattagttccagtaaactttaaattgacaagttggatttgtagacagaaagtcatttatttgtttataataacactttggcatagtccttttccgtatttaaggctttaaagaaatcttttcttatatgttgctgaagacttctggtacaatgtcaattttaggcatctttgccttgctcctgagtttaatgagaccactttttaacttaagcaagataaatcagtttctttccatcttgacttattggtagttatatttttctttcaagctggaaagcctgtgaaattttgtaaaatatatcttagcattacttgagatgatcatgtttttttttcctccatctttaatataaatacatagagaattctgttaatagttttcctaaagttgaacctccttgaattcctgggataaagcctggttgatcatgatttattgttgtggagttttctatttgcttagctttgtaataattctccattaaaaaacacttattggctaagtgaaccaaaatatctaatgaaccatgaagttgtttgaaattatagcaaggaatataaatagactagttggctatgctgttccctttttaaaaataatttcattccatgctgacatgagcaataggatttgatcgtaacagagagatgacttcttggctgtgtaggccatatgtttcctgataaaatatctagtgtctaatatcgaatagcccttgtggcttattttgtgtgtttaaacaatctggtccagttctgctaagtgacaacaagcatcacctactgtcaaaactcttttctgagcctgcagaaattactacaactgtgggatgtacttgatttcaatgtgctgtattaatgtttgcccagtaatttctagttacagaggctatagcttgttcttccaccaaccatcctggagagcagttagtaaggtgtagcagttgagagtgtgaactatctggtttcacttcacagctctgccattaactggctgtgaaaaccttaaattcctcagttttattattttaaaaatgggactatttaaggtaactttgagctattgtgaatatttagtgactaaatataaagcacttaaaatgtatttggtgcatagtgttacatatgtgctagctatgatttattttttgtttcaatgtaattttttcctttttttaaatttaaaacttttatagctctattgaggtataattcacaaataaatattgcatatgtgtatatattgtatacaatgtgatgttttgacacatgtatacactctgaaatgattattacaatcaaactaattatcatgtctattacctcacagttatatttaatattaatatttaagattattctcttagcaattttcaagtatacaatacattattaactacaagctatgactttgaataatcaagttagaatgatcaatttgccaggagtttttgttacagatgtcagagtcctatgatcacacatgaaagatttgctttttttccttatatgtgacccatggaaacatatcccttgtagaatttgactagtcctttactcattcaaggaatttctgaaaataggcagatttgtttgactaatgtttttccaataaaaaagggctggctgtttttctcacaatattttacattttgaaaaattcaaagaaatgaaattgaagctgattatcagaatctgtcggggaaatcattaaacattggccagccctagtaaatagcaatggaagggtaatttacacctctcattgctctataggaggttcttctgttgcccctgtgttgaccggttcacagttagcaaaagtatcttgtagggggactccaaagacagagagattgtgtgcagcttctgctctcagactccctgggtcaaatctgagctttgccactggtcatcagcaagttgaccttgggtgtgtttctagtgctccagtttcctcatttgtaaaaatgtgataataataataattacctctcagggctgtggggagaattacaagagaaaacccctgtgtatgaccaacataggaccctgcacatacgaagtgctcaataagtaatgtgtcatttagtacaaagcatttgttatttggaagtttttttttgttgttctaaggtgtaagtcatcatatctccggctaggcagtatgccatacatgaaagtttgggagagtggggttcatttattttaaaaacagttcagtgtttttagtatagtcacagatatgtgcacccatcaccacaatcaattttagaacattttgatgaccccccaaaggaacctcatacccaataactctcatttcccccttcccccgtccatctagctggctgtaagcaaccactcatctactttctgtctctatagatttgcctattccggacatttcacacaaattaaattgtactatgtttagtcttttgtgactggcttctttcatgtagcttaatttttcaaggtttatccatgttgtaacaagtaccggtacttcatttctttgcatggcagaataatcttccagggtatggatagaccacactttgtttatccatttattcattgatggacatttgagttgtttctacctttcggctatagggaataatgctgcagtgaacattcatgtacacatttttgtatggatgtatgtttttatttttcttaagtatgtatctaaaagtggaattgttaggttatattccatttgaggaactgtcagactgttttccaaagctgctgcaccattttacatccccaccagcagtgtatgtttgaaggttccaatttctccacactttcaccaatacttcttattatgtttttgtttatagccatcctagtaggtatgaagtgatatttcattgtgattttaatttgcatgtccctgacaactagtgatgtagaccatctttttgtgtgtttactggccatttgtacatcttctttgggaaaatatctattcaaatctgttgcccatttttaattgggttgtattttcaattattaagttgtaacactggtaatttttattgagctattaatcgctgttcacacttgaccttgcacacaaatccctggggactttgttaaaaagcagtctctgcttcacttaggtcccttggggaacctaagagtgtacattttccagtagttgcagatggcgtagtccatggaccctacttgaagtaagaaagacactttttaaaatgcttcatgattggctttttatgtattactcagaaaagccatttgaagagagaaacacaaaacctacattttatttattctttcctatattcacttccacaaatggaagtattagagaaatgtaaaatataatatattctcactgttttaaagagagctaacattatattagtgtctgaaaataaagatatagttagaataatttaactttttttctcgaatacttgtattataatttaaagcatttagaagcagtatttgccaagtgactagatttactttcagtttttaaaatagttttggctacagatgtagctgtaagtttggactttctagtacttatttattatctttttcctttaaaaaacagtttgagacacagtctccttctaatgaaagattattcatcatcctctttggtcatgcttcgttgggaggcacttgcattgatgtaggacaggaagaaaggggagggaccctggctgaaccagccagatttgcagaattagtggccaacacgtgtctcatagatttatgtgcctacagtcttggcagcatcccaatataaaggtatattatttccagggacttaattcccctcacagtgtgaaagagcaatgaaaagcacaagtttggaaaagaaactgcaaatgaaaaaatcaatgtaatgaaatcaattgtgaacactagagtttgttcaaattagttttttgtttgtttgtttgtttagttttggtagctatcatcctcatagatacctcacctaccctataggacgtatgatttcactttcaaggggattttctggcctttaatgagtcatggcagcagttaacactagttgcagtggctggtggtataatttggaggcgcattctgttcttttgtgacattaaaatggaaaatatgagcccagaaaatgatttctctagggatgcacatacatggttacagctcattatggacctgtcaacatcttctcctctgcccttccttgggggagattttgtctcctgacgcagttttgaatgagagtttaacaagtgctgagtctcgtaccttttacagtaaaatatttgcccagatgaagtcatctccttcggaatttgaaatttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccattatgatttgattatcctgatagtacaaatagtttagcatctaataggtcaatcagtttaatggacttgagccctattcaacaggtgttaacattgctttttgggaaaatgcctgtttccttgctggctgttgacagcaggtctatctcagctttgagaggctgtgagcatttcttgtctcatggtccctcagtcttgaaagccagcaatggtatgtcagatccttgttatgcttccaatccctttgacttcttcctttataattttttatttttgagacagggtctctgtctcccaggctggagtacagtgatgcaatcacggctcactgcagcctcaacctcaaaggctcaagtgatccgctcacctaagcttccagagtagctgggaccacaggcatgcagcactatactcagctaattattattattattattattattattatttaatatacaaggtctccctaagttgcccaggctgatcttgaactctggggtcaaactgtcctgtgttggcctcccaaaatgctgaggttacaagtttacacctgaaaagccaccatgcccagcctttgacttcttccttttaaaggactaatgtgattagagcaggcccacccagattatctccccatgtaagggtaagtgatttgggaccttagttacattttcaaaatcccttcgtagcagtacctagattagtatttaatttagtaaccatgggatgggaatcttgggaggctatccttagaattctacctactatagttaagtgaattgcctgaattcacatgagtagagagtagtgagtgaagcaaggatttaaaccccagcctatctggcatcagagtctgtgccttttctacctatcaggtgacccctctatgaaaatcagtggtggacattaaccccaaaagaattttctagaaggaaagcccaaccctaattcttaacctagaggaatgtcttagttcatttgtgctgccattacaaaataccacagactgagtaatttatagagaacagaattttatttctcactgttctagaggctgggaagtccaagatcaagaccctagcagtgtcattttgctggtgagggctgctgtctacataaaaatgatgctgtctgcatcctccagataggaaggatgctgtgtcctcacatggcagaagggacagaagggcaaaagggggcctaagctggttacctctggcccttttacaaggcacaaatacacttattagggctgagccctcatgatttaaccatttctccaaaaggcccctacctcccaataccaccacaatagggattaactttcatcataaattttggaggggacaaaaatattcaaaccttagcaagccatataatttaaataattattacatttaaaattgtagatttagtgtttaaaaattatgcaccaaagtaatactgaatctttctgaaatgccaccaccaaagagatagtatgattgtgggctatgtaaacagatctggatcaagtctaagagccaccacttacttgccctgattccccatgcctcagtttctgtaccataagtgggggataataatagtggtatcttctggttgtgctgagagattgaaattataacacttaccatagttcctaggacactgtaagcactcaataatttctaaccacccccactactatcattatcatcatcatcacattattattattattgttatctccaaccttcagcctagatggttgatacctattaaacatattatcaaatatttatactttcatatcaataacatataaaataaattatgttcattcttcagatgagcagaagaggtatcatgccatgatctcatttttaacatgcatttgcttctgaaatctcagctgtagattagtaaatgtaatacttagtaattttttgatctgatgttttctctgcccttcctgtaatttagagtttgtacacttggttctaattctgtcagtgacttaaatagatataaatttaatgtcatagctcatgagaattaatgtcactttcaaagtcatcctctcaacctgcccttctcctttttcctcttgatccaagacccattattctaaggtttctaacacatttcttttcacttatactccagacttgagattgctgtaaacatgaaatttatttttagatctttttgctctgcattctactcagagcctttctctttttgcattttcacaacattcctaggcttctgctcagccaacattttaaatatgacaaaaataaatgccatggagggaagactctgtggcagcaacagaaatgcctgttgagtcctctgtggaatgaagcctgagaccccttgggtggtttaagcagaaatatttgagcgaagaagtgtgaaggacagaggtgtcagaaggaattttcaagagtgtttataaacagtatatgctacagagggtgcagggctactgagacctcaattaggatgggggggtgtggttaggagaggccactatggtgcagacatccacccatcccaatttctgtagaagtcagcgatggaaatgcgcagtggtccaataatgttcccattggtggtagagtcagagctttggttttttatcaccttacatggattttacacattattaagacataagctagaggagagaaatttcttattaacaaaacctgaaatcctactagcactgataccttctcccagcacctgcactagccacccatgacatcctctacagattagtgtgcctcctttgctttccatgttaaccttttagcatccataccattccccttatttaaaatagggcttctcaactgagacaccattgacatttggggccagacaattctttgtggtgggggctgtcctgtgcattgtgggatatttagtggcatctctgacttctacccactagatgctagaaacccctccccaagttgctacaaccaaaaatgtctccagacactgccacatgacccctagaagtcacgattgtctgcacttaagaacgactagtgtagaaccccctcttctgctctactagtccttccttgttttcctgtataactctgctcaaagctcacctgtacaaaacaattcattaattaatcccacctagctctgagctttttcatcactaagtaccttctgtcctgctgggcctagacatagattttaccaattatgtttttgccatagcctccatttgtaataaatcagtttttgttactccttctgtatgtaaggaaagagtaagtttatgacttcattttaaaaatatctccaaagttcctgctagcatattctgcataaaatggactcagtaacactttgatttagtgagcagaactacttttttttttttttttttgagatagtatctcactttgtcgcccaggctggagtgcagtggcgcaatctcagctcactgcaacctctacccttagcgttcaagagattctcgtgtcttggcctcccgagtagctgggattacaggtgcccgccatcatagccagctaatttttgtatttttagtagagacagggttttgccatgttggccaggctggtttcgaactcctgacctcaagtgatctgcccaccgctgggattataggcgtgagccactgcgtttggccagaactacagttttctattactaccagttgcattgcttgacttttatttatttagcaattttaccattgctgaattgcttcaggattgaagagaatgaatctttagaatctctattgaaataaggaattaaataattgtgatttcttttattctgctgagaacttccaatatactcatttggtgatgaatacattttttaagtgaatattcccaacatacttgggaccactgtagctttcagctatatggcatgtacctgggtatgctgacgccacactattttttgttggagattcagcagttattttgtgtgcagttgacagactttttttttccaggtcctccctgggatctaattttgtaatgctctcagtgttttctcatgtccccttagcatttactctatgcatggaaggctgcgtgtttggaacacctaaaactctgccacctgagggcatttcttctaacagtgggaattgcctgggtgttaatggccatgaaagcaattctcccagcatggtgactcatgccacctataattccagtgttttgggaggctgaggcaggataattgcttgggcccaggagctcgagaccagcgtgggcaacatggctagatcctgtatctacaataaaaacaacaacaataataataatctggatgtggtggtacatgcctgtagccccagctactcaggaggctgagaatggagggtcgcctcagtccaggaattcgaggctgcagtgagtcatgattgcagcactgcactccagactccagcctgggcgacagagcaagaccctgtcaaagaaagaaaagaaaagaaaacaagcagctggttggatggggatttggcaaaaaactgccccagcttcctagtccccctgtgaggacaactctgaggcaaatatatatatatattttttttttttttgagatggagtctccctctgtcacccaggctggagtgcagtggcgccatctcggctcactgcaagctccacctcccaggttcatgccattctcctgcctcagcctcccgagtagctgcgactacaggcgcctgacaccacgcccagctaatattttttgtatttttagtagagacggggtttctgaggcatattctgtactgtctctcagtattacctagtaggattgatcaaattgctcacagaagtaacttgtgtgataacacacctcggttggtttctttcccttctctgtctcaccttccaaataaactacttacactcaaatccttgtttcagactccacttgtaggagaacccaaaccaagaatccatgttataaatatgatgatttaacatgtttagagaaatcttgaactaattcacaaaggcttgttcatgaaatgctgttgatcggtgttgtcaccaaatgttctaaggtctacattctgggtgggccagactgcatcagggactgctgtgcactgatgtgtttgtctgtgatgatgtgggcattgttatttttactgggtttgttgtgagtaaagcttttggaaattatgttttcccacaagttccgcaaatgttttcacattttagaaattgtttgagcatgctgtaagccataactttgaaagtcaagcagtttggctggtgatattatttttaaagaaacaaaagtcttgttttgttttcaattttggcttttgttatgctttgcaatccttttttgctctcatggccttaacttactttgtcttgtacatggttttgcataatactcatggagatatttcatatacatttttgtgtggatatgattgcaataaattttttactggtaatacttcacattctaaagctcttttacatatatttcatttaatgctcacaaaccccctaaacaataggattataatcacagtttaatgatagagaaaaccaagttccagaagagtttaagtgagtttctgttcagcacttttattttgtcatgaattaacataaacattttattcatgtgatcagcaattctacaaagacaacaaagagtgagaatgtaatctccaagggaagcagagtgtgtattagcatagctgtagggcaggggaacttggggatgaatggatacagacctcagcaattgtcctaagtctggtcttctttcaggtttgttaattcaccacattctcatgtaatggaaagagtaaacattctctatatgctagcattattttacaaaatgaacaccagtgaaccagacatgaaagcagcattttcccagtgctttctcaccttccaggaaacctccttcactgttgctgtcagcctctggtggattatcagcaccatgaacactatagtccatattttctgcatcaccaaccaggacaccatgagtaccatgtgttggtttacacacaatctctatcgtacttgcactaaattcgtatctggggtgaagaggaagtgcatcactatctcaaatgtcaacactgaattttgaattttagtggatgctgtttctcccaggagctagaatattgcgtttgatagccagctctgaataggtccctccttgacaattgccatcccttatgttggactcagtctgatttcttgaacctttgcttgttatctgctgttggtacctgaactgcttctatggaggccagttaaccccctttggcccttccaccgacagtgcacctgagttatgactaagccattctgcgctggcaaggattcagttgggaaaacataaaacctttagatatttcaagaagaaagatttattacaggagtgagaggctttctaaagaattgaaaaggacttcaactagcattcaagaaattaggaagataataacagcaggcaggcaccattgatggtctcagatacctactgtacctggaagcatctagcaacacctcccatgggccactggcccaaggctgttcatctgcctgccatcaccatattggactttggcttctcttaggccttgtgaatatatctcatttgtgtgagctcaccctgaactgtatcgcaaggtgtctggaaaatgtaattaccaaacttctagctgctgggatccagagaagaacataaaggaatgaatatagttctgagtagcctactggtagttcaggccatattgtgtttctaggattttctgaaactgatctgtgagcctggggtgcccaaagaagaggatgttgttcctccaaaactgaaggtgctgagaaaaacatttctgatctggggcagggcaatagaatcagggagaaatagcaactggagatgtgatgaccctcaaaattaagattcagtgatagttgttgatgtgaaataggaaaagactagtacctatgcttcacacagagctaccaggaaaattgggcaactccctaaccgtatccttactatacatagtagagtagtactctgagatttccctactttctggtaaaatatgttgtgcactttaatcagctggctgagtgtcttctctactcctgtatgccaaggtcagagtctttggataagttttctccttcagagacaaaccttggaaaaagtctccaggaggcaatgagatttgtccaggaggttatccttgcataggaggtgctccatccagccagtcctgtagggcatgagacctggccaggagtagtagaacaacttttgggattgtttttagtggcatattctacttgtcatgtgattcataacatttgcttccagaagcctgtgcttttggcctagatacaagactgaaaggctgaggcatccatgaaattgacctaatgctgtataaaaatgttactacatgttacaagtcataaagtctggtttattcctcgtagaatgctagcaatcagttttcttttcatcatgatgtgaaatagtctttttatattcataattaggttttgttaagaaattttactgtgttcagatgaattaatattaaatatcaaataatgatatattttttccttcaagaatatattataaaaccagaactctattaaaaaaaaaagttctgttggataagtcaaataaaaagtactatacctaagcacttatgggcccttaatttaagcaaactgaggtactaactttgagtttccttaataccttattaatacttttaatctttttttaaggaaatttgtatggaagttgtaatcaatagtgttctgaaggttttaaaaaattctagttggaaaaatacttcacagagactatacctaatactgaaattttgtttcttttataatgattaacatgcaaagagaaaggcataataagctccagttaattaattggaagttgaattatttaacctgtatatattggaaatcttcctagttgcactgaacactgatttatctattcttgctatctatcattttattgtttttcattggaataaaagcactttttagaccttatgtgaatttttttgttgacaatgataagctaacatgtcaacaaaatgttttataaatgagtagttttagaggctgcctctctttgtgacctttaacacacaatgctttagatctctagactaaaaaaagtgacaagtcaaaactaagaatactcggagacatgttactgaaaataaggcctgcaagaaattattttaagttaaccaacagtaacttatcaaagagtattatgtttcacattgcaggcgaaactaagaataccagcatttgttatggtgaagtttaacttcaaagtgaagtttaacttcactttgattttaagtataaacataagtgtgaatttctgccagttccttctagacttaggttatgatgtgaaattaggaacttgattgtagctgcaatcaagttcttaattgttatgaatgatgaatgtttgcaaagtttccaatctttgcagagatgtgctattctggcttacaggagtatctttctaattagtaggtggatatgtacttatatgcatgtgcacgcatatgagagagaaatacttttctcagttaatgtgcttctgattatatacatcttgtgagatttcatacaattgaaaattagctagaaagaacaataatactgagttttcttcataacacatttccataatgcctgttccattacttttgttatttacatatttgaacttattattattaaattggattatcttatgatttttttaataagtggatattccaactcttggctcacaaaattacagttggtaaataatttcttcaaggaattttaatattgataaattacttatttcaaatgaattcacttaatatcatttttattttcttatgaattttctaataaaaacatatttttcatttcttcctctcttttttcaactcaatgtcttttttaaaaatgacagtaatgtgtggttataattatgcattttttccaggtgctcaatggcccttatgtctcttttaaaaaaacttttatttattgtgggttttctccccaaagcagaagttagtccaatacacatggcatagaaatttcacaattaggcaattaaactagaagtataacagctgacatgtgttcaaagtaataaagttccaaaattagaaggtgaatcaaattaacataaaggcattattaactttttctaggaggcgtgagtttgcaaaagtcttgggtaatttgatttgcttattctcaaaatagccactgaaccttgagtgacattgcgtttcaaaggtgggagccagagggaaggtcactgttagtgttggagtggcaaagaggaggtttaactttcaaatcatctagggtaatgcctgctactctattttgagacttttagctagatggcaagaagtttttttttttttgatgggaatcagaaagttaaataattcctgaatttggaacttcaggtggtttttaaaccttctccttgttttatagtttcctctgttgtttataccttcctaacattcaaatgataaagttattttcatttttaaaagaaacaaatccaaataataatcccattatgtgggattgttgactctaagcattgtgttttcttaatataccaattacatgctaatgggctttttaaaaatctatacaggaacattttaagattgaatgaatgagcatgccatttccattacaagctgctagactgcagtttcacagactactgatgtggatctgagggcagttcctcaaattaatatggtagatccacagttttgaaaggcaattttcattttatataacttctggcatgttcttaaaaagaattacacacacaccttttaagtggttcccccagtgtggctgctattcattttgttgtcatccttggtattcaggtctggcctagtcccttcataatgtattacccctgtcgcttttgctttcttgcccttcctatgagctcctgctctcttttctggtgcttaggtggggcagcacttttcttgttgcatatggatagagtcagccctgcctctggcccctcccaaaggacatgctgtatcacctgccccagcagcttctgtggtaggcccacagtgcttccattttgtgattgttgccactggcctccgtctgaatttgtttcactgccctagccatgtgtggacatccagatgttgcatccttggtgttcatgtggaacaaccaatgcttcctgataccaaggaagccagggctttctgcagcttcccttctttgacatgaaaaacagaggtggatagggaaacttgaaatcactagtccatttttgtccagagctggcagaaaatttgggttggccagatataactttatttcctttggggtcatagccaaacttgattttctttaatacatcaattttcaaaacatgttattttatttttatatacttattaatgttgaatagttcatgtatacatacagataaaaaattcaaatggtcttaaacaatatgtgcttttattaaaggtctcattctcatctctagtcctgagtctaccattttacttacccagagacaagtgatagcaatgtcttgcatacatttccattcttcctgcgttattgtatgcatttataagcatgcacgtttctgaatctatatgtataccacttttgtacaaattatactgcataatttgtatacaatttcttatacttaacataccttggagatagttttatatctctgggtgtacatatgcttcctttgttttagcttttgtttttaagggttttatagtgttccattatatggagattaattataaaatagtgatcccttaatttgtttaacctgtcctctactgatggctatttctgttgcttaggatcctttactttggatcaagggctggcaaacatcttctgtaagggataaatagtgaatattttagactttgcaggccttgtggtctctgttgaaactgcttcactctgtattacaataacagccataaactatacgtagctatgttccaattaaactttgtttataaaaacaggctgcagtccaggtgtggcccctgccctagatgttcagttttgagagactgtcatgcaaaaagtgtttgtgactggcctgcagaaagtgcttaacagatagctgttatttgattgatgggtaatttgtctggaaatttgtcattagaataaggagaatgctaaacagtaaaagatttgaaaaatacatttgtatcaaaaaagaggtatggaaaatagaaaatgcatgactttaggagcatttgactttctggtgtttaaaaaattgtttaagatgacgctttgacttcttttcaaagtgtagtaagcaggaataagaaaattggaggaaggattatctacctctttgtagcactaccaacctttgaaattttgcttcctgctccagtctgactagtaaactcagattcacccacaaaactgggtatggtaacatagctcatggttattaaagccgtttggttttgcatgatgagtgtattttgttgaaaatgtgtgtcaaccttatgatgtccacatacaaatgtcctacataggcttttccctccttctggggttctagagaacacatgaaagtacttctcctttcattaaacactaaacttgatgcttttaaattctttgacgttctgtattagagatgagtaaactaaggcctgcaggccaaattcaacctgctgcttatttttggaaataaggttttattggaacacagtcatatgcatttgtttacacattacctgtggcttccttcatgttacaacagacaacttgggtaactgaaatagagaatatagaactcatgataatgaacatttactgaccctttatggaaaaaaatcttttcaacccgtctttttgattgcactatttttccctcaactttgagaatcgggtgctctcttctctgaagttgtagggaatctattattatttttttagcatggagaacttgcaatcagcatgtttcttagcttttaaagaacaggcatggttgttcggttgatttatcttttcaatatagtgaattcctactttattattattattattattattattattattattttgagaccgagtctcactctgtcgcccaggctggagtgcagtggcgcgatctcggctcactgcaagctccgcctcctgggttcacaccattctcctgcctcagcctcccgagtagctgggattacaggcacccaccaccatgcctggctactttttttgtatttttagtagagatggggtttcaccgtgttagccgggatggtcttgatctcctgacctcgtgatccaccctcctcggcctcccaaagtgctgggattacaggcgtgagccaccgcgcccggccctcctactttatttgttgaacagacagttattaaactgcctcttaaatagttattaaacctgttatgttcaagcctgggaatacaaaggcaaattatattgatttcctgtttgggaaaaaacttgggggccaatgattgacatagataaataaatcagtgattataagggtaacagagatatgaaggaactggtatgggaaggaggaaccctccatattatccccggaggacaacaaaggcttgctggtgcaaaaaggtgacattttgaaggataacaagggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacctagtagggagacagttacataaacagaaaatataacataggaaggaatgaacaggatattctagaaataccaaaggctctgaaagtagggtgatttctacttttaaagaggtaatttaggttctgaaattaaattcctgaaaataagggccaccctagaaccttaccataacaaaattagctacagttagttatgctaatagtaacctctttcctgtctcgaggaactccttttctttattccacaaagagcctcaccttcatggaagatccaaaacaagaaactgtaagtctggttttgactgttggtcttttaaagaaactctgtaatcggcaaagaatgggtccattgcaggaagttgtccaactggatgttaactagtcagatagcagccttgctggggtatagcacaagttggccaattcgcactggcacatagcctggcctcttgggtcttccttgtaactcaaatcactttgcaagccctggtagtttcacgaaagtcagatgtacccttaactcttaccccatacactcatctatcctggaaagaaaaagttgttggatcttggcccactactcaggaaagtgtattgaccacaggttgtatagttaagtaacagcattttgaggaggatgataatgatagtgatgatggtgatgatgatgataacaacattgatggtgctgctgttgctggtgtgcttaatgataaggatatgtgattataatagggtaggaactatatcttatccttttatacctagtatttggcgcagagtagggatttcagaaagtttgtttgttgtggatggagtgagcagttagagtttcccacttaaaacctgacacagagcatgccatcccacttactcaacaccctccagtgaacttccgtttcatcagcatcaccctgtgttgacctatgtattctggctctcctctgatgttactctggtctcatctcttatcactccccagagactggcttctttgtttttcttcaaacacatgcacgttcccatgtggaggtctctgcgtacgctcttccctctgcctggaatgctttcccccaaatatcactgtggctcatttttgttgttgttgtttttgagatggagtcttgctctgttgcccaggctggagtgcagtggcatgatcttggctcactgcaacctccacctcccaggttcaagagattctcccacctcagcctccccagtagctgggggcccaccaccactcctggctaatttttttgtatttttagtagaaacggggtttcaccatattggccggctggtctcaaactcctgaattcaagtgatctgcccaccttggcctctcaaagtgctggggattacaggtgtgagccacgacgccctgtcccaatgtggctcactttttagctttctcagttctctgcttaaatgtccgcttctcagagaggcctcccctgaccactgtgcacccctctctccctcccatgtccctttatccagctttatttttctttgcaatatttacgtattaagcattatttgtgtatttgtggcctatctctgctcactccatctcgactgaatctaagctacatgaggactacctcctttgttttcatcataggcatttccctagaacctagaacagtgcatggcatataggcatacctctgtaaatattgttgaattaatttgaaatgagttaatgaattgcttataccatcagaagacacatttcatgaactggcatgtatttcaggtatctttctaggtttgtctttcttatcaccctcttggttgtgtgagccccttcagaacagagatcctatcagatgtgttttgttgtcccaaaaggagcccagcacaaccccattcacacagtagttgttcagtaaatgcttattcattggtagattgtctcaaaggttcccacttaggagtattgcttttcttttttgctctgcttcaccacatttttcagtcactctgttttccttcctgcgttttgacactttatcaaactgtactttttcactgtagacatctatggggggagagattatacaagagtatttttatttccactctcaaatacatgtggtggattcaggtttaattttgtattattcataccactgcaccaaagaccaactaccaagaaaactgtaaaaaccagagaatatattttctattcttgatgaaataaaggttctgtatgagaaaccaaatttctaacttcaaaagatttaataggttgattcttttttaaaattgacacataatatttgttcatatttaggaggtacatgtcatattttgttacatgcatagagtgagcaatgatttagtcagggtatttagggtatccatcacctcgagcatttatgatctctatgtgttgggaatatttcaaatcttttcttctagcagttttgaaatatacaatacattgtggttaactatggtcaccgtactctgctatcgaaccttagaacttattctctctatctaactgtatgtttgcacacatgaaccaacctctcttcatctcacctccacccacacttcctaggctctggttactattattctactctctgcctccataaaatacactttctaagctcccacatgtgagtgagaacatgtggtatttctctttccgtgcgtggcatatttcacttaacactatgacctccagttatatccatgttactgcaaatgcatgggatttcattctttttttatggtggaatggtattccattgtgtatattatacagcacattttctttatccattcattgaacaggatgattcttaaaagcaacttccagctgattacatttaggcaaatacatttaaacatttgctgtggtttttagcatgttagtagcttttgaatatagtacattctgcctactcaatgcccttgaaatgtctttctgaaatagttaaattcatgttggtattcacactggactctgtatcactgcctcccttacccaaaggagtttgactagttacttgctagttgaaaccagcttggtacaagctgacacatttttcaagaaatagttgtgtaatacatgttgatattctttgttcttcctttccttattcatccatttggctcctttcttctttccctgactctattccttcccccttgactttttggaagccattatcgctttagtaaacttaatggtgaattgcttcaagagtaaaaatgctctgcttttcaaattagaaaaggactatttcctgtattcttggggatctcattctctcatagctcttatttaaaacgttctggccaggtgcaagcactcatgcctgtaatcccagcaatttgggaggccgaggcaggcagattgcttgagtccagaagttcgagaaaagcctgggcaacatggtgagacctcctgtctaaaaaaaaatacaaaaattagctgggcatggtggcgcacgcctgtagttccagctgctcaggaggctgaggtcagaggatcgcttgagcccaggaggttgaggctacagtgagacatgattgcagcactgcattccagcctgggtgatagagtgacaccctgtctcaaaaaaaaaaaaaaaatgttctaagcaacgattttgtttatttgttcaagattggattttctacacatttaagcctgatttatcacaaataaagcactttctcacaaaatatattctcagctaattattattttcattagtagcactgtcctaactttataacacataaagttcccctggtcttgtttttaacgtcttgacatatgtatacatttttgaatgactaaatcaagctaattaacatatgcattacctcacatacttatctttttttgtggtaagaacacttaatatctactctcttagctattttcaagtgtacaatacactgttattaactgtggtcaccatgttgtaccatagagctcttgaacttattcctcctaactgaaattttgtatcctttgaccaacatcttccaatcctccctctccatctccagcccctatcaaccaccattctactctctgcttctatgagtttgccttttttagatttcacatataaattgatatcatatggcatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatactcagtagtgggattgctggattatatggtagttctatttctaatttattgaggaacttccatactgttttccatattggctgttcaaagttacattctcaccaatagtgtaccaggcttcctttgtctccacatcctctccagcacttcttatgtttcatatttttgataaccattctaacaggtgtgaggtgatgtctcattgtagttttgatttgcatttctctgatgactagttatattgagtatgtttttcatatattgaaaaaaatattgaccatttgatgttttcttttgagaaatgccaattcaggtattttgcccatgttttaaatgggttgtttattttcttactattgagttgttttagttccttataccttttctaggtttttgtttcatctatgctgtcttctcgtacagctcattgtatttgtttgctaaggctgctgtaatgaagcagcacaaactgagtggcttaaacaaatgtattgatccacagttctggaggttagaagtcttagatcaaggtgtcagcaaggttggttccttctgaaggctgtgggggagaatctattctaagtctctctcctagttttaatggtttgctggcaatctttggcatcatttagcttgtagatgcatcaccctaatctctaccttcatcttcacatggcattctttctatgtgtgtatctctctgtctgtccaaacttccctatttcacaaggacaccagacatattggattaggacccactctaatgacatcattttaacttgattacttctgtttattccctatctccacataaggtcacatttcaaagtagtgggggtaaggactccaacatatcttttttttggagacacaattcatcccataacactcatcttctgaaatgtcaaactctggagttagtaaaaccaacaaaagtgttcattgcagcattattaacatgggttaataatgggttctctggtttatcaaatgtttaactttgactctttagatatagtaaaactttaactgagtagggtgagaggttctaacagatggaattttctaatttgctggcaattagcctgtagatgactatgcgagatgtcagctctggttccttcagtagaatatacataatagaaattttgatgattaacaatccttctatttagtattcatcctaacctcagactcttcatttcatttcatgagcctgcctacccattatggcaaagtgaagacactgtgatgttgtccatgacatttatgttgttcccaagtcacccttgtgttgtccatgacttttatctcactcctttcttccttgttctaaccactcctccagttcccgaatcttgcttctctcccctacttttgtacatttgtatttgttctgtagatttttttactcaatgccccctaaagaatttatcttagatatgctctactggctgttcctgattcaaatcaaactgatgaatgggccatcctaactagtccttttgacatcagtcaccacaccaatgagtccactcaccagcacacaaactgggcccccttagtttatccacaaagtggagaatttgacaagataatatactgtcctctcatgatatgtattgtgagatgccctcttaagagactttccaagtggctagtctctacctcatctgattacattaacatgcagttattccaatgatcttcctaatgtgtaattctgaaaagcaacttgcattcaaaatccatcaaggcccctccctccattgcccattcaatgaatgcattcttcagactgacatcttaccttcacatacctacctactagagctccaaacaagtagttctcagccttggttgacattgaattacctcaggagatttagaaactaaagatgcctgagccacacccaagataatctaatttaattggtctggagtgtggtctatgcatcaggatttttaaaagttccaatattcagtcagggttgagaactacttgtttagagcaacatgtctccaatcttaatgtgtgcagtaattgtcttattcaaatacacattcttattcagcaggtctggggccagccaaggttcctgtattttttataaccagtgatttttttggtccacactttgcataacagggtgataaacggagctctgtcaggtccgggaccacatttttctcatctttctgtctctaaagtatagtgtagaagctcttagcaaatgtttgaaatcaaattaaattacagcctttccccaactttccaacctttttctctgcatattgaagtccatataagcataggcttatctctttttgaagcctatccctagccacaaccagaaggccaatgttttttactcattcattcaaccaacattttctaagtgccctttatggcctgttaccaagcattctgtagataataaaatgtaatttccacctcaaatttgcatgccctaacaggggattatcctcttggtgtgtgcttcacagattaccagtgctacacaaccaggtgttttgttttaatatgctttaccttcgtaaaatacaaagttcaacacttgggtgtctctgcaatgtcaagttgctataaacgtttctaaacagtgctctcaaattctctccttgtaaaatggcagtaagtaattttcagatcatgttggttcatggactacactttgagtactgctttttcagggcctttccagacaaagtggagtctgtagaccagcagcatcagcatccttgaaagcttctgagaaatgcagaagcttggatctcatcacaggcctactgaatcagaatctgcatttctaggtgatttgtgtgcacattacagactgagaagcacagctccagggcagtggctctaaaccttggctgcatattagattcacccctggggcttctaaaaattctgctttccttcttttgagaattgtctattcagatcctatttgtttttgttgttgttgagttgagctctttttatatcgtggatgttagtccttcattggatgaatagtttgcaagtattttatcccattctacaggttgtctcttcactctgttgattgtttcccttgctgtgaagaggctttttagtttattatagttcccttagcctgtttttgtttctgttgcctctgtttttgatgtcttagccatacaatttttatggaattacttaaggctaatagaattagctgaaagtagtttccaaatgtgcatctctaccccttgctttgcaaccttctgaaaaccagacaatactctgatgtaatttgggaaagaagatatattagtttaggcctaacgtcttaatgtcctgaagaacttccctgtgttttcttctagtagttttatggttttggatcttatgtttaactattcaatgcattttgagtttatttttgtatatggtgataaataggggtctagttttattcttctacatatatagtacatatacacaataaaatgcttttcagccggctgggcacagtggctcatgcccgtaattccagcactttgggaggctgaggcaggtggatcacctgaggtcaggagtttgagaccagcctggtcaacatggtgaaaccccgtctccactaaaaatacaaaaattagctgggtgtggtggtgcatgcctgtaatcccagctactcgggaggctgaggcaggagaatcacttgaacccgggaggcagaggttgcagtgagctgagatcacgtcgctgcactacagcctagagtgagactctatctcaataaaaaaaaaaaagaaatacttttcagccataagaaagtgaaattctgtctttcttggcaatacggatgagcctggctgacattatgttaagcaagataagtcagacacaacaagataaatactggatgttctcactcagatgtggcagctaaaaaaattttgagccaaaggaagtaaagagtagaattgtgggtattagaggtagagaaggtcagaagggaggggaggatggggagagactggttaatgaatacaaacttacatctagataggaggaattagttctggtgttctagcactgtagggtgaatatggttgactataacttattgtatatgtcaaaaaactaggagagaggattttgaatgttcacaacacaaacgataaatgtttgaggcaggagatatgctaattaccttgatttgatcattacacattgtatatattataaaaatactctgtatcccataaatatgtagaattgttacatgtcaactaaacacaaaaggaaaaataattctgctgcacaagctatgtcccaatgaattaaactaaaaatctctgggggtggtccccagtcatcagtatttttttttttacagctctccaggtgactctagcatgcagcccagagtgggaaccagcactaagtcagcccagtgtccatagagtcccagaaagtggccagccattgctctaaccttcaaatcagctcaggttctcagatactcatttattactccattcccttcacttaggaaactcaggaccacagctaaggtattccttagggggtatttaaagaggactgcttagatcagtggttcctcaccttttgttccacagcagttcctgaaattggatgggtgcatctttaaagtgcagttgcagggcctgtgccttttttattgaggtggagcaattattgtgaccctgttctgctcagtaagacataaagaaaatatgctgggtggctttctccctgagagaggagcacagaaatagaaatattattagaaacagaattagaaatagatagaggtccacttcatgactgctcaactggactttttagggtctcaatttctacttgtgtaagctcagattgctcagtgggccaattagtgaatcccagagaagggactagagaacagacctcgtttggaaatactctattatcgtatttcaaatgtgggccatggactagcaacatcagcaccatctaggagataattagaaatgcagaatctcaggccccaaccagatctgtgaaatcaacaatgttcccaagtgatcgctatgcacattcaaatttaagaagtggtggtctctaagaggcagaatatattttttctcaaactacttttcagttcccctgttttccttctgctgtcatggaagatgagcttgccacaaagggaagctatgaagaatctagcacattcttcccttggaaattcaaacacccatttccacactgcagtggaagtgttgtgacatgttctattggaaaaccactacctacatgccatcatatggagccataaactatttttaggttttctggacaggccaaagattctgctgcccaaatgattccaaagaacgtgaggctgatgtgtctcagattttcttgtaattcttgcatttctaaaaatatcttgggtgtttgatgttgagttcagccctgttttactaacaaacgaagcctttgtatttactgtctcatttggtaggttattttctccctttttatttccagtgacatgtcatgtttcctgatactgatttatcagagaagtagaacaagaaattgattcaacatgcataatattttattgaatgaccatctccatgtaaaatttttcttggagtttgaagtggggaagaatgttggatatagacctggaaaagagaaggtatggtggaagttcaagtttcctcatttttgttagaggagtttgaaagctgccagcaagtgtttaacaaataagaaggcagccacctgagatagtctattgagataggaagagtgattgtagaagacaaacagcaacccatggtccttcaaagaaaaaaaatggcatgggcaggaattacttaagtctaatagaattagctgaaagtagtttccaaatgtacatctttaccccttgctttgcaaccttctgaaaaccagagaacactctgatggaatttgggaaagaagatatgtgagtttaggcttaatactttcctagtctttattattatattttacaggaatttcataatatatattttaaagattcttactaccatgattaaattctgcccagtatgatgatcaaaaagggcttactgaatggagaaagacatttgtgtaacacctagcagtcatttattgcaaagccaataagcgccaggcattagggatataggtataaataatgtcccagcataaaaggcaaatatatatttatttgccaaatatatatatatatatgttttactttatacatatttttcaggagttcacagaaaacaatgaaataacccttaaatcatagttcatttcttaattttcccagtaggagaaggctcatttttcatgtttttctttattattttgaaggcaggacttcaaaaaggaataaaaacagaaggtcaattgcagggcaaatcacagcggctccgttcttgcatatccagatgggcatcaccctcgtttaccttcctaaattgggaagctttacatcctttcacaaaaacatgatccataattattttgttgcagttcacttttttaaactggtagaaagcatgctgttaatgtgatagtaagtacttactctgtgaataataaaattattaacatttcaagcctgcattttggggagttaccttgagcccacattgtgccactcttaaacacatcagtgcatgcagtctttggggcagctccctgaactaactctcttgttgtcattttagagatgttgagattaaggtttagggtatagttttctccaaatctcagctataaataaaggatagagtgaggatgtctgcctgacttctatgcttaagcttctaaatgttgccttgcatgctgtctgttttgtgatctgagagtcatagtttatctgctattttgaagcacaaattattttttttaagaaagcctgatagctttatctgagaggattagctcctactatgcaaaaccttgaagggaataaattatgggaataaactagacagctacctgaatgtttgtattttagatttcaaggttattgaaagtactagagatatacctcagtctaatgtttgcaaataagaagcacaatatctccttgaagtcaagatttttgaaaggcgttattacttggtaaattaaacattagcttgccaaatagattttttcttattctggagaattacataatagaatcatgggtattttgtacttgccaagaatcacttcttgtaccatgtagaacactcctgactccctgcccctcatcattgtatagctgaaaaaatcagagaaggaaaggcacatgccccaggtcacacaacttgctggtgtctgaaatgagtgaaacctgagaggttgtctagtccacactgcaatggatctccagctgaacgttaaacataattatgaactatctacatattttttgtaggaagtttcagagtgatgagatcatttcttcaaaggttttgtttgtttgtttgagataatgttttaatttctgacaaatagcgttggccctattagaagacttgcgttatgtaagtctagcataaaatatttatcatatccttcatttgctaaaatgtttgatcttcttaccactgcatcaaaacaggctgggttctgaaaggctgatggagagtcaatttattcgcaagaaagaaatcacacgattcaagtgacccaagatgtcagtgtgaaattaaattccaccagagaactgatgatactgagattgacccttgcttgaaacaaataagatgaaccatgaagtgaacctcattccaaacatggcatcaacaaacataaatgaagacctaaaaagtgacttgttttgggtgccagatttttcaacctcaaaactgaagtggttgtgaagccaatttcaaaatgacaggcataacccaacctttagggtttattggaaacttgattatgttcttaaggcctctcagatttttggcatggtttaaacatttgcctctctgtcctacatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttttttttttattcccggagttccttgaggtcaaaattattttaataataatatgaagatattgtttgtgttttttaattctcattctctcaagagtgtgccataagagttttccagagaccacatggtgtgcaatgaatatcatgctgatagctaatagaatgtgttcttgtgttttaaaactttctcagttttaattcctaattcaataaatagcaatagataaaactcacataaacacaagcttttggaacttccaataatttatgagtgtaacggggtcctgagaccagaaagttatgagaactactgctttagtgattgacagagaaaatgaatcaagttgaacaaaagttcagaacttgggatatttcaaataccatggctaataacataagccagcatcatcttttattgctttgtagatattagagacacgaaaaacccttggattctgtgccagagcttaaaagaactagaagcaattgtttctgagttcttgtttcaaatccagtgtctgatttggagttgtgtaatctctgtgccgttgacattttgggcagggtaattctttgctgagaggagctgtcctgtgcattgtagaatgttcacaacaaccttggtctctgcccacttgataccagtaggaacctcagttgcaacaactaaaaatgtctcaagacattgccacatgttccctggctggcaagtcacccagttgagaaccactgtctcttaaggcaaagtatctgttgtcgcgacaggacgtttctgattccctctcattgtttagaatttattcacatagccattcctaattgtaaataggctgggttatctaatatttattctagatgggtatatgccagctaaaattggatgttgtattactgtgacagaagaagagaacaagtattgagggacagctcccagttttcatcatgtgtggaaagagaatctatgcttgaaatatttgtgatggtgatagcacattctatcaagtctaggaaaacaagtcactggattttactgaagtatttaggtgtaaaaaattgaaggcccttccgtgaaaaagttctaattggtaatttcattttatgcaaacccctattatgttattatttgagagagttcaagcgtactttttatccttggtaaatattacacagtaaaaaattcaaatatcagagacaatacaaaaataattgtacaggctctttgctttctttagttacgtttttgtccagaaatatgtttttgtgcatattttcataccacaagttaaattatttttcaactttcattaaggttttatcgtctctcttgatggtgattgttcacaaagaaacaaaatatttatctattaaacagagtgtgatttgcatgaggttctcccagaagtagcacctgagtcaaggattcacattcaaggagtttatttggagaataaaagtagaggagcggaggtgtgagacagagaagggaggaatccaataacaggtgtactgttgagcacatttccactttaggagatgggctgcaatcccattagggaaccctataagccagtatagaatacaactcagagttatcccacccaacggacaaggacactgaggtatttatcctccaaatctcagctgctgttggctcagggcaacatccaggggcattaggtccctggcacttctggctttcctttttttccctagtcaagagaaagcttataggcagagagctgcttatgtgtgaagctggatgtcatgggatgtcctgaagcagcgagtgctgagaggacatgatggggtacctacagcatctattccaccctctacactggttggttggcttggctcactcaccagcctctggcccaccagccttgctctatgttatgttgtgggcttactaaggtcagataggcaaaggaaaatgagctgaagctggacctcaaaaggatgctgacaaaaatccttgcatgatgaataaatggtgaatgaacttcatcaatgtgatggtcaggaaaacataaacattaacaaaaatatgaagctagttttcaggagccatagcaatatagttttaaattccaacccaaaggatatctgcagagcaacaatgggaaatggaattttttgctgttgtttgctttgaacatatcacagattcctcttctctaggatgttaatcagggccatctttggatcgtacttactgtcagatgtaagccaggccactgttaatgagagactggaatgcagccccagaatcggtgtctgcttcaacacagatgggcatggggatgagagatgccgggtggttatggaatatggggaaaaaatatggtgacttaaaggagggcagaggcccttaaaacttctttttatagtacatcaaagctgttgatcattgaggagaaaaagcttaaggtgggctactgggacctgccgctttcagcaagaaggctcattattttgaggataagtaaaacaagtagcctcatgtaaggatgaagcgctcttcagtagatgttggttgagtccatatggcttgcagaacatcacattaaagtttgctgactcattccatgcaagatttaagcaattttcccaaggagacaatatggctgtctccatataaatgggaataattctagaaggtaaacattagtcagcacagagaatgatttgatgaagagatagagacttctatgggtaatgggggcagacataacacagatacatgggaagcagggtggctaaatgcaagtgtgttttaagccaacaaaggtagcagtggccatggtggaggaactggagagaggggccacttgttgataatttattcctaccagctcttattgcaataaaaagaaactatgtaataccgtatgtggttaaaaatttgaaactaataagataaaggaggatgatggtgaaatggggggaagaaaataagatggtatcagtatataaaaatgcacgctatgagatactgtctccgcactgttcaatatagtagcccttaaccccatggagctgttgggcacttgtaaggtgctgagtccacattgagatgtgctgttagggttaggtatgcacactggatttcaaagactaatatgaaaaaatgtaaactatatcattgataatttttatgtagattacatgttaaaattatgataccttggctacactgggttaaatagaatatagtttaaaatcagtttcacctgtttcttttcacttttttaatgtggctactagaaagttataaattacatagtggctctcatttgtggttcacattgtatttctgttggacagggctgttcgctaccatggcctgtaccagtggttctcaaagggggatgattttgcccccgagaagacagttggtaatgtctgaaaacatttttggttgccactgctggaggggagggatgcttctagaagccctctagtgggtagaggccagggatgtggtcaaacattctatgatgcacaggaaagcctccgccatcaagtattatccaaatgtcaatattgccaaggctgagaaactccactttacaccatagatatagggtactgggagcccaatatggaggtatagtattaacctaagtgtgagggtgtaagcatcttctctagagtgtagacagtgggacccataataacacccttcactgctcaactgcatgtcaacaggcagtacagcaagcacctgatattgatgttatttaattcccatgagagcactattgcggtaggcagcatctccattttgaatctaagtcagctgattccagcttatgggctttatcgcccacagagataagaactgtaactacttcaagtctcttgagtccatttatttctttccattgtaagggcctactatcctagataaggccacctaactagtctctagtcttgaccacttcagtcctccagttctttctccatgtcacagtgatctttccaaaaatccaaaacctttcaatatttctataattactctcaggatgcagcccacattctttatcatagtctagaaactattacttggtttcaacacatttttgtcaaggatacacaatgtattttggacaaaatatggtaagaatcacaaaatgactgcaagatgatgcatgttaatggctgtcactactagagatgcatcttgaagacaggattggtgacctttctctctgtaaacaaagacttttagggcagtattttgcttatgtgggacctgtgaacatttgggtaaaacatgtttatgcaatttaaatgattatcaaaccaacaataagtttattgaaatgagaagattttaatttgggaatttgataggaagatacatgttgtttgttatactataaatctacaaatgatcaattctttggagggagaggttctgatttgtatctttttctgtctccagcaataacgagtataaagtaggttttgatagttccaccttaattaaattacaaactttgtgatgatcctgaaatgtgtattttgaataagggatcttaagtgccacctagtggcaatgaggggatatattacacattacattacaaaatgtattagttttgaaattataaaggatcttaagtgccacctagtgggagtaaaggattatattacacaacatactacaaaatagagccgttttgaaaatgtaaatggtcttaagtgccacctagtggaaatgaggggatatattacacttattttaaaatatgttactgaaaagttgtccccttctcggtggtagccccagtatgacttaaacgctgtgaatacaaaaatggtatctccttaaaattatgcattctcatcttctttattcagtttacctgtctgtcacactgccctctggacatctaattttttaaaaaagaaattttttgtatgagttgaaacagatgaatcctgaaatctgagtgaaattttgaaactgcaagtttgtttctctcttatgtaagagtccaatgaggatatttggtggacagccttccttgtagtgacttggggatccatgctcctcccatcttgtagttcagccagactttagggcagagatcagcaaactgtttctgttaatggccagatgggaaatattttaggctttgtggactttctggtctgtgtcaaaactactcagctttgcctttgtagtgtgaaagcagctgtatacaatatgtaaatgaatgagtgtggctgtattccaataaaagtttatctttggatgctgagattggaatttgataggtttttcatgaaatagtcttctttttaatttttcttcaaccataaaaatgtaaaaaacatgattagctcacaggcagtgcaaaaccagtttgttaacacttgccctagggctttggaatccttacttccagccagaggctggagaaaggatcttgcatgggaagtttttttctaggccagcctgtaatcagtcaagcaccatcccattggccagaacacagtcacatgatcacagacagggtggagagggaataggttttggtgaacacatagcagtgtacccacagtctctaacacagtccaccctgttactttaaaaataaaattttgttattcattcatttattctttatcagttgatgccatttcttagccatgttcccttggtatttatcattacacgcacatgttcgtgaacatatccactttaagaccttgtctttaaactcggtacgtatgtataaagtgattatgatgaacataagaaatggcatcagttaataatgaatgaatggaattgtatttttaaagaaataccatgaactgtattagagattgtggctacagtgttgtgtgttcaacaaatctttctctaacctccacccacatggttgaaaacaaaggagacttcgaaccccagctcagtgtagcaccaatgcctcaatagcatccttggagcagagctcctcaaatgagaatgtgcatgtaattgtctggtaaatattaccagcacaatggggcctgagcttcagaatttttaatactggttatgctgatgttgctggactgtggaacacactttgagttgtaagaataagtgtactgagctaataagagaaaccacgtttcttcatctctgtaatcaccgatagttttgactgtaatagctgggaccccaggcagctgtctggattttggagaaaatgaggatataaagggaatgtgaactgaagctcaaagcttgggatagctatggattataataaattttaaagcaacaacttgcaaacaaatgggtattatgtatctgatgcagttcaggttttaaaaataaatcttacagccaaaaaaaaaaagaaccccctgtcattaatctaggttgacaaacatgaaagaaaagtttaggaaagaaaggaaacagagagatggggaagaggggtaaggtgagtgggtgggtggaggaatgtcttagattgactagagaaatgggttttgcttcatgggattttttcatatttccaggagagggcagccagtccccactctaaaaacaatgtaaacttttacatttgcatctaccattttcagaaagtattgtgatatacagtgattttttaaaaaacttacttctgtccattctattaaccataattggaagctcaatatatacgaagggcattaaactaagagtcaaacatctgaatttggaaggtcctttttcctagatcttagcaattctgtacctgcaggcaagttgatgaacatcctagattttttatatgtaaattagatgcagtaagactagatccgcctcctggaaggatggcagataattaatgaatattgtttgtgaaagccctgtatgaatatattaattcattcatctatccattcacttgttcagtcacacatttaagccttaacgtgttgcagtgctggatgtcgaaatacaaaatgaccgtcacacagattctgccttcaaacaacctattgctaactgaagaaaaatagtatgattatgctataattgaactgcaaagtgacagtctaataaggcttggtaggagcaccctctactgacaaccctgacctgctgtccttttctcccagtacttggcacttcactcattccattccagttacataggcctcccccagctgttcctcagactcaacaagttctctatgttttggggaatttgaatttcgttttcttgcctgaagtgtttttcccttagttatccacatggctcatgctcaaggatttttaaaaaaagatctctgctcccttgtacaattcttacagaggccactcagagtacattatctaaaatagcacctcagttactctctatttcaccctctctcagtctgcaaattaagatgtcattccctaaggcatccattgtatgcaatgaattaacttctctcgtatgtatcgagaatggtaatagctgtgcatcatccttgggaaaattgagaatatagtctgtcaaagtactttctgtgttctgtggtttagatgaagatagcaagttgagtccgtgttttactttgctttataacagttttcacttaccaaacacaatattatgaatatatttaatttgtttttctctcctttctcaccattagaacacaaactctaaaaaggtaggaaccatggtttgttcaatgttgtatctgtagcacctacaccaccatgtgccatctccagcttggcatattgtagggtaggcaatacacttttgttggatggatgagtgtgaatgacgaatgaatggatgaatgaatgttgagaatgcactcaagaggtaactcttgatctgggtcttgtaagatcagcagaattttccttggtagatggggatgggaaaggtattcagacacagtatggtttaatgccacagtcttgtaaacttgagagagccatatccaggtaaggcagtggctttctgaagtggcaaatccatacctattgtagttttcctgatttttgtccttctttggagagtattatacactgcatatacattgtattattcacaatatatttttgacagaaataagttgtatttcctgagcagacacctccacttgttgatggcctgtgtactaaggaaaatacagattttaacattagcctaaataccacataattagaaatttaatctactggggaaaatatcattaaattttcatactgcatatattactttgacttatcagagttattcttctcttattaataaaagaacaaggtgtcagtttactcactgattaaaataatcatattattccatttcaagagcctatgttttcaatagtgaaatgcatgtttaatgatctttagatccatgctactcaaagtatggtccccggaccagtgccaattcttagatagtccttgcaggtctgtaaggatatatgcaaatcaagcaagagtaaacatttagaaacttttatagaaatttggcaccataattttatatctattgaacctaatttttaaaactgggcttgtgtttcatgtgcttccctccacccctttttagtaatttattttatttttattacattttacaaaagtatgattctgcaatggattggaaacaaacaagcaaaccttgtctttcaatacaggtcatttgagaaacactgctctagagcatgattcgtgcactgcctttagtcccacaaagcctaaactatagggaacactgagaatttagcttggagtcgaactgaccttaaaccaggtgacagtgcctgttaatagtgctgatagctggcatttatcaagcacttactatgttccagacattacactaaagactcgagagatttcccttgcagcaagggcctgagaaaagtaaaagtagatgggggagagggagattgtgtgtgtgacatcagaagcacacacagatgtttcttgctctatccaacttctttcagggatagaaagtctagaatgacaaccactccactgacagttacactgatttgacatccattttcttttatttctgggttggttttagtaatgttttggtaatataagccattaagcttacacatgggtacaggaaaggctgagtttcgggttgtttgtttatgcatgcatggatgccttggagacctggtggagaacccaaaagcttaatagcggcctttgcttaaggaaacctggcctacttcacccaggggcaaagctattagtgtccagaatctgggccctgttgcataaagatcttgttgtaactggttcaattctaggagggctggggaaatatgttttttagaagccttgaaatttacaacctcattgtccattgtggtcttttcaaagcattcaaagaatctgcattgataacagtctgtggattaaaaggacaagcaacctttgctatagtttcctgcatttggaaaccctgtggaccctgctaggcaacccttttggtaaaaggtaggcagcgaaatgcaagaatcggtagaatctacacagcatctgggctaaatcagaagtatgccagaataaaaggggaatatataacatatgcccttggtaagctggacttcactagcagggcttcatctccctctgtgctgaaaggttagcaaatattttatctaaacgtgccacagaaaagcaccataggtattgtctattggtagaataaatagttcaatcaatagctcagtgtagtttaagttgaatttaataagactttggaagcagatggactaaaagaaacacagacacacacagaatttggggcccttgttctgtagcgattgctcataaaagaatgtgaatctttagactacgtttcctaaaaggaatccagccatacttatcgaaaattttaatggaatttataaaaactgaactgaaacttgtatccacaagtccttaagccttttgaccacctctgtgattaggcatattcagctaatgtaactaattgccagatttagcaaatcactcagttacatttgaatttcagaaaaacaaatatttttacagtatattccatgtggtatttataagtagatcccatgcaatgctttgaaaagaccataatgcaaaataaggttgaaaattccagggtttctaaaatcatgttttccccaacccatctagaaccatgcaatatttgggacatatttatgctaaaaatattcatttattatctgaaagtcaaatttaactgagtgacctgtattctgtctggcaaccctaatctagtgtcattgataaaaagatgtgggaacagataaaaaagatgcagcagacaattggttaattcttttttcttttcttttctttttattttttgagatggaatctcgctctgtcgcccaggctggagtgcagtggcacaatcttggctcactgcaacctccacctcccgggttcaagcaattctcctgcctcagccttccaagtagctggtactataggcgtgtgccaccacacccggctaatttttgtatttttaatagagacaaggtttcgccatgttgcccaggctggtctccaactcctgaccttgtgatccacccatctcagcctcccaaagtgctgggattacaagtgtgagccactgtgcctggcaacaattggttaattcgtatttgaaatctttatacatatatctcacttgaactttacaacactcatagaagaaggatatattaaaaagcttgttttacagatatggaaactcaggcttgaagaagttaagtcatttgtctaggttcaaacagctacttgagtcagagaggtaagattcaagatcaaatttaactctggagcctagacacttaaacatatcagtgtaatcttaagtgacatttaataatactttggaagcagatggactaaaagacacacacacacacacacacacacacacacacacacacacacacactcctcatattagcaaagcatcattaggactaattctcctttagtgttttccaaccattatatcaatggtttctaaacttttaaattatggacacctctcctccattttaacctctcatagttagaattactaagcatggtaattttagttgtctgatataatataatgacagaaattagcaaattaatttgtcaatcaaaatgaattcatatataattttcacaacacaagtagcatctaacagcatatgaaagacagtaaaacataccttcagataaattatttattctagaaatgatgttgagtgtgcaaatagattggaggattcccttatataatttgaggctctcccactaccacctcaaagcagtcatgtcccacaagttgggaatctataaattagagaaattaaatcttagagatagacccaagatgaatgaaatttctttccctgaatgtagaaatgaacccaaaggaaaacaactactgaagctggggagaaatgcaaggtgaggggaggggagggtcagtgatttaattctcagccacagcaggtgcttctggtgtcctgcctgcttcagcctgaaggctttatactacaaacattggcaacttttgacttgatggctttctctgccacctctccctactcatgtacagctgacagtaggacagcagggaagtctggaagtggttacacctagaaagcaacacttaacacaaccagcttccttgccctttgagtgggatgactcagagtgaagctttacccaatctcccagaggcccccagaaggactaagtcccaggtgcccacagtagtcaccagctcattaatgcatttgaattggtcaccttcccttcctcgtctcactttcatcctttcccagtgcttcctgggatcttctcccaattaaactgcttgcatgcaaattcttatctcactctctgcttctgggagaactcaatgttaagaaatggactaaggaattttatatttttgaaccctgccataggtatcaataccagaaaagattagctctctgttacttttctgatcctcagtgccttgagaattagtccagccttttgaggataagcaggttggtgagcctggttaatatcagttcttcatggaggggcccatgtggttactaacaacatgggtaaatagagcctgacgtaaattaattatgcttacgtagattttttcctctgtaaattttggtcattataaataaagaattgataggtttttgtacacagtacatggtgaataactgctgtccttcagtgctccactcctagcatctttatttgggcattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatcctatgacttagttgcaggatcaggcatagaggccaggtctctagaccttcagtcccatgccttctttatggaacgatgttgtcttcagagatatgtctttaatcagcacatgtttctcagttatctgctgttagccttgaaatgtgcaagacacctgaggggaatgtatacactgtacaaggcatggccactgtcctcccaggggttaggaaagaaactctcgtacacccattttgatttcctctctgggtgcagtatcaatcggtataaagtctaatgcaaggtaaggaggcaagtgccatttcttctggagtagcaagcattgcaaaaatgtctccttcctctattttaatcactgtatttggatgcaaaataatccagcatagcacaggaaatataatcaatttactcaagaatccctggcaatatgatacaatagcaggcttgtataacccattcaggaaccatagatcctctgattcttctacgtttgtgtcattttaattatgctcatttcctgtaatgcaattactaataattatttgccgctctattgtaggggaaaatcacttacatattgctgcatagtaaaccacttcaaaacttggtggctttaaggagaatcaaaaagctctttttggaaagagctaggtagtaaatattttcaggtttgcaggtcatatgttctctgtcccaactactcaactctgcttgtagggctaaagcagccataagcaatacataaataagaatggctgtgttttaataaaactttatgtatagatgctgtgatttgaatttcataaaattttttaggtgccacaaaatcttcttctgatgtgttttctacccttaaaaaatgtcagatccttgaatggtttgctgatagaagctggatttggctcgaaggccttaattttccatctcctggcttaaaacggccatcactatcactccgtagtcttcagattggttgggagtgcacaatgcaagcttgggcttttttactctgattcaggttctagatcccatgtgaccttggattcttaccaaaatgggaataacttttatccttgtgtattcattctgggacccaggatgggtggcagcagcttttttcatagctgtgacacggaaaagagtacaagctcaatcatccaagtgcatctgtggcctcaagctggctaccatgtcattggccattccatactatcgcatggccaaatccaaaatcagcaggcaggaaaatatcctctttagtgatagaaactacatagggtatgaattcagggagccatgaagaattggggccactggtgccgcctatcacactcaccttcccttttctttattgaaaaatataatgatctccttatttttcctccaactttcttctagacagaaaagaagggcatatataatctattttagattatttctggaggggataacttcctatgagtacttctcttagtcatctgcaggaaaatgctgtttataattttgccctgatccgatatctgtcatgcaggaaagtacacattacatatctttggacattccacagcttaatctgatacaccaaaggtcaactgaatgttttccttgagagaattttgaaacaccaactgctatctctgaattttctttgtttggcatctaaaggtatccctgttaccctagaggtcctctcattctgaacacagggaggtgagaggagttattcctggaagtggggcctatgaaaccactggaccttttcctgacaattgctatacccacgtcactgagcgaggactgtttaacctagcttttcttgcctttagccacattccttccactcaccatttgttgatgcaacttttaacacaggacaaagtgtcttatgtttttctaaccatctttgctttctggattttcttttctgataaccttctggattttagacttacgatttcaaattcctgaatggaacatttctcaaaacaaaaaccactttttaaaaatatgtaccctgaatttaaaaagtaatagtgaacagaatgtagcaaaatatcagggaggactgagaatgtgaaggtccacctgataggctagggagggtcacttagcttggcagagcctcagtgtttgcatatgaaaagaaaagtcactcccaacttggaaataatttgattctgaggttccacaaaatgcatatattcagaattctgtgtagaatttgaggtacaacttaaagaagacatctctgtcttctatatataggctgtatattgggccccaaacattatttttcagctccctagctatcccccttcttttctacttccaccccttcctggtcctaggtacagaaatctcaaattttattttgtttagctgaataatattagttgtggagatgctcttaaatatatgatgaatggcaaataaagaatttgggggagtttccccagtatgatgaactctgttaactgtcattgtagggatgagatattttgatcaaaagatcttctcatgggattatgatcaacactgtaagtagatcgatcacttgtttgcagaggtttagaatcaatagcataacttagtacccaaactcagatgggtataatttgaagttttccttaatgattccaatatcaaggttatcactatgttggtgagggatggtaaataaagaaacctaaatgataaaatgccaaatggccaaatggtgactaacttaccatatagatcgcatgtgtgatgcgtgatatgtgtgtgtgtgtgtgtgtgtgtgtgtgtagtatgagttggctcaggcatgaggcacattttggaatttcatcagcatttgaagtagtgaagagacgaggaagctgagattcgaaaggggtggggctgaggaagtgatggttgaagggatatctttgactccagagactatgccaagcacaggaggcatacagtggaagactggagaggtgagcatattgcagaaggactccagtccttgggtgggtccaaaggcagctggagtcagtccttgggagcaatgaaattgtcaggctaggaataccccagccaagttgactggtatgcagcttagaaggaaatggaaagacggacttagtggcatggagttaggagttggggttacagtcggggtcagggcaagcctgcatctctgaaactacagctatttcttttctccctagggttgccaggtaaaatacaggctgctcaggtgaatttgaatttcagataaataatgaataatattgccagtatgaatctgtcccaaatatagcatgggacatacttatgttaaaaattagccaggtgatgtggctcactcctgtaatcccagctacttgggaggctgaggtgggaggatcacttgagcccaggagttcaaggttgcagtgagctatgatcgcaccattgtatcatagcaacagagcaagactccgactcttaaaaaaatactcattttttatgtaaaattcaaatttagctggatgtcctgtaccttatttactaaatctggcaaccatacctacccacatccatgctaggtaaacaccctgtacttttctttccttgtacctttccattatttgggtgatttcttcatttaataattgtctccctcttgagaaaccaagttccacgagggtgttttgactttcagcatactttgtgcaaaaacataggtgaggctcaagaaatatgtgttgaatgagtgcatactactttattagcagtgggactataagtaccactagaagtctctctgaggctgctggccaaagttctactctataataagggctttaggattttgtcagtagaggcaactgcaaggagctgggggcaaagtgggggattgacagtcccataacttcatcattattctcatatttaaatacacatgtctgcctgggggcacaattgcctctgtggaaatccacagccctagatggaaaatcagatggcttgccctgtcattaattggcacaatggctttaggaaggttcctcaacctttagaagcctcagtttctttctacaaaataggagtgaatctcctgactcatgggcactcacaaggattgagaactcatgaggtgaaagtgtgtattggaaataattatgctgtttttttaagaagatacaaatgtacactttatgccgcagaaacagtagaggcccctgagataaatttccctgtcacctgagcaaatatcccttgttttaaagacacggagactgagatgtggaatctttcttattcaagcacaccctcagtcactgttcaaaagctgtgctgccatgtccatcccaagtgtcactggaaggtcacatcctggagagtgtagggaaaggagtccccctgcaaagagccaataaccgcccttatttctgaagggtcacagagtcacaaacctctagatatttcttaggaattcctctccccttcagaatgaggctttaatgactcaactttctctactgaataatcagtaggggttcaagagtatattaatagatcaggctcaattaaacaaacatttctggagtcctacaaggctctgtgcttagggaaaacagtggagaaaataaagatgattaagacactatgtactatgaaaaaatgctcaccatcactggtcattagagaaatgcaaatcaaaaccgcaatgagataccacctcatgccagttagaatggcaatcattaaaaagtcaggaaataacatgctggagaggatgtggagaaatagggacactttcacactgtcggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactagataaagaaatgtggcacatatacactatggaatattatgcagccatataaaaggatgagttcatgtcctttgcagggacataggtgaagctggaatccatcattctgagcaaactatcgcaagaacagaaaaccaaacaccacatgttgtcactcataagtgggagttgaacaatgagaacacatggacaaagggaggggaacatcacataccggggcctgtcgtggggtggggggctaggggacggataacattaggagaaatacctaatgtaggtgataggttgatgggtgcggcaaaccaccatggtacgtgtatacctatgtaacaaaactgcacgttctgcacatgtaccctagaacttaaagtatatataaaaaaggagactatgtactgtcttaggaagaaaaagcccccactcagataatgctaatgtaagagcaagacaaaggctgaagagaagaagcaaacgcttctgactgagagttggggagaatcgtgggagacttcagggaggagggtcttgtaggttgcatagaattgatgtaatccccgttcaagctcttctgtgttctttttttaacttttattttaggttcaggggtacatgtgcaggtttgctatataggtaaactcttgttatagcggtttgttgtacagactattccatcacccaggtaataagcatagtacctgctagttatttttttctgctcctataccctccatcctcaagtaggccccaatgtctgttctcttctttgtctccatgagttctcatcatttggctctcacttataagtgagaacatgtggtatttggttttctgttactgcattagtttgctaagaataatggcctccagcttcatccatgtcccggcaaaggacatgacctcattctttttgtgtctgcatagtattccatggtgtatatgtaccacactttctttatccaatatgtcattgatgggcatttaggttgattccatgtctttgttattgtgactagtgctgcagtgaacattcacgtgcatgggtctttatggtagaattatttatattcctctgggtatatacacagtaataggatttctgggttgaacgttggttctgtttttagctcttggaggaattgccacactgctgtccacaatggttgaactaatttacactcctgccaatagtgtataagcattcctttttctccacaacctcaccagcatcttggtattttttgtctttttaatagtagccattctgactgatgtgcgatggtatctcattgtggttttgatttgcgtttctctacttatcagtgatattgaagttcttctgtgttataacactcaataatagtatgaaacctcaagttcacgaatctgtgccatttacatgtttgactaacccaagcataaaacaaggggaacacaacctgcctaggctgccacagagagccaaacgggagctcataggtgaaagcgtaatgcactatactggtgggaggttggtcttatttactggcttgtcatctgcctagtttggactctgttgcgccttccttcattatgttggtctttacggggaaaatttcagggaagctcccaagtttgctcaagaaaagccacccagactttacagtcattttttactttgaaaaaaacaaatccaatcatcttccagatgttttcatttaccaggtctaaggaggagaagtacaaaaaggaagacatgctaacttttgggtttactcttcccattaaaacttctccaatgtgacattgaaatatctttctagcattgttggtggctgttaaccatttttgttcattttctccccatgtgtttacctccaggaaaggcatgaaaccaccattgtccattccctgactttaactgtgtgtctcttcagtctcagtcttctggctcagtaagccagtgggtgtgtatgtgttttcctcattcagctaaagacctgcttatttgcacttaatgtgagtaaagatatagttggggttttaatcaataattttcattgcatcttctttaatagctttttggtgaacaagtttagatatgagggtttaaaagggttctacaatatttatttatatagttaagagacggattcttaacgggggtaattttatccaccagagggcatttggcaagatctggagacatttctgactgttacaactggggagtggtgttggtgacactgctggcacctggggggaagaggtcagggatattgctaaacatgttacaatgtgcagcacagcctgacaacaacaaattatctagtctaaaatgtcaatagtacagaggtggaaaaaccctaatttaagatatgtactctacctgctttccaaggaagcttaacaaattaaacataataacaaaaagtaattacaaataaaagtagaactgaaacagaatagaaggagcagaagcaaggatgtcactggagtcctgaaatgacttaatcattagggttgaatatttgattgagttctgtatttcccaacaaatgagaaaaaaagaaacagttcttgggtagcccccccccaaaaaaaattgatacataactccatcagccaagaccacttttttttcctgccattgattttaaagagaaatatatcttgtagggcattatatgtgggacattgtataagaaaatagataatttttcaaccacggttttgcaaaagacacagatgtgtgtgtgcatgtgtttgtgtgtgtgtatgtgtgtctctttgtgtgtgtgtgtgtgtgtgcaaatggatatttctggtctaaattctctactaaaacggtagcagacagtataacattaggttttgtgagatgaaattcatttctttgagttgcagaactaatacattctgggtattgtctttgcttgtgatcaaatgaataaagagtcgtgtctctgaagatccgagagagagaaagaacgtttccatcgaactttgggaatctctccctggattatcaaatgactgcaacgagtctttggcaagggctaaagagtaatcaattcatggtagcattttccagtgatcatccaaagtgtttgaaatcatttgatagtgtttattcctagtctgctgtggatcagtctatttgttaggctttggggacaaaaagattattaaaatgtagtccctgttttcaagtagcaggagtctaaccctggcaagaacatatataaataatcatgaattaatacacacagtcgaggaatgtgcagtgtgccatgggaacccaatggaagaagcgaagtttcactgaggaaacaggagatttgaactgtgtgggttattgaagaagtcttcacaagtcttatttgtaaatacagctgatccttgaacaatgaggggttaggggttcctaccctctctgcaatataaaatctgcatatggctgggcacggtggctcacacctgtaatctcagcactttgggaggctgaggtgggtagattgcttgaggtcaggcgttcaacaccagcctggccaatatggtgaaaccccgtctctactaaaaatgcaaaaattagccagacgtggtggcgcacgtctgtaatcccagctacttgggaggctgaggcaagagaatcgcttgcaatctggaggtgaaggttgcagtgagtcaagactgcgtcactgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagataaatttttggagttaacgaaagtgaaagaaaatgagagtatgtatgaagttctcatccattgcatgtaaacatgaaagcctataaattgtaccacctctatggagagcaatatagtggtgtctattaaggtggaagattccaggctcttgaatcatcagcttcacttctaaatacatactctagggaaattctcatatacgtgcatgagactgttcattgcaacattatttgttatgggaaaaaatcagaaagaacatacccttatgagaatagataaattaattatgggataatatttcagtaaaaataagtgaaatgggccaatatgtgtcaacatggataaatctcaaattttggcaaaatataatttatatattgaaattcaatcaaattcaagcttacagcaacaataatgatatgctgacttatattctagtatcctattctgattgcaagataaagaggtggcagccaattgtgcacaactttggggattatacccgcatggaagaatgtcgtgtatgtgagcatcattgtttggtgtgttaaagtgaaaaaaggaaggttgagaaccattactctagagttttgttgttcaagtagtgatcaattaggaagaaaaattttcatgaactctgtcttagctcaggctgctataacaaaataccacggactgggtggcttaaacaatgggaatttatttctcatagttctggagactggaaaatccaaaatcaaggtgctgacaggattcagttcctggtgaggcctctttacctggattgcaaatggaccctttcttattgtgtcctcacatggcagagagagagagagagagagagagagagagagagagaaggagggagggggaagggggtgggaggagggaggcaccactctggtctttctcttctcataagagtactaatcccatcatggggtcccaccttcaagacctcatctggacctaattatcttccaaagaccttgccttcacattccattacattgggggttagggcttcaacatatgaattttagggggatacattcagtccataacagattcccagtgttgacttactctaattttactgaaatagggctatagttatttatgtaagactatgaataaacttcttatgttcagaaatcttatctatataatccaactaagttatttgtatcacacaaacatggctggatgtattgcattagaaatttatgtttctgatgatcttacttaaaatacaggcttcgtagcatacagtaaattcactttgatggccctcagggaaccacaaaaagttaagtcctcctcctccacagcagttgaagccaaagcagaagaaagaagatctggtgatcactaaaccaataaaagatgtatccatagcagagaaaataaacagaatttcaaatatgggccccaaaagaaagtcaccaaaatagtcaccacaacttgtagggctgatgtgtgatacagcttcccactaagcagctctttggtgctacaaaataaggggcaggaggatttatgtattttatggataatgattctctgggatattcctctattgcattgaaaccacctactactaaatctattaatcaaaacaaatactttatatgtaacaatcagtaagtttcacagtagtaatattaatttaatttgacagatgatttggctttgttaaaatccagtgatggatgtatggttaaaaaaaatgaagacttgggtccaactccatgctttgatttcaataacacaaatgtagaaaatgtctgtctgtataagaatgctttaaaatgttacaaataagcacaataattctttttttttctagttcaaaataatctgaatacatttaactgaaatgaatcactctcaaatgtcaactgtaatgaggaacacttgataattttgtgaatgtccctcatttatttgaatataaagataacacacagctttttttagaatcttatagtagcagatatataagataataaattttgtaataagcagtagctcattcttgtgctaataaaatattacaagcacaaaaagataggatatacacaagaaatcttcctgtgtatcagctaggctacttttggctgcactaacagagtacatgattgaaagttgcttaaatagtaagaacattttttatctcacataagcatggcattagatattactgtgtaacaaattatcactaacttagtggcttaagacaatacatatttattatctcacagtttctgtgggtcaggagttcagacacagtttagctgatttctttgcttcagaagttatatgaggctgcagttaaggtggcagcctgagctggggtcttatctgaaggctcaactggtgaaggaaggccctatttaccagcttaccctagttgtttgcagaatctccttaaaggccatttgactaagggcctcaccttctcattggcagttggctggaggccaccctcctccactccttgcctcatgggtctctccaatatggcagcttactttatgaatgcatgcaagccaagaaggcaacagcagaatcaactgtcaagacaaaagttacaattctggcaatgacgtcccatcacctttgccatattctatttgttagaaggtgctatggagtctatttgttacagcacctttgccatatttgggtagaccagctcacgctcaaagggaagagattgggtaggggcataaataccaggaagggaaagaggagaatccttaggaccaccttagagtcagcatgccacagacataaacctggagcatggttccaggattacctcagggactcagtgactacatttacccagatacagttcatctctcttccctggctcagagatgtctctctccatgtagataggctacagccttaccaggtgctgtgtgaaagagcatactcaggtgaagaaaagagggaatttcaatttttgttattttggaaaaaaacctttcccaaaagtctcctgggagaagtcccgtcaagtctcatttatcaggattgggttgtgtgtccatatccacattgcaaaggagtctagggaagtaagggcaaggatatggcatttttgccctcagtaggaggtaagtctctgccagagagaaaaggaaaggggtgggtgggggcagaggctgggaatgttccaccaactactaaaagacagacttctttaagggctaccttgtgttaacatgataactgaattttctgcctctattctccttacttgagatgttcattcatatagtgcgctatgatgtcattgggtctttacttggctcaaacattattgtacagacaaatgcaaatataggtcctgagactgcctgaggttctctattactgatatgattatttttgttccaatatttcctaaatatgttaagctagttataaaattcttattcttaaatctcttatctgtaaatgtttttctttttgtacttcttcaaacaaaagtgactggctccttaacttccaaccatctagagtcatttatttagatatgcaaaggtaatcatgaaaataaaaatagatggtagaatgagcctttgatctaccctggcttttctgcaaaactccccagataagtacacaaagggtgagttgtttacaaaaatctctctgtaatcagagcaggacctgtgaccttcagcaccttagactatggagggttccagacttccttttcaggttcctcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaatatttcatatctggctttttgcagaaagcatttgccaacctgtgctctaagctgaagaagacagattgtttcttttgcatttaaaattccaatagcgttctttccttaccttcttttccttctgctattgttcaccttggttagtgcttttgttgtcatacacctgaattgactcagccatctcctaattgggcctcagcagctattcagagcttctcttctctgaagcccttggttcattgctgttgtttgagcatctgaagatcttccttgtctagttctaaattctttctctttatttttctatgctttttacagaaactcatcttccctgggtgggctgagagcaaacactggctcaaatactttacccagttttgcatgtatgattcattaggaacttctcataaactatctggatttaacagttatgtcttactctacataagacctagatcctctatagattattataaaatcattgcacacaagaattatgtcttacacgttacatctgataaaatgcttaacgttgagttgagctggacagagaggtatagaaggtgtagaccagcggtccccaacctttttggcaccaggaacctgttttgtggaagacaattttcctacagaccagggttgtgggggggatggtttcaggatggaagtgttgttccacctcagatcatcaggcactagttagattcttataaggagtatgcaacctagatcacttgcatacacagttaacaatagggttcacactcctttgagaatatcatgcagccgctgatctgacaggaggtggagctcaggtggtaatgctcgctggtctgctgcttacctcctgctgtgtggcccggttcctaaccataccagtaccaggccatggactggtactggtctgcagcccaggagttgggtacccttggtatagactgttgataggtctttgtgacaagctgctttactatttaaaaatgaaatagagctttgtttcattttatatcgtttttaatggtggtgattaaagatactttaaataaatttaaacttacaaaaaggtcgaagtaatggtataaggaactttttctctaaatcatttgagagtaagtttccaacctgatgccctatccctcctaataatttattgtgtaattcctacaaaaaataaccaaaatactaccatcaaaatcagtaaatgagcatggttcctgatagccatttagtccctatgctctaacaagtttaactaattgtctaagtaatctcctttgtatcaaaaagatctagtccaggatcataagttgtacttggttgtcatatctctttactctctttatatttggaacagttcttcagtattttttgacttgcatgactttggcattttttgaagagtattggagagctgctttgtagaatgtaaaattgtatttgtctgatgattccttataattaacttcaagttatatgtttttgatatgaatatcacatttgaagaggtataaatatcccattcgtcatcaaactttcactcactagttttagtggtgtttcttggctaaattaattattactgtgttagttgacatttgataattttctatttccatcactcctataattattatttggcattccattacagggaaaacaattcatctcttcctatttgttcatttatatcaccatggactcatggattcctattctattcagtgggttagaatcctttactttcatttattttgatgctcaaagggtcccacatttagcagtgggataaggttgcctgataagatatagaacacccagctaaatttgcatctcagataaacaattaataattgttttagtaaaatatgtctaaaatcttgcatatacatgcttaatattgcatggacatacttaaattattagttgtttaactgaaattcaagtttaactgggcatcttctatttttatttgctgaatctgaagccctgaagtgggagccccttcaagatgcttactgtgttctttcaatatgtccccatcattctttgaatacttccttgatttctggcccaacaaaatgctgtagcctcacctcgtacctttcttgctccagctctcaagccacttccccaaagaaacctggctctgtttagtgtaaaatggtatttagaaaccaagatctgtacacagagtatactcattactgttgaatgtcacaactcttagaccttctcagtggagagatccagggcaatctatgtatttatctatttacacatatgcatatatgtacatacatctacatatgtatttacttctgtatctatctctatgtattgaaaaatcatgacttcacaccaatgcttctaattccaatctagtaccacatgaacatttctcattttccttttctacttctctaacagtgagaaatgtggtcctcccaccctccatataaccataattgatcaattacccccatatgtacccaatctcccattgccaccaccagcctccacatccctacacggatgctttgctcacctttcttgggctctgacaccccaccctgtgcttcctctcactgcctcaggctccaaaatcccataccaagccactgccagtaccacttctgccaacgtggcacatgggcaccttattcacctgattcaggcttcaacatcccatgccaggccagcatcatcattcccctgtgtggatgcctcttcatgccacttgggcttgatccccagcaacagaccaccctgagtgaatgccctcctcatgatacttgatacactgtgctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaatgaatatgtagagagctaaagtttctacatatgcagaaaataaattttaattctcctaaaaaattattttctcttggctcttgaacttacttaacatctgatttaggattcacccatggtaacccaatgattgtttggggttttctacctcacctagcatgacatctgggcaagtttattttcaggtcactataacccagagttttcttgcaagagtatggtcaaaacatcatttttccttattaggaggtggcttgtgtgtgttgagctcacatttcttttctcacaggcttctcttgctctcatcccctgtgcagacttaatcatatgcctaccggtgatttctatatactgagatcaaaatcagcttctgtttcttatgctatcaaataaaatatctgctctgtaaaactgcttctacatataaaagaaagaatcggggaccagctcttcaattggtatgaatgagttggagagaaaaggcagtaaggcacccacccataggcccccaggggtcaggaagcaatgttcgatgttttccttctctcaccagctagctaaattcttgtggaaaaaatcccttcctcacgaacctgcaaattgaagagatgtagcaactgggctcactgatcctacccaccccaatcctgccccaagtcatcacagggaaaatgagcagtgcatgtgtgaatgggtatggcatataaaattatattttcatttagcatttattagagctgattcaaaaaatcacatgaaactattataaattgctgaacagtttcaaagtttattttgcttatgtgtgtggaagagagacaaaagtagataagaactttaaaaataatgtttattgcatgactaaaaacttgggagctgagaagggagaccaacattatgtaagctcagaatatttttggaagttaaatggcatttcctacaattttacttccaatgcattcagctgatcacctctctgaaaacaccttgtgccttgcataccttttttggaagcttacttctccctccctcttctcttctaatactctttccgtgataaatcctcattcatcctggaagactaggcattaaaaacattttctgtatgaaacttgcagtggctttcaagtgagttcattagaacagtggtcatgcattagaactacgtatttacactttgtctccactattggctgtgaacttccagacaggggaatgttacatctcattttgttttcttttacttaatgttaaggatctcatatatacataattgggtaattacactggctagctcatgacacctgagtgatatgttttttttttgttgttgttgtttgtttgttttccattctcagtgaatgtcttcagtggcattgagcacaagagtggctaagaatggggctaaggacttaggcacacctggtctgaatccctgctcacccacttaactgtgtgacttggggcaatttatgtaactttttgagcttctgttttctcaaatgtaaagttagaaaaataaagcccctatttaatagtttttcttttttatttctgagtgttaaatgtaatattgcaaactaaatgctaaacatgatttatatgacaagaagcagccagtaaattttagctttttaattttttaatggagtggggctcaacagatacttaatgaatgatacagccattaagctttttagaatcccaattatgtatccaatttgttttatttattttctttttctcttttcttttcttcctcttctttcttttccttttcttcttctcctttctcctctttttcctctttttccttctcttcttcctcctcctcctctgcctccttcttccttttttctcttcctccttctcctctgctctcatttttcttcctcttcatcttcctccttgtcctcctcttcctctttcttctttttcttcctcttcattatcatcttccttctctttttcttcttcctcctccttcgattctccttcctcttcttcctcctcctcctcctacttaatcttctctaaaattctcctctctctctcctttctttcccctttcccctcccctgccctcctctcttttttggacatctctgagcacagctgctgcacataccagggcaaagctgcatcagatgccaaagtcttttcaagggaagccagttttcaagctcgggcacactgacttttaggatacaacccaaatactattaaataacaaaacattaagcttctttgcagataagcctggaataccttattctctaggtttttaaatttaagagaagtggaaccaggcactttacaatttgaaatgttatttcaaattattctcatagcagccctgcataataggaattattattcccactttacagataagagagttgaagacggtgtcactataagaattaacattagtataagagcagtctctcagctctgtttccctccctgctggctttaacttcttccactaaatatgtctttctccctatagtcataaaagataatcacaatccaacagagacatccatccctacagctcatgatcccaaaggaagtgagaccatttctattacaacatccaatttattaaccagtttcatgggagggctatgattgcctttcatctcaggatattttcattggtaagcagaagagtaatcagcagtggcttaagtgaaaagaaaagaaaaaaaaaaaacatttgattatctcacagagctagaagtttggaggtaaggggctcttgggttgagtcagtgactcagtgatagcaggagctgagcagtgtcttgtaaccctcttgagttcatgctcatgattgcagctccaagcatcacttcttcacctcagcatcataaggaggaagaaaggatagaaaagaggtcattcctctgacaacactcttattttgggggatagaagatctctactctaaaacccccagtggacttctctttatatcccattggccagaagtggggcacgtgtccactccaagaccaattattggcaagaagcgacggagttaacatgagtggtttacaacaatcatggctcggcatctgaggctaagtgaagggacagcttttcctgaaaccaaaggttcctgcctcttgaacacattgcaagttctgtgtgcatggcaggagagggtgtgtgtacagatggttgttggtaaggcagtggtcaatatctgctgcagcccattttgggtcatatgtctatccctcatatctgctgagggcagcacgaagagttctgccttcgactgtgttcctctggtgcagtctctgagagtaggattaacaggaaaaggattggtcaggaaatattcttgggaaaaaatggtagaggaagtgggatgaagaagagagggaggctccacagagttcaaggtctcataaaattcaccccccagaggataacttaagtgcaactccacagagaagtactggggacagtgtagaccccactcagtgctgtgttccccatcgggattaccccaccaacactgtggggaggggatataaatttctgggcactcctggttcttcacatgtgcaggcaaaagagattctggaagtctgtgggtagttctctaaccaggagacacaaggctggccgtttggagtaagagcctgttagagccactaagcataacactggggacttggaggggatatgagctgagccccaaggacatctgccacagggtccatgacagtccagaccagcatcaagtctgcaccccagagccacggtgtgggtgggcattgcttgatggttgccaagtgaaccaggacagtatgagcacaaggaaggtggccccctatggaaagaaaaatgctgagaggtcaacatctcaggacaccaactcatcagccctctgcacattccccaaactcattagggtgcctccaggagaggtcttacgtgagaacgggaattttggctgcccaggtactgtgtggaatctgctggattctctttatctgcagctgctgggggtacgccagctgtcagtgatgacttctagtgccattcctcttttccccatttaggcttttcttactttttagctgagagtagagtttctcctccccaagtactattgatatttgaggctgaattattcctcactgtgggggactatcctgcgcactgtagaatatttagtagcatctctggcccctctccacttgaagccaattccaccagcattcccccaccaaagttgtgacagatatcccctagaccttgttaaaaccactcctggtggagaaccaccggcttagaacactgggctcctgcaactgtagcttccaggtttcacctgctaaattgggggaaatgccctctaagctgtggaactctatgaacttcatgggagtttgccagatttagtgtgactcttattcttagtgagttaatttgtcatttgtgtcttgtttcctctgtgctaggggaataaagaatactggacctgtattcagaatttcctctcccttctcacatttacctgccattagtgagctgaggctttctttccttagaattagggttgccagattaagcaaataaaaatacaggacatccagttaaattggaatctcagaaaacaaacaatgttttagtaaaatatatcctttgcaatatttggaatatagttatactacaaaagtatgtgttctttatccaaaaccaggtttaactgggtgtcttgtagtttatttggccactgtacttggcacacattctttctctaaggactccactaggaaatgcctgcattactgtattctggtgcactcatcgtatccttcaatcatggagtccccactctgcctgttggttagcttgtactccactcaccgtggcaccacaacttgggctgtttctatcacagcactttcagcattgctgctactttccatagtgccctgtcccttcttttagcttttgtgtctttctgcaaattgattatatggagttggattaaggcctgcagtcattatatgtgggtgtgcgtgcatgtgaaaaaaaattactcttagcttccctaagagaagctcatgggaatcgaatcattgagtaatacagccacggaggatcctggggaaggaattctccagcattccacagtagcccctattctgaaagcctctagttagtatcaccatgaaaatattagagggagaggaaaaaaaatcctctgtaaatagtagcactccaggggagatcctagtaatttgcatttttaagaccagatgcagttaacctttcatatattgtacatattttaggatgatttttttctaaaagatttattaatactatcattgcctaaaagatcagctgatttgtgagttatttgaataaaacaaactaaaaaataagggaaataaatgttgcttgtcatcttccttacattcattgtggcagaaagggcagcaatgagctcttgctagataagagaactacagcagaggtacaggatgcagcatcatgggaaccagaattcatctgagagactcaataactctgatgattgtttatttagtaacccaggggaaatttggcttgagttacagtgtgtgtattgctgagttctttctgtgtgtcttggttatttcaactaaaaaagactggggggaggaaaagcagctaacatgctaaaactgtaatgattacttaacattacattttggaaaaatggctttactgaaatgtaattcacttatacaattcacgcatttgaactgcataattaaatggcttttagtatatttacagaggtgtacaaccataaccacaatcaattagaacatttttatcacaccacaaagaaactccatatccattagccagccatcactccccatttctcccactccatacctactcatcctcagcccctggcaaccactaatctacttgctgtctctgtggacttgcctattctgcatatttcatataaatggaattatacagtatgtgattttttttggtttctggcttttttcatttagcataatgtttttaaggttcatccatgtcgtatcatatatctatactttattctttttgttgccgaataacataccattgtgtatatcacattttacattcatcagttgaaagtcatttgtgttttcagttttgggctattatgaatactgctgctatgaagattcacacacaagtttttgtgtggataggcaaaacgggcagggaaacaaactagagaaagaataaactgcagaaatccaagtgagaacaattaagagctcaactgtcgtacatttccctttcctttccttcccttcattattaccctgacttaatccttgcccagccttcctttcattttcacagtatcctgctcccaccctaagcatgtgtatttcaaggtaaggctttttgtggagccaaattgaagggggatcacctggccagatttgcaaatgtaaaggcagactggtacatagattctccctccacggtatacccccgacccccagtgaatttaagaaccaaatttaatatatagattagctcttgattaagagcagtggggccaaggttcacttttagtctcaaggtccaggagagatgagcttctgtagcatcagctgggactggctacataattggcagaacccagtacaaaatgaaaacacgaggctccttttgaaaaaattattagaatttcaagatggcgagagatgagccttaaaccaagtgcagagcccttctgagcatggggctgtgtgcacaggtcatgaacccatgaagccagccctgaaaagagttctaagtttgaaaatatctagattccatctgccatagagtaccagcctgtaatcagaatgtcacatttgcagatacttcctaagcagctgaatgtatacaatgacctgttgatcagagggatgctaccctccagaaatgaatgtgttactaggtgtctccaacattaaatctctttggagctgtgttctgatgagctgaaccgggatgttgcccttgctggttgtacagtcataccacttcacatttcatgatagcaacaataaaacaccatgaaagatgtgttgcttcttgtgcggcaggcactgtttgtctcatggcctgtgagaaaccttccaagacacagcccttcaaactcaggaccctgtaagtcagattaactgtgaccacagactacatgagttgttatgagtaactctgggagaaagccgcctttcgttaaagtggagactgagtggattcaaatgcattttaaaacatctgtcatggccagattgccatttcaatagccccattgcctgcctggagcttttgcatgcatgagtatttctgctaggaaacagaaaatgtttggattcccaatttagaatcccttctatgagttcaaagagtttgggcttacactgctcagcagtctcctggttttgtttctttgtgccctcatgaaactagagctctgtgtcactttgctctaggaagaattttgttgttggtgaagaatattcttgatagttagcatctttgaaatctctatgaaaatgagaaattaagcacaaatgaacacaagctctgctgaactctcaaccccccaatctttctggcttcaaattttatttttatgggttttttttcatgctttgcaaggcacaatttagtaaaacacagcaatattaaagtgtacgtcttgaagaaatttgagaaatgcacatggccattacccagattaagatataaaacatctccatcaccccaggaagtttccttatgcctcttccagttagttcccctgctcagaggcaactgccatcctaatttctatccacatagattagtgctgcctgtttttgaaatccatataaatggaataatactgtatgagttaatgtgtctttcactgtacgcaatgcttttgagactataagttgttgtggacatcattagtttgttcctttattgccaggtagttttccattgtatgaacacaccacaatttgtttatctactctcctgttgatagatatttggggagtttccagcctttggctattacaaataaagcttctgtgaacattcttttacaagcctttttgtggacatacatactcatttctcttgggtataaagctaggagtggaattgctggttcatagggaagctgtttatttaactttaactgccaaagaagttttccatcaatgtacaggagttctaattatttatatctttgccaacacttggtcttgcagtctttataattttagtcatactgaagggtatgcatttatatctctttttaaaaaaaatcacttttattgaagtatgattagcatacaataaaatatgccatcttaagtgtgtaggttgactaagtttggcaggtatatatatccatgtaaccaccacatcaagatatcaaatatttccatcaccataaaagaaactcttcatgccccttcccagtcagtgcctggtagcaggcaaccactgatctattttctgaccctacagattagttttgtttgtctagaatttcttagcattggaatcatattgtatgtgtattttttggtctagcttctttatctcaacatatttttgagattcatgcatgtccttgtgtatttcagtaatttctttttattgttgactcatattccactgtacagacatatcacaatatgtttacttgttcatctgtggatgaatatttgagttgttttctgttttgtgctattatgaaaacagctgcaataagcatttgtgtacaattcttttggggacatatgttttcctttctcttgagtaaatacctagaagtaaaatggccgggatatatggtaagcgtatgtttaactttataagaaattaccatacagttctctaaagggttgtcacattttatgcttccatcagcaaggcatgagagttccaattgttccatattcttaccaacatttgtcattcatacagtaatcatacagtatagttttaaattctagcaagtttagtggtatctcttgttttaattcacattttcttgatgaatagtgctgataaatatcatatcttatgtgcctatcagccatttattatcttattttgttaagtttccaaatcttttaccagcttgaaaaattgtttttttttttttatcatatttgaagttctcataactgaaaaattgtcaatttttgagttgtaagatctctctgtatactctggaaacaagtcacttgtctgatataagtattgtggatatttttttcctagtctatgtcttgccttttcattttttaatgatatctttcaaagagcatgaattttaaattttgatggagtccaatttttaatattttcatctgttcttgttgggtttttcttgtatcttaagaaatctttgtataccacaagattgcagaggttttcttctatattatcttgaaaacattttatagttttaataattacatttaggtctatgattcattttgaattcatttttatatatggtgtgaagtagagggacagtttaattttttaagaaaacattgttataccatcattttttgaaactctctcctttccccattaaattacttttgacacctttgttgaaatcagttgactatattatgagtctgtttgtggattctctattctgtcccattgttctatatgtctttcttcatgcaattatcatcctgtctttcactgtacacaatgtcttgatttttgtagctttatagtaaatcttgaaaccagacactgtaagtcctataatttggttattcctattcaaaatgtattggctaatctgggttcttggtatttcaatacaattttataatgtctgcaagaactgatgatgggattttgattgagattacactgaaattatggtttgatttatttgtcttttttctttcctcagtaatatttttaaattttcagtttttaggttgttgtgtatatctggctaaatttattcctgagtggtttgtgtgctttgattaaattatacgttgtattgtttttctggtttcatctttcaatccttcattgattacaaatagaaattcagttggttttggatattaaccttgcatcctgaggccatgctcaatctacttatagctctagtggctttttaaagtagatttctggattttcttcctacataattaatacatgattgtcttttctgggaaaaaaaaaagcttagtatttctcctttgttttcaatgtgtatgtcctttatatcttttgattgccttgtaacactgtctcagatatcttattcaatctctctgtggctttaatatgcatctccttgctgagcaccttttcatatttattgacagtttgagtattttgagaatttctcgatcacgtcttttttcccattcctattgttttgtttatttgcattatttgtaggaattttaaaaatctaaatacaagtccttcattagacatgtgtttttaaaaatttctcctagtctgtggtgctttttttttttttacttcagcaatgatgtcttttcatgagcaagagttgtttttgtttttaatttgatgaagtgtatcaaattttatattctaggaaatgttttcctacctcaaagtcgaaaagatattctcctgtgtttttgtctggaagcttttaagtttttagatcaatgattattttcttgaaagctctgtgtgtgtgtgtttgtgtgtgtgtgtgtgtgtgtgtgtgtgtgtgtgtgtagtttctttaatattacactcaaatgctttttaccatttttatgggtaactttggcaaagatgaaaattgtataatatataatgctggtaattggattgggaaagaaacactcaagatatgctgctggaggtgcaaatgcatacaacttttttggcatgggtaggaaaaaattcagtaataagaatcaaaagctgtaggaaccaaaagccttaaagatgttaattcctgaaactctataggttcatatcaagacatttatcctgtagaaataaccctgggtgtgtgctaaaatttagcttcaaggatgtgttatcacagtattttttaaaaatagggcacaagaagaatggaaacagtctataatagtggattgattaaatgatcatatagcgctattatggaatactgttaaaccactgaagataatactgcagaatattgaatgcctgtctttgtctgttttgtgttgtgataaaggaatatgtgatgctatgtaatttacaaagaaaagagatttatttagattatggttcttcaggctataaaagtactatggtactggcatctgcttggcttgtggtatgggcttctgtgctgtgtcaaaacatggcagaaaaggtcaaaagggaagtgggcacatgcaaagagggaccaaacccaggagtatcctggatttataacaactcatttttgggaaaaataattcattcccttgagaactaattccatttcacaagagctagaactcactactgcaaaaatggcaccaagtccttcatgagggatctgcccctatgactcaaacatttcccactaagccccacctcccaacaccaccacactgaggatcagagatcaacatgagatttagtgagggcaaacaaactgtatccaaaccatagccatgccatagaatgccacactttaaaatgaaaggcaaattattattgccatttgttcactgctttataattttaatttgtccctttgattgcatatttttattcttctgtatgactaagaaaaagggcttcttgtcccctgccaaagagttgaaagcatgccagagaagtgccaccatccaaaacatttctcttgctgtctagcattccatcttctgagttacaatgccttggtccacttataatttggtgagatttatacatccatttaaattttcattagctggatatggaggtggatgtaaacaagaagcattgattagatctagaaaaggtggtatgtggacccaaagaagcaccaatagataacgctgtagacagacttggggatgaaactgttgtgtactccctggaattttgctgactcagctgtggtgtggtgtgagggtgacacctttagaagactgtccaggtctctttggagtagtgtgtgcttgtcaagtttacagcttgtgggaaagggtaatcagaacatgcaaaggctcaatcaacctttactgaggctccctcaggcatggtactcaggcttcagggcccagagggtacatattgaatttcactttgcaaagaacccagcattagagcctggaccccaggagcttgggtctagtggagcagttgagcagccaaaaggagtgttgagaaggcagctttaacagggcatatgtgttcaatatcaactgaattcagaaggtcaagctgctggagttcttcatctgattaaccttcatcattcaaatattctgtgctatagcttttcaacaggaaattcacatgtacttaaaatgtactttttttggcccaaactgtctaaatgtgcattgtgttagtttcctagggctgccaaaacaaatgactacaaactgggtgttttaaaacaagagaaatgtattctctctgtcagttctggaggccagaagtccaaaatcaaagtgtcagcagtgccatgatccctgtgaaggtgctaggggagattccttccttgcctcttcctagtttccagtggctcctggcaatccttgatgttccttaacatgcagttacatgactccagtctctgcctccattgtcacatggacttctttcctgtgtgtgcttgtgtctgtatgtgtcccctcctttttctgtaaggacacccttacaaatttagggccctcccgaatccaatgtgaccatcttaactaattacatctgcgaagatcccatttctaaataaggtcacatacacaggtaacatggggttaggacttgaccatatctttttgggagacacaattcaacccgtgatttcaatcactgtttaaatatcccttttggggttactatgttgtactgtacattcctctttcttgcatttttgacccctgtatgtaccatgtcttttgttcataagatgactctgagaaaccccctaggctcttctctggaattcatgatgaagataattcttgggtttctataatcatagaaacagaatgttcagctttagctcccgagagacttcaagtgctggcaatgtttggagggaaaccggatgtgagaaaatggtagggaggctaagggaagatgaggtttctggccatggagctgactagggcagcggtcaggggtgacctattagaagatgagggtacagagtggggccaagaattagagattgagcccaaacaggaatgcagcacatctggcctagttggaggcaggggtggatctccagcagaatatagacaatgggacccatcttggcagacacctaaaggagaaggggaacttgttgtccatgtccagtctattagcaaggcctcttacctccacatcaccatgtgacagatctgttcagtgactcccatttccttcactaaaaccctatttctgctcccacagtctttctcctagactaccaatttccccttctattcaggctacctcaaattgttctccaaagagcaactgaatcatcttttcaagcataaaccctaagttgctgtatgatctggcccctgctcacgcattctgtgtcatcacacctcagtcactctgttttctttatgttcctttaacacaccaagctccttaccacctcaggaacttttcacccgctgttcccactgcctagaactctctgccctcatatgtcaatgcctgattcttggccttctccccttgaaacaaccttctgtgaccctccagtctaaagtggtgcctctccatctctgtccatcatccaattttattttcttcatattgcttaccactatgtgaaattattgaattcatttatgtcagtggttcttaacatggagggattttgtctccccagggcaaatttggcgatctggagatttttttgttcttacaactggggtggagggtgctaccggcatctagtgggtggagaccagggatgctgctaacatcctacaatgcacagaaccaccctcacaacagggaatcattcttcccccagtgtcagtagtgccaaggtggagaaacctatttatttgttgcttttgtattctcaaatctgtgcttaacccttttgaatgtatatcccaagaaagcaggaaagcaaactggtatgtgtcttgttcgttgctctgtctctcccccagaacaatgccctggtcagagttggtgatcaaaaaataattgatggattaatgaatgcgttaatgactgaatgaatggtctcaagccctggatctgtcctttcctagctttttgagcctggggacatgtttttaagtgaattaagccattgctgacctggttcagcctcagtttgaggtaggccctgtatccctgggtctcaggatcagactattacattgtccttcccccaaggatgattccctgcatcccccaggggtacagagatttttcattatctttttcagattacagaaagaattttaaaaatgtattactttagacaagtctgatatttttatgaaattaattatttccatccagcaataggatatgattcatttacttcagtcttctttagtatcatttagcaaaattttataatttattcacatacacaaacacatgcacatatcgttaatgcacatttctgaataaagggattttcatttttcctattgttgtggtccaaaagtagactgttgagttttaaacatattttttgctatatttaaacaattctaattaaatcctttaatggttatgaaaataatagtaatatatttccaagtttacaatttccatttttaattttctttgatcaagtgattttttaagaagaatactgttgtttcttttttatttttaactttcaagtgtgaaaggcttttgttactgttgttgtttctggttattttacaattgtctctttataattactacattctttttaaattgatgatgagctggtctttatattttagaataattttagatttacagaaaagttgcaaagattgtacagataattcctgtataccctgtacccagtttccatttcttctaatgttatcattttactttactgttctctcatcctgttttttatccttgtggtgggccaaacctttcagagactcagctactaaaagatacattttatatttaatatgaatagagaaacctgtatatgcaaacaagaaggaaagttgtctaggaaggaggtagaagtaaagccacattgctgtttccaggtttgcaaggcccagttcaaaatgagaatgcagagccccttgttcaagaaatattaagaatttcaagatggcagcagcagagcatttaactcagcacagagccctttgtactgtgaagccctgagccactgcctggtttcatgcctgtgaagctacccctgctgttcctacagttgaaagtaatctttcaacttcttccatgatacaaatacctcagtaagttaagggaaagtgtcctgcacgaccaagctaaatctactcatatttgagtttttctagaacactcaaagtcacaagctttgcagcttgcctgccttctaaatctaagttcaaaaggctttgagttgaggacaatagtattagctaccctgaaatggcagtgaagctaattctaaaataacatccacattagctcacacaggctgatattttctttgctgaagatcaggcaaatggagtgtttgttttgagtgccttccaataatacttacaagtagccaagaatgcttgggctcttggaaactgtacctatgcccagaggctcttggtgaatatatttttttaaccaggtttactcatttaacttgtccaaatggggcactttcacaagggaacccatcagccagtcatttctgatgaaataccaaaaggacctgtgaggaaatgaaatacgagaggtcttggtaaactgacattttgaaagtatctgggaaatacattgctggaaattggtttagcttcatcatttatttatcaatgttcaacaacattgtatcttgaaatttgagggtacaatgtccacttacagtatttggttaactgtgctagccagatagcaacatacctacaacttacaacatacacaccatatgtactacataattccagttaggcccatcttcccttctgcatcccttctgcactgatgttctattcatcatggtgaaaaaaaggtatcctggatctgaggctgcttcctcctgtttatgcaacatgggcactggctctactgtggaaccgaatcccattagatagaacagatgtacccacctctctctcctgcctcttttgactcacaagtgtgcccccctagtttctgggaattaactcccactgagagcaaatggacaggtgacctatgagaatgacattgggataggcttttcttctgctattattcccttccttgtatgtaggcattgtgtgcaattagcgtgaaaatctaatactttacatcctcccacccttggaccttggaccttagttcctgggttgcaaagaggtcccaggttggaccttagttcctggggtgcaaagaggtaattgtcacttatagttttgggctgtattttagtggattagagttgttagaagtctgcaagagatttcaagtaaaagactcctcaggagactatgtcagcattctatgggcatatatgcatgcacatatctatgtaggtatgcacacatttgagtatagtatggtacttgtgtttttaaaaaatcaaatttgtttaaaacagtacagaatacgtcagttcaaagagcaaaatagaaaagtaactaattaagtttctagaattagaaatagaattgccttaaagattgctttgaatcatttatttttaataacatcatcacatttgttttctaagaaaggcctgatttatgtgcagattatcttcctagaattctgacatagtttcttaaaaagcattatcatattctaaaagacttaatttttgttgtgtcttagccagttcaggctgctctagcaaatgccatagactgggtggtttgaacagtaaacatttatttctcacagttctggaggctgggaagtccaagatcagggtgctggcagattctgtgtctactaaggaccttcttcctgatttgcagatgcctgccttcactcatatcatcatgatcatctctctcatgtttcttctacattagtgtctttataagacatgaattccattcatgaaggctccaccctcatacctaattacttctcaaaggttccaccctcaaatactgtcacattaggtattaggccttcaatatatccacttcaaagggatacaaacattcattgcatagtaccttgacataactacatttttgtggctttccctttttgtcatttagaaattgccacttagcatcaattctgtgtttcggactttgttggaagaaattttctcaaactggaaagcaaaaaacagattagaaaatgttttctagaagtcatttcagatattttaagtacttctgctactaaacagataccacttgattaatatttttgccaacaatgtccatctcagataaatgttctttacattttaaaaatattacttttcattaactattgagtagattcaaaataaaatttgtggttaagaaaagaaggacgtgatggctagaacactagaaggtaccaggatttaaggaacagaggtggaagagaaaaagccgatgaaagagagaaggcagaaggctttagaaagattactgtgaaatgaaggggcaggggctgagctgcattcagcataatttcttcaaatgtatcatccaggttactgattcagctatgcttaatctacctttgaaactgttcgttgagtttcatttttgtttcatttcttattatattgaaatgtatacacacaaaagtatacaaattataaatgtacagcttcatgaatttgcaccaagtaataacagtcatataactagcaccctgatcaagaaatagaacatcattggaatcctacaaacctcccttgtgcccaatcatgatctccaacccaccatctccaaaggttgctaatattctgacctctaccaccatcagttagctttggccatttatttatttatttatttatttatttatttatttatttatttatttattcattcatttaagacagagtcttgttctgttgcccaggctggagtgcagtggcacaatcttagctcactgcaacctctgcctctcgggctcaagtgattctcctgcctcagcctcctgagtagctggaactacaggtgcatgctaccaagcctggcgaatttttgtatttttagtagagatggggttttgccatgttggccaggctggtctcaaattcctgggctcaagcgattcacccatcttggcttcccaaattgcttggattacaggcatgagccactgtgtctcaccagctttggccatttttgtactttatataaatggatatctacagtgtacccttttgtgtctgattctttgcttatcgttatatttgtgagtttcagcctcagtgttgcattcatctgtagtccattgctccttgttgctttgtggcatttcattctatgtatataccataatatatccattctactgtgatttgtgttaagagttgttttcacttgcaaagtttaaggtaggaaattttcctgcctttggttgagagagggctgttctcccttaccataaagatacatcctttttagagacccagagtgtttttttttgtttgtttgttttgagacagggtcttgctctgttgcccaggctggagtgcagtgagccatgattgtggtgagtgctaccacatccagctaatttttaaatatttcgtggaaatggggtctcatcatgttgcccaggctggtctcgaactcctgggatcaagcaatcctcccgcctaggcctcccaaagtgttggggttagaggcatgagccaccatgcctggctgagtcccagctttatgggaaggactgtcccattcaacttgttaccatgggcaagcctagaattcgcattttgtccactgaatcctgtgaggtcaggaaaacagaatttagattcaccacattcaacaaatgacttcaaggcaagcactggctgtagggctgcaatgttcttcctgattattttgagacataagtgttctttacttttttgtccactcatgcatattttaaatagggctttaaaatacattatccaacatccctagttgttttctgtggaaggctggtgtgggtattcattctgccttactgtaagaaacatatatagacatgtactttaaaaatgccccttgtgtttgggtgtggtggctcatgcctgtaatatcagaactgggggaggttgtggcaggaggattgcttgaggccagggattcaagatcagtgtgggcaacatagagagacctcgtctctacaagaaacaaaaaattagcctggtgtggtggtatgtgcccatagtcccagctactcaggaggctgaggtgggaggacagcttgagtccaggagtttggggttacaatgagctataattgtgccactgcactccagcctgggtgacagaacaagactttgtgtctatagagagaaacaaaaaggcccctggatttgtgaaaccaatgtatctattataaaatttaaaacaagtgaggtgtggtaatagtttttttttttttcatattctttctcaacctatataaggataccaaagaggttataattttttaccgaagttgtcctcttctggttttgtttgtggagagtaaatagtttatttcaaaggcttagacttgtgtcattttaatatttccctcacaaatcattttgagtgattcatgcacaaaatatttttaggagctactttttacattgttttgaggtaagcctttatgggtttccaaagatggtagtacaggagtcaggagtgaaaggaaatgtgtactctacaaagagaaatatgatcattgacattcaagaggcccagaaaaagtgctctgcaagttcaaaggagaagtttacttccttttgagtggatcaggaaagtctctgtgtaggaaaagacatctgaactgggcctcggaagatgggcagggttaactgttctcatggaggaggaggaagaggaagaggaggaggagaaggaagaggaggaggaggaagaggaggaggaggaggagacatactcgtctgcatgagttcaggtaggaaaatatagttgagtttgtctggaagaatgcattcatagatttagaactgtgctatccaacgtggtagccactgactaccatgtggcttttgagcacctgacatatggctcatgtgactgatgaattcattttaatttaatataatttgcaatgaagtgaaatttaaacttttaaaaaagtgatgctgtgttcagtttttggaaaagttttaagtacgtttggaacaacttgggtatgtgaatctattcttgcaatcatatattttatgaagtctaagtccagatcaagtatttctaatgaaaatccactgtccaaattgagatgtgctgtaacaatgtaaaatatcttattaataattatttatttacatcaattccatgttgaaatacgatttgggatatttgggttaaatgaaatatatagttaaaaagtcagtttcaactacttatttttacattttttatctgactaccagaacattttaaactacatatatggcttgtatcacatttctattggacagtgctactctacagagaaggttgaagcataaaatgagagtgtcttgggaactttagcaagttacttatcttctctgagcctaagtttccttatctcctgtggtttttgcttcatacaagtattgagagggcaaaattagagttgcacgcaaagcccatgttaacacagtaacaacgggctcaataattgggtatcattattcttttatttaaagggataaaaaggtagacaagtaagttctgtagaaaagggaagggacagtgagagtatctgatttataaagtatgtaatggcatgggcagttataaggatcatagacccgaagatcagtgagtaatgagtgatgcgtggcgacctggcaaacaagattaagaaagctgaaagataacagatgaaccgtgagggatgaaggtggtgcagtcagaagattgttctaggcttggaagccggttctgactttgccgtggatagatggggaagccagctcacttactatgtctctttgtagcatctgaagaatgacatggccagaccaggtggccacccagattactttagggccaggtatttaacttggtagaagaaatggaagacaaatttttcataaatgttggtgttgctccttacatgaagctcattatagttaaggaaacagaagcattttatctaaaggtaggtctaaggaacttgtgatgacgtattgaagaaaatgagcagtgaaaacaaagaggaataaagtcttgaaagaagagattggcacattctttagctttgcagttgaacttgcttggcaattactggagataaggaaaagaagaagggtttggccaaggtttgttaatctttataaacaggcaggaacatcctgtgccttttcccctgtaattacagtttatgaatatttgtttgagtgttaggatacttttttctttgccttttgatacatccttgtgtgtactccttgtttatctgtgacttagtttcagttttcatgtctatgtgcttcagaaagtcagaaaaattaatcatatgagcttaaaatgccgatcaagaaaagctcagcaagatacattgtattgaatgcagtgatttcttttaaaataaaatattaaataatttctgcttacctggaggtaagggaatagctttgtaaatattccttttttggagaaagttccactgtggtttatattcagccacaaagagggcatgcttcttatattatatctcaaggtggaattcattttgcatgtaaacaatgtgtagatgaggatgaggtttagccgcatctatccaaaaactcaaagtaaccatagctgaaaaagataggaagttattattttctgatttagatgagactggaatagtgacttcacatttacctgggacccaggtttcttcaagctccctcctccatcttcctagcacatgtctttcttctgaagggcatttcatggtttaagatggctgttgctttggcagccaactacgaagcagttgacttataattgaaggccatgttgtatttaaagaatgtatgacttcgaacactaaatgcggttcatagtttagcttagtgaggtgctgtctgtgggaagcacgcaaagacagacaccgactgaacaggcagttgtgatgactttaatggaatcacattttcaaagttatgtgcactcccagggggacacactcatgagtgcaatgtagcatgtaatcaaatgtttgaattacaggctgggttcagtggctcacacctgtaatcccagcactttgagaggccaaggcaaagggatttcttgagtccaggagttcatgacaccagcctgggtaagataatgagaccccatctctacaaaaaatcaaaaagttagccaggtatggtggttagtgcctgtagtcccagctacttggaaggctgaggcaggaggatcacttgagcccagaagtttgaggctacagtgagccatgatcgtgccactgcactccagcctgggtgacagagtgagaccctgtatcaacaaacaaacaaatgaaagaacaacaacaacaacagaaaaccacaatagttgaattatgttttttcataggcattctcccatttttccctccatcctccctctccacacgccccacccacaccttttccagaacacccatagttgaattcaaggtagatatatttgcacgttacgtaacttcactgtatagtgaggtctccctactcctccaacaccaccttccactctgctcaggtgatctttggatcctgcagttctgtactggatgcagaaagagagaaatccaccaatgctaatgggagacacctaaaaggaatcataaagtaaaaagatggatacccagatttctggctgggacagactgcatttctcagccatggggcagactgcaagaggagagatacaagaatacactcaagtactttcaagggtctcgccactaccttttaaaagccatttcagtcagccatgcagttagtggaaacgcctgtgacagtctagcaaagtgctggcagaggtccagtttttgctcacactttttagctttgatggtgtcaccataggtatttgagtttaaaagttggaagcaaatgcatcatagaatccttaccacacaacattataaatttgaatcccatgcaggtaaagcctttatattggatttgagggatgaaatggctgctttctaagatttggagaatcagaatgttatcccaaatctcattataaaaatcaaattaatcgatttggagtgaattgtcaaacacagcacgatggtaatgttttctttcttgattgagtcattaaactacaaaatcgctgctatgtttctattctgttattccttaaccacagctgaaataaatttggaaagtgttttcagacagttgggatggaggaaacacaaggacgccattactacactgtacaaacaatgcaaaggtcgctttcccacatcatcccaaggcttgctgttaatctgggacaaacacagttagatattttttgatggagagggcattgtcgtgggtggagaagagatgaggcagttcccttcgacccagctgtgactcagctcaggtcacaacttgtggccttaaatctcaaagagaattagatgtgtgtgatttcacaagttggactttcttttattgaacctatttctaaagcacaagaaggaaatgtgcagcctaccgtgcattaaaaggccagtagacactcttactatctgtatcccctggttccttttgtgtctcataaataaaatatctctacaaaaatatggaaaatatcctcgctctaaattaggaaagcagccttgctttaatttccttctctgcaagttggcagctgggtaaaagaaaatattttgacttccagagatgctattgtccctccttcagcctccctcctagccctgggcttcaggcagtctgcagggtgttctttctggccagtctctggtcagatctgatatgcttcttcttgagagaggcccctgtttctcagccagcagaggctgcagtggggaagagttgctgcctgcaggaagtctaaagtccagtcacatctttcagctccatccttagcctacaagataggaatgtggtttccttgataatgttctgctgaactgtcttgtacacaagataatgtttgcttcatcatccctgaaatatgtttccaaagcttcgttgtgatggtcaagaagcagtccgtaccttggagagaggcccggggaatgaaattcagagagacaagtatgtcaaccccaccacctcattcatgtattcattcagtaaacaaagtgtctgaggttctactgagtgtccagcaagtgtgttaggcacttgggggatagaagtgacaaacacagatagctcccccctttgtgtggctacgagtctaagaggtgacccagacagcactttctgtctctctcactctcttgcttttgctcactctgtgtgatcttgcccctccctatctctccaatgatttcttctataactcttgtccttagtcaccacacaactgtcacactgagcttcttactctttcgtgaacatgtcagtaattccttccccacagcctgtatactggctcttctctgtatatgaaaagatttccacagggtgggctccttctttgtttgtctcttcccaaccagcttgagttacgtgagatcacttgactggttttgcagcatggactgtgaatggaagtagcatgtattactttctggccaagaaagtaaatgaccctccagctctgtctaagcaatctgttaagatggtggcatctcagtttggaggaccctcgctcagctggagtccattagtaactacaagaagtagagcccccgaaaacccacagcatcactgaaaaatatgtttccattgcattaagccagtgaggctccatggttaatttgttaccccagcataaccttacctgactaataaataagctcatttgagtggagtagacaccattattattctcactttacaaatgaggaaacaggcacacagaagtaataatctacctgtagtcacacagctagtaaacagtagaactgggatttgaacccaggtagtctagctcctaggactgtggtaaactgcacaaacaatgcaggaggaggcacttaaatataattaggtccaaccaagggaagtacggtggaaaattccagcctgaggaagctattctggagtggtacacacagcaggatctcaataaatgttaaatgaatgactggatctttttaaggagcagtatattcaattgttttggctgcataagagagtaccacctagtggcttaaaatagcacacatacattatcccacagtttctgtgggtcaggaggccaggaacacctaactggatcctgcactcaggatcatacagggtcatacaagggtcctatgaccctaagtgaacgtatcagccagggctgctgtctcatcttcagctcaggatcctcttccaagctcatgttgatggcaaaatctagcttcttaccattgcagaaataagatacccttttcttgccagctgtcagccaggggttgcactgtgctcctagagtccccttgaagttccttgccatgtgaccatctcacaggccctctcacaatctggcaacttacttctcaaaggccagcaggagcatctctctcctgtaggctactatggagtcttacacactgtaatataatcataggagcaacatcccatcacctttgccacagaaggtaacctaatcaaggggcagactgttccatcatattcccaggtcctgcctacactcacatgggaaggggttataccaggtgtatataccaggggatgggaatcttgcaggccatcttttaattctgcctatcaaaagcagtgaacaaggatcaactataacactttttttttaacactaattcattggctactcactattaaatgcacaacctagggctgaagtctgtgaatggtcacatattaaatagaccatgtaagtcacacctcaaggaaaagtaagggagttaagacaaaatacagaactcacacttggcccatgaattagaaacttgagtaattaaagacagatgttctgtagggtaattggggtgaatgaaactggtgatttcagtatatgcaagctaatctttccagaaccccttttcaaagttcattttattgagcaatagtttaataaactgcatccatttcaagtgtacaaatggatgaattttgataattgttgtgaaacgaccaccacaaaacaatagctaaacatttccatcaccccaaaaatatatctgatgccccttgatagtccagatatttctctacaaccccaactcccaccaggtagcctttccagccccctttaactgtccttttaattaaataaaggcagtatggtacagtggtttggcactcaatacttgagtcagaatgtgttgtttggatcttcctttccctactttcttgctgtgtgaccttaagcaatttactaatttctgcctgcttcagttttatctaaaaaataagatagtgcttctctgaaagatagtcatatctcgaagaattcctatgagaatcgatgtagttgatagatgagaagcctaagtagttcttggcacatcatgagcactaaataaatgtttaccgtgttttttattgttattgtcaatattgttcagttcaattaaaaagccactataaagatggctagtagaagttaatgttcattaaaatatatttatgtcttttcctggagcactcttcccccagatataagtactccaactccctcctcttctttgaatattttctctaatctcaaactctgattgaagcctaccctgaccacattatctaatactgcaagcttcctcaccccaccccatcccacctcctctttcctgatgtttccctaccctgctatagtttttacttctccttagaatttatcaccattaacatcctaaataatttacttatatattatatttactttttattactatctctccttattagaatgtaagctccatgaggacagaaatctctgcctgttttgtttgctgatgtaccccaggctcttagaacaatgcctagcacatgatcagcgctcaggaaatacatgctaaataaaagaaattggaacctgtggcctaagctttatttatattatcacatataactcttaaaacaaaaccatgagatgtagatattatcactaccttttgataaatgaagaaaataaatcttggagagatgtagcttgtcacaatatacacagtttagttggtgctactccaagacatactctttttggctgtagtataccatatggaggagcttggaggaaccctagggtggatgtgacgagtcagacattgttgcccagctctagtaacccacaagcaatttgtgtgtttacatgcactggattttggatccactggcttatgccaagccaattccttattcctgccctgctgcttttgaaagtactggagtggcaagaggccgaggcatatttttgaaggatgagctcattccctggcccgcagccttactaaagtcttcagtaaatctattgaatctatggcaggaggttcagctgcatcaaatttaggattatcttgctttaatacagctaagactgcagaataatgaagatttggaccatcatataactctgaatcagggaccatcttaatacaggaaagatctttaaagtatgactcccttccatttttttaggctgtgtctacacatcacaaagtaaagatgtcagttatggacactaactgatgtgggtttatttctttgctctatctgtcttggtatggattttccagaactagaccctgggaccaggaattgagttcaggtagtttatttgggaggtaactgcaggaacacagtgagaaagtaaggaagacaaggaaaggaggaaagctaatagaagctatgttaatgagttggttactgctgtgggaaagtggggctaaatgcagctgagggcctgtgtagaacacaattcagaaatgtcccagtgaggggtgatgatgcaggggtattatgccatcatctgtaaccttttctgggcccttacctcccctgcacttccagcctgaccagtgcaggtgacctagtagacttccattgccggagatcgccctggagcagtttgaatttaggggagctgtctgcagctgacctctattgaaaggcagttctccatgtgtcgctggcatttctaacatcttgtgaacagaggcactcacacttttggaatatcttttcaaaaatatttgtttagtgaacagtctcaagagggatagaggtcatgtctccctctagagagaagggcaggtttgttttctgtccctaaggaagagaatgtcttccttagggacaaaggttaggcaaacttaccatccatcacaaaagatttcggttctctaagctcagagatgatgtcctgtaatgcagtccattatgtgagcaggtgtcacctgactcccataagtcaccttgtagggactggggcttggagggactggagcaaatggtgatgctctggctattactattgttgtgaataatatattgtccttgatcttggactcaggtgtctcatgtcttctaacagcatccatgaaactggcagaatgactcattcgcttgaaagtagagtaaaatttcagacctatcacagtttttggggacctccatggtggatctaggggatatgcacagggttccagctgtgactaccaaatgctatgcttcgctctattgatagcagtattaacaggatagtacaaaatctctgttatgtcctgcatgtttgattgagcctcagacctaagcattgtgttcctctaagtagaccagccctcttttaaggataaaaataatattaggggcaaaacctatgagtgtgtagaagtatattgcctattgaatactcactatatatttcattttttcaaggcaagacacgttttctattttgtaatatttggaatagaatagattcactgattagtgaacattgtaattattcttttctgaattaattatgttgaacacattagaaaattgctaggattgtcttttgtaatggaggtttcatgttgtttccattttcaaggagttctctcacgtactgtggtatgcagagaagggttgtcttctgctgggcccaaggaggcatcagtgggcttgccccacctccaccccttgccactggttaagttgggtaattgaagttctttattctatgaggccaggtctgtcatatatcacaatttcaccaatatgatctggatctgtagctaaattctgtcccatttcaaagttttctttgttctttcacccttgtcacattcttttaatgacattgggcagggcaggtctctctacctgttttttgttttcctcgaagaaaatcttggacacttggaccctttccttagcaacttcaaaggaaaataattagtttggattttgattgaaattgtaaaaaatctgtaaaaaatggggaagaattaacatcattattgatattttgtcttcatattcatgaacatgttatttctctcattttacttcaggcttctttagtggcttacgatagttaaaatgtgtaattttctacataaaatattgcatattttgattttgtatggtatattatatattattttgcaattataaatggcacagtttttaatattacagtttacaactgctggctgaaagtttatagaaatgcactttgcttttgtatattgaaattattgcagccaccttactgaactcttgttaattctaataatttatctgtggattctcttgagttatctatgcaggaagttatatcatctgcagattataacaacaggttagaaattttaaaacactttcacatacattatgccatctgattttcccagagcaagtattatcatctccattatagaagtgagaaaatagatcaaaagattttaagtgacctgccataggtaccaggtaccaagttattgaggtagaagaatctagtctcatgtcatcttatttcaatccaacactgtgcctcctaaaatcactcaccttgaaaaggagatgaaaactacaattggagagaagccacggatagtgggggtagatggaaaagaggaaaataatttcacttaccatgtgaacatcaaaatatcatgaattggctaagtcttgatttattggccatagggacttacagactcctttttattttttcccgtttgcaaggtttaatattattggtatgtctataaaagtaaatatttcagttttgtcccaatgctactgaagtaatgaagtccttggctgcaattacacaactgtggcaagatccagctactgcagttgtaatggtggcctcataagtggtaggaactagtatcagtaactattctgcctctcataatgctttgtagaatgacaaagatgtcaccaaagagtctatgtttatgtcatcagaaccattattgcaaaaagaaggtcaccatttcttcttttgtcttcactctgcaaaatctgcaaaagtactttagagtttggattcagtaagagtatatcccatttcttcctgtggttattttcaaaagaggcctggaaagcaaatagaggaatttccatttagtaaatataggaatttcttccactgccttggagaatatgttttctctccaatgtcaagtagatatattggaatctacccattggataataaggaaatagagtctaggaaaactcaagagcaattaagtgttggtttccatgtttataataaagatctggcatctccccaagttgtgcttgaaaaaaatatgttttgttataaagccaaacagctcctattcccaggtagttcaatattggttcatagtctgcagtgattccaattatgaaaccaaactggattgaggtgtatatactgaataacaaatattttacaccatacatgtcctatgacatgagatccgtctcatcccaaatgctatctaaaatgcccagtgcacaccaagaacctcttaaattcccttgttgaaccatttgtttcatatggaagtgggaattacggattttcaagcaggacttctggttgtcactcacatgaggcagagctagactggctgtccaatcagtaaatgaaatgatataaacctaatcacctccaagacctgaaaaccacactccttgattcttgccaatacaactccatatggaaacttactatacaaaatactccaatgaattcaagtgccagattgttggaaaccttccttaagaaaaaagaaatctcttttattcaggtaattattttctttaacaaagacaccctcagttttatttaaggggcttaaaattaggtgtcctttctctttttctttactctgaatgcttcaaggaaagtattttagagcttatattttagagtgtgattttatagaaaaggagcttcatcgtggaaggttccatgcaaacccactaatgtttgaaatgatcctttaagaaacagcttttggctgggtgccctggctcccgcctgtaatcccagcactttgggaggccgaggcgggcgtgtcatgaggtcaggagatcgagaccatcccggctaacacggtgaaaccctgtctctactaaaaatacaaaaaaaaaaaaaaaaaaaaaaattagccgtgcgtggtggcaggagcctatagtcccagctactcgggaagctaaggcaagagaatggcatgaacccgggaggtggagcttgcagtgagccgagatcgtgccactgcactccagcctgggcaacagagcgagactccatctcaaaaaagaaacagctttttttggtttctgggacagcatgagacaaagccaaggaaagaagatgagaaaacagctgaagtgcaaaaccacaagagatttctcaggaagatacattattaatgcatcttaaaatgttatcattaccaagactgagagttgacatgtatgtttgcaggctactttgcttactcttcttttggaaatactaaacaaaacaaaagcaagtggattgataggcttttttacgaaccttgctgagcaacaatataccttcagagggctggggatgtatcatgtaactcatgtgtggcttagttttagaagagtcaagagaatactattggtacaaccagaagtaattttaaaacaagtcatttacttgaacttcttggaaacaactaaatatttaatacccagaaatattgcttacaatgtcttctttcctctcccatcaccatccttaaacactataaccagatttgtacctctttcaagtgctcaaaaatctcaagtacaagttttgcaagggtccccgttggaggccagggcaggtacatgctgaagctggacaagccagaagatctttaacattctggagaagggagtatttaggaacattcctaagaattatatatatatatgctatatatatactatatatatatattatgtatatatatagtatatatatgctatatatactatatatatattatgtatatatattatgtatatatatagcatatatatatattatgtatatatatatagagagagagagccaattccacataaaactgcagaaaataaatgtaataaatcccaaatcaaattttagcttgaccacttctaagttctgagttgacaaagtgtagctaattatttctgggttttccaaatctacactagtgtttccttattttgaataggggcttttaataaatgcctttaataaatgcttttaataaatgcccatgtaaggatgcctctaagtcagtcttgcagcatatattagtgaggagtagatttggaaaacttgactttccacaactctgcaagactgagaaaaattgtagaattcatttagcttctgtttggcttccctttgctatttatcttaataactaagtgagctttctgcccttggacaaagcccaggggaccagtcacacagagagattcttgtgtgcaaatgcctgcttctatgaaaaaatctctgtagagtaaaattcattagctgtcatggtatgtgagcagaatattgaagttttgaaggttgaaaaattcaattatttgcttgttgagaagcatgcaattcttcagaggtatcattctgaatggaagtttttgtaaaaagaacagtaagcatagcatcggtcagaagagccagatttctcacttttgtatgatcttaggaaatgcaaccactcaatgtgtttccggatattcctctgattaggttctgtggatgaaactgttacatggactgtaaaacattgtagaaatataaaacatggcctggtgcggtggctcatgcctgtaatcctagaactttgggaggctgaggtgggcggatcacctgaggtcaggagtttgagaccagcctggccaacatggtgaaaccccgtctctactaaaaatacaaaaagtagctgggcatgatggtgcatgcctgtaatctcagctactcaggaggctgaggcaggagaatcacttgaacctgggaggcggagcttgcagtaagccgagatcgtgccactgcactccatactgggcgacagggtgagactcagtctcaaaaaaataaattaaaaaaattattattctcatttatcatgtacctagtccataatagacatctaatagatattccttgaatgatttaatgaatgaatgaacaatgtggttactctgaacccattgatggaatatttaggatttcagattgcatccatactaatattatatctcctgccagaagtctggggtcaggggttgatacgtaattgtggtttttcttgttttcctaatttttgcatgagtttcttttgttatctgttgattttcatcttaagtgtcaaacataaagagtcatttcaattcaacagacatttattaaacccttattaaatgccagggaagacatcatctctaccttcaaggagtttccagtctagcagtaatttcaaacatgtaaaggagtggtattacagtggggcagattgttaccaaggtgctatgcatcatggagaaagggcattgtcttactctggggagcaggggagtgacacctgtgcggggtgcagaaggtactgtagacagagtgagcagcaaaagcaaagctgaaagtatagatgagtgggggttgtgagtctccagaatgttgttcttcagaactgttacttgtattgctagattcgctttcatataaaccctctttcaacttgaggaaccacgtttgaatatttatcatcagttgtaactaaggttttacttcttgaactgtaatgcttgagtggactgattgttctgtgaaagcaattagcaaatcaagtcagatggcaccagaaagctgcactgtgaactcaaggggtacagaaaatatactccggctttgttgctatggtaacaagtggttctcctgcgttttagttccattataggccatggtgataacagtttctctttgggtaattatgaaaaataaaggagagagaaagaaaagccacatcttggtgtttgcccctgcgtctaacagctgcattttattcctgcaactgttaagggtattggaatgaattcttgtaaggggcagctattgtgataactcttccctgaggatccatgtgacattggctttatgaacacttccaatgtgtgcaggttacagggaggctaagcatccctgggcaagctatgctgcacagccagatccacgaatgggaatgctggggtctctcacctgcactcatattaacagccctcttggtaattctccagcaagatgccatcctttggaccagtggtttgcaacggaggtcagcggtggggaaatgggggaggattttgccacccaggggacatttgataatgcctggagacattttgattgtcacaacaatggagggaggtgtgcaaatgacatttagtggacagaggcccagggtactgctaaatgttcttcaatgcacaagacagctagcaccacatggagttatctgcccacaccggttcatagtgctgaagattagaaaccctgctttggaccatgattttcatcttttggaatggctggcattcaggaagtactagcagaaccagtgtatgaatctgatgctgtaaaacggatttcttcggggtgagttttctgtgacttcttagaggatgtcggagatgttcagccttggaagaacgtgcattacaaagggcaggctcaccagagccctgcagtgaagggctcatctcacactagcatgactcagaagcccagcaggctcaggtgctcagttccagaaaaacatttctcttctcctcatattgtattacttgtttagaatttcacgtaggtagctgagcacgttgaaatgacacgtttgttgtatttagtttgaacaccatatgttgacggggctgcaagcccaacaagctgtttttttataggatttcagctatcaccctttcatcaacctgggatcaaacatacaatagatagcaaaagaacacacacacacacacacacacacacacacacacacacacttattatttgttctacaaaggggatttcaagcataaatcacttatcacgctctatgcaaatatcaacgacctgtcagcttacttcttatttttctgggaagctctcccttaaaggagcaagaacaaactgccttgttgttggtatctaggggctgttctggtgacaactgtgagtgtccatggtcgtggaatgtgcccactcatcagccatttctgtcagggtgaatatctcacctgtcacagggaaaggatatcatacctgtgtgtcttagagtgttccccagcagcattgtggagcttcacagcctgacatttttcttcctagccaagatgtttctgacatgtcagtccacgtatgtttactcccagttttgcctaaggcgcctatgatcactgatgccagtcagctacaaatcatccaggaatccttccaaatccctggaccttgatgcatccatctactaaggctttgttagcacatctccagcagtgtgccagcccctgtgctgaaggatgcagatctaaaaatcaggaagttgtggctcatgctttcaggggaacttggtaagggaaagaaggcacatgtagaaaataaatgatgacttttaatccaagagaaggcatgtacaggggcagcgtagcccaaagaggtaggggtgcattggcctgtgggtgtagaggaggctccactagtggaggtgtgactttagagctcgagcctagaagcctagtgagaatgtgcccaggcgggagagaaaagctgggatgcattcctgggagcacaaaccaatgtgaggtcttccagggactcccaaacaacacacaatggctgcctggatgtcagatttctgttgctaatcagatgtaattgaactggcacttgagaaagacagttttggcagtggagagtaagctatatggattggggcttgcgaaggtggggatggcaggccaaagccagggagaccaatgaataaaccattggtggtgaggacacaaaggaaataaaacgtatagattcaagagagaattctgacatggggcccactagccttggtggcttgttgggttaggggccaaaggtggtgtctcagctggcagtgacaaaggaaggctagtgaagaatacgcttctcatagctttcacaacatcttgttcccagctgccccagagaagtatagaaaccaagtcaacaaaacttactcccagcctcccgcaccaaactgtattgctgcatataaaaccctggaggcatcactggcccctggcttagaaaattggatgaaggtgagacatttcaatgaaacatactttatggtaggagagaagtgtggataatgtttggtatttcacatgataaatttgagatgcctgtggaatgtacatgcaggggtgtccagggagctttttggtaggagctcagagaaagagctaagatgaacgcactcatttgggaggaattaaagactaggccagtggttcccagccctgagtgcatcatctatggggcctttcagaatcccaatgtccaggcccacccccagaccaattatatcacaactatacagcagcatattttaagggatggaggaatagttcccagaaatcgtgctggttctctgtgagagaagaggtaactttaagtggtgccagttcatgcaggggcttgagaaaagaagtggagtgagtacaggctaaaagctgcaagtcctggaagaggaaggaatgcaatggactgatggccaaccagtgctctgaaccccatctgggataagaattgtggatctgtgtctagtctgcatatttgtgcactcattttgccccagtgtacttaccatccaacttgaggaaggagggtatggtggtatggtctgagacaacggaagggcaagaagggtttctgcagctgactttggaatccaggctggataaggaaggcacaaaagtcaagagggactgatgatccagaagaaaatcaagtaaggaggaaggattggaggctgtgctcaaagactggaatatttgaggttaagatttccaagtggtacaattatagtggatgcatgacagagagtggctgaatatgctttgaggcgaaagctgttccaattgaggtggaaagcataagtgtggagaagtatttgtttagtcttcttgtactcctttgttctagaagtctgccttggttattcccaacttccttaacataaaggctgtccaatggtgactgcaagtgttttaacacagctgtcttctatagaacgggttattattatatctgttattttaaaacacccacccttgcatcaataaatatacatgtcaaccaaattctttatattaattgacaattatttatgaaaattgcaatgccttaagtgaaaaatttgtggagccagcatcccttagaaacacctttcttgctagaaccatgtgttcttgctttgtgactgtttgcatgttttattgctaagtctgtagataacattctttcttgaagattattaattatgtatacaagtacccctgtgtaaaagtattcacttggaagagacccaggaatctaaggcaggggccagcaaactgttcctgtaaaaagccgagagtaaatattttcagctttgcagactagacaatctctgccacaactactcaactctgcttttgtaaccttaaagcaaacatacaatacatgaatgagttgtggctgtgttccaataaaactttatttacaaaaataggcagtgggctggatttggtctgagagctgtagtttgttgacccctgatctaagataataaaggactctagtggattatttttgtgggaaggtttccaagttcatattttaattgatttgacttttcagttttggcttcaataaaaccatttaaatcatagtttgttatggtgctatagaaatgaagtaacttgtaaatgatgacacatggaaggttctaactacagatgggtttgtggaaaactaataggtcacgatattctgatgtagacagtcatcaggcttgtcatcttaacttactcccttgaagactcaagtacctcctccctcatcttggagaaagtgcgtgtctgacgctacagtgtcatttccttcaaccatgtaatccataggcacaagtgaaatggtgtaattcaatgttgactagaccaatgacggtattctaaactatttccttatggaaattcagtgtcttctgggaaaactaacattagattgcaaatctgttcctagcatttagagactcctcattaataagcactttttttaatagtaaaatatggcctggccaaaaaaaatctctgacaagatgtgagactcaatgtcgttcttatgatttagaagataggctgaagtgagatatacttccctacaaataaaatagatattcctcaaaatgtcaatcgaagttatgtggtttcattgtctctgtaaagtatttacatatttgcaactaaggcctattaaatatttattattaaggttgccaccctctgaggtggtttgatgtttcagtcagggcccagaggtttttttaattttttttcatcagtcattctttggaattaaatgtgtgcacgttggtaggacagaaaaggaacggaatgtcagctttctgccaacaactcttctggctacaagagaatttctcatttttttttcttttcagtgtgagtcacatggagaatttatctgaggagggcatcaaaagaaggagtgaaaagcaattaaggagaaaaaacacagttccttacatccatgttggtccatattggaaaatgaatactgagtatcatggctggttatcaatttcttttctttctaaagcccaattactgaatttttcacttggaacatgcccagataagatggaacttattcaggctccattcttaaaaaaagataccagaagtcatgatctgcctttctcactctggacatggaaattctcatcacagtggtcagttgaggtgatttcaaggaataatacctgaagggatcctttaattcaggttgtagaacaaaagcccaaacaaatcattaacaataattaacctctcagatgtaataaattacttttcaataagttagtttattgagaaatgtaatttgaacatatataataacaacagtctgacactaacttctgtaccctctgcttgaagcaactggggaactctgactgtggtgtgatgggaagttaactttactcaacctgtgagactgggtctttcttctgaaccaaccacagggcataaggttcatgctgatgtgctttggaatgtgcatggcccatcctatctatttctctagcttctgctggctttaattcagagtttctcaacctcagcactgttgatatttgggccacatgtgacaggccatcctgtgcactgtaggatgtttaacagcatccttggcatctacccactagatgccagtagtgcccaacccctgaccctcgtcacgacaaccaaaatgtccccacacattgcccaatgtcctctgggaggcagaatcaccctggttgaaaccactgccctaataagatgttgcaaagttccagatttgatatcattgaactgatattctaaaaagcattggctacatctgcatgctgctgccctaggcttctcttgacatatttgatctcaactttgcattgagtcttggagggaaggggcaatgtgtgtaggatgtccacacatctaggtttgcctaggataatccagtttttgtctgtcatctggatgtaattattaagtagcaccaccttgaaaagtgacacagtaagagtgaaaattatctggcccccatgtggtcttggaaaatggggaagagttttaagagttcttacaatgtcagaaaacttttaccttgcagaggtttttgatgccttcctgtcctattttaagagcctgggaattcaactatttcatgcccatatggaccacatattcaagtcttcagccttaactcttaacagcttcagtttttgtccaagtaggcaaagtgagctcagacaacaaggaaaagaacagtgcttttaaaagaatgttcttctcaataaaaataaattctaaagttctaagtagggagttactgctgagtttataatggctttcatatttgcttttacaatcacagtattgctgggctcaggcttcctgcttggaaaagtgctttgcaatgcttcagacagaagagaatgattttagaacaggctgggctatgaaacaagagagttgaagaagcccgaagtggtttgaaagcagtcattcctttggtgttaaagataggggaaaaaagattgttcccccttattaaatcctgtcacatgtagacaagagtgcttgttaaagcctcgagtggacatttgcattgtgtggttctctggtgtgtacctttgctaaaataagtatgcaaaagtctccaggtagtaatatgcccttgaccctgtaatcagaatcggtctctcacctggaaatgtgaagacaagatgtttggctagtaatgaaggtaagataatcatgtgggaccacaccattcaaaaggttgtctcatgctcacaagatgaatgctatatttccagccatcatgcccatgtatcagacagaaagaataaggaagaggggagctcaaaagggcatccttgctgagacagcttcccaaaattactgaagccctcaacctaacacttgctctccaatatcgatagttttttcagccaggtatttttaccacctccttcagtattatcttaccaatgaatgacaggagaatggatattgggtagacaattagcaagctctggtatatagcccaacttttgctaatgtttaaaagtcaaaaccacacaaatcttctaaaccagtggtcaacattcgctgcctgtggactaaattcagcccgctgactgttttggtaaataaagttttattgggacacaaccacaccccttcatttacatatggtctgtggctgcttttgtgctgtcaaacagaatagttgtgacacagactgtatatatgacctccgaagtctaaaatgtggtctctctggccctttatagggaaatgttgccaacctctgttctaaacagataactcaatgaaaaaaatgggcagaagacatgaacagacactttacaaagaggatatccaaagaccaataagcacatgaacaggtgttccaactcattagtcaccaggaaatatttttttttttttggttttcttttttgttttgttttgtttgagacggagtctcgctctgtcacccaggctggagtgcggtggcacaatctcagctcactgcaagttctgcctcccaggttcatgccattctcctgcctcagcctcccgagtagctgagactgcaggtgcctgccaccatgaccggctaattttttgtatttttagtagagatgaggtttcaccatgttagccaggatggtctcgatctcctgacctcgtgatccacccacttcggcctcccaaagtactgggattacaggcgtgagccaccgcacctggtaggaaatgttaatttaaaccacagtgggatggcactgctttcccatcagaatggctataatcaagaaataaagagagagctgacaatatcaagcattgcattaatatgggacaactggaactcttgtacattgctggtggcactgtgggttggtataaagactttgagaagctgttgggcagtgtctactaaagtagaacatatgtccccctctgtgatggagccattccactctcaggtatacgcccaacagaaatgcctacgtatattcaccaaaagggatggaccagaatgttcacgttggcactatttattaataatccaaagttggtaacaaccaaaatgtctatcaacaatagaaaagggaaaactgtgttttattcatatgatggaatacttttagcgatgaagaggagtctcgctacctgctacaacatataatattgacaagagaaaccagacaaaaaagactgattctgtggccttaaagttcagaaacaggcaaacagatcaatggtgtttgaagtcagaatatggttccttttaggggtagagatcaggagaggactcttcatgatttgggtggtcgttatacagggggttcactttggcaaaatgcagagttgtacacttatgagttcagaatttttctgcttatatattgtatttcaataaagagtttcaaaaacagaaaaaagaatgcacatctctttaatgatagaaatgtatcagcattgctctcagccagttttctattgaaaatgatgcctatgacatgtccctcatgaaacaaccacataattagccctggccctttggattctagtcttattcacaaatggaataaattttctgttttcagatttttgcatttgactacgtctaccctgacagtgtgactgactaggtggtctcagctccacacaccccatggcaaaaataaaaaggttgtgtctaaactgcagtggattaacccactgagcagactgcgtgctcctgggctttcttgccaaaggagagagcaaaggatgcaaagaagctgaatgtggaatttatggaccctaagaaggcaatttggaaggattttttcccccgtttctgtttagtcttaacttcgtgaaattgtaaagaagtgctggagactgggggagctgtttgtatgcaaagtgttgtctgcctcagttgtgctcctgaattttgactggctgcccagtcttatgtgggaagctgaataaaatgtgtatacttctaaaaaaaatcaattttagattttacaaaaggagtcaaatattattactcccaaaggaagaattgaggcagttttttttttttttaagaagagggtcagaagaaacagccaggtcttttttaaaaatcacccatattttttggctgacatattcagttaaatttgtcccctctcattgatgccggtggggagttataaaggaaagaaaaatattaaatgctaaaaatgaatagaagggatgtaataatccaagaattagggcaattgatgacaattttttaaagacactgctgtaaatgaaatttaaataactgtaaagctagatattcaatccaatagttatatacataagatgtactagttattgtttcataattatccagaatctttcatttaaaaatatcattttatgtttcttagactgtatatgtgtatatgttacgtatatgtgtgtatatatatttcaaatacatatgtgtagaaattcatgagatttttttttaagttaccatcctccaaaggaaaaaaaaaaaacctggcaagtgatgagaaggaattggagctgtgtacaagaatcttagaagatttaggtgatctcaatgcagcctcccaggtctcgtgtagcacctaaaaggatcattttttaaaaagaaatccaaatattagtttaggagaaaacacagaaaatctcatgactctcgattttgtgaaaattaaaatctgacagtagaaagcaaagtggcatggcccctgtgcttgggttaccgctgcttcccaaggggctccttagggaaataacttccctgttccttctcttttttacttggcagtcccaggaggacagttgagttgggggactaggggcattggaacaagtgtgtccttgccaggctcctgtggttggctgctagttgggcttctcactttgtgaaccaaaacgtttggagagtcttgtcttaggaaaagcaaattattctgccccgtgatgtcccttcagtgtggaaacatcaaggagatagatctcactgataacagagttgatcaggggagagtatgcaaagacaagacccaattatcaaagcacagcctttttaaagggttttgagtagattgcacttgttttggtgagaaaccaaattagagagttctgcctcctaaactctacatagactaatgtgttcttgggaagcacccctgctctgggagtcgcatttacctcttggtcatactgaattccttcgtaggagggcctttgatatatttattctgtaaccaaaaatggcagccctgagattggagagcatccctttgatttcctgtggactgtccttttctggagatatggtttgttctttcctaagggtcggaattatgattctgaaaagttttgcttttgaaatactacatcacagtgtcctaatgagaatggtgagccatctgcagcattcagcacttgggcatggcaatcaaatctgggcccgatgaatgattatgttatataaatcaccaggttcctccaggcagcagtcattgccattgtaattgattcctgatgagactgtttcttgatttgctggtgctgtaaccactgatgctgattgttctcatctcctgaaattgtatttagtaacagcattcaacaaatattactcaagtggttattgtatatgggaccaggctctggggttaaaaaatgagtatggcagccctgtctttgaggagacaagtgtttcaggaggaaacagacaagatgagcatcctaacagaggtacgaacaggaagctagcaaagctcctattggagggtggtgaggtgaatcggggaatgtccctccagaaaatccagagaggctaatgggagttacacaggcaaaggagaaatggaagggaggtgacagaggaagtagagcattataggtggagggaaatttctccttgaaaacaaaggaatcacattcaatgtgtgacctagaatttcagtgggcatctcctctggcaagaaattgagtagaaggatggctgcattttggaatgttcaaagtgtggagaggatgctatgtgtactgtagtaagtgcaaaacaatgggttggatttttaaaaattttatgtacacacatatttatctatatagtatgacgtgacatagaagttacagcctgttgaaaagtttatgccataaaaataacaattcgagttcacttcctgtgagtggcctagggtttttaagacaaggaagaataataggatgtcaagggccaaatatagacatggatgttttagaatcctttgcttttctgatctcagagcatgtggcatttggtgtaattgaatccaggacagatgggtgcaagccccattcaactttggagggaaaccaattaacaagcatgtgtccaaatgtaggattaaacttgcaaggcaagcgagtggcttccaataacacttaggaaacactaattagtgagagggaaatactttgtcaaatggtttgagaatagtaaatacaaatgcaacaagggaacattgtttttagttacaatttatattgttctagaagaaatggggctgcaggtgctttctacagacaaaatgaatcccaaatacatttacctaaggcttctagaaataatacaaatgtgtctttaaaagctcagatacataaagcagtagcatccaatttggaagtcctcttgatctaagcagtctggtttctctttggtaagttgcctgtttccagactataaatgaaacaaaataatcactatgttaatagagatgaatatatggaagataatttttttttcttttgggcttataaaactccaggagggaaaagatgaaagccaaaagtagaaaaagattcaaaggaaacaaattgcaattttagttttctaaatcaggggtgggtgaacattttctgcaaaaggccagatattttaggtttagtgaacatgcagttggtctctggcaactgctcacctctgctggtgtagtgagaaagcagtcatagacaagtaagtaaacgaatgggtgtgactatgttccaagaagactttatttatggatgttgaaatttgtatttcatgtaattttcatttcataaaatgttattcctttaattttttccaaccacttaaaaatgtaaaaacaattttactcaccctgtgctagatctgagacaattatctccccacaggtttgttctgttagaaagtccttggttgaaaagcaacatgctttccttttaaagttttcataaatttattaaataatgatgttttcccccactggtgttttcctaggtttttctagaatgctctgtgctctcgtaacactttctaacatctgttgtcatcatgcatttattaagcactcaccatgaactgaaatgctgaggacagacgtcagaggaaaagaaaatattagcaatagaaagtggtacagaagctcctctatttatggaatttcaactcgtgcactttcagagatacaaacaaaaccatactctggagcaaagccctctggctctctcttcaccaccaaaatatgcgtcaagaggttctgggacctcttttattttctgccctttttaaaaagaatttctcatttttcagtctatggaatatttgctgtctttctgctaggtgttgaggaattttgccaggaaccccatcttatgtgataacctcagaggacttgaaagaagaaagtgctagtaagaagtagtagaagtaaaggcaagatagaaacaatttctttttaattgaaataggtcagaaaaactgttgtaagccctttggcaggaagaatgattttgaggacaaagatcccatcatacaacctgagagaagctctgtacttgtgtaataatagcaaacattgatacagagcttctatgtgcctggctgtgttttaagtgattacacgatcacatgagtgtgcatgtacactaatttaatcaccaccaaaaaagtgttaatcaactaatgagctcacgaaatgattgatgaaacagtgaaatttgaacgtggctccggaattagcatcgtaggcctatttgtgttaatttaagagaaggaaacaaatctggtaagtgtacccggtcatggatggttccatgggtttgcagcttttggcatctgcccaaccttaaagtaagaggcagaacagcaatgctattttggagtaatattacggatgctaaagctgttgaggaattccctgtggtgcttgtgggcagattacccatttcagaagattttcggtgtatgaaatgaaacagatcgaatgtaggcaaagatgtcagtcaaagcatttatcagtaaggaggagtacgaaaagaccgactcatacctcacccaggtggaaatctggaggttgcaagcttctaccctgttcaagacctctggacgtaggaacaaggtcatacatagcctttagagcttaacatgtattcaaccaaaaagcacagtggactctgtctgtgctctgcccggaatatctcagatcttttaccagttctgtgtgcctgtcccattcaccagcttctgtgtagttttgcttctaatgaccaacatctgtgagcactctgtggggttctggagcagttgccctatattcacaaagagcaggaagtgcctgggagtttacatcaccctgggggcggggcgtcccacagcccatgactgactgatgtgtgtgaaaatattaaagtccaaattctttggcgaaggcgggacaaagtttagatgtaattaataccccagagcttccctcaggaccagactgagactgggactttgctagaaatcacacccttacttggctttattcccttccctaccctgttatgctcaccccttaccagtttctcctgggaacaggttcttaataaatcaattgcacatcagtctttatcttagtatctgcttctgaggaactctacctaaagcaacaagcacatatattattaagacagagaaatatcgtaaggctttaccttaagtcagcaatgaaatattgaatgaaagaatggactgaatgaattgatagaagccagctttgcactactcatgttgcagttagggaaacagaaaaaggataaaatattgaaacagtgactgttacattttagagtttgaagggcgtatagtgagactgcccacatagtgcagcctctctggctgatggtaatctaggttcagcttacatatggccagggaagaagatactaccacctcctgggactgttgccttccatctagatttgttataaagtcagtccttccttcctctttccctttctccctccctccctttcttccttccttatttccttccttctactttatggaggtaaaattcacatgccatacaagtcattcatttaaagtgaacaattccttggtctttaacatattcaaagttgggtaaccactattaacataaatttcagaacattttcatcaccctgtaaagaaacactgtaccctttagctatccccccctcaactcctcaacccccaagctctgcagtcctaggcaacccgacatctactctgtggatttgcttattcttgacattttgtataaatgaaataatataatatgtggtcttttgtgactgacttctttcaattagcttacaattttcgaggttcatctacgttttatcagtatttcattccttttaatggccaagtaatctttcattgtatggatagatcatattttgtttattcattcatcagttgatggaaatttggtttgtttgtaccttttggccattatgaataattctaccataaacatatgtatacaagtttttgtggacatatgttttcatttctcttggctatatacctaggagtagaattgctaagtcagatacagaaagttctttcttatattcagacaaaatctgagtctccttaacttccacacttggtacttatccagctttctgaagaaatatggacaagactttcttatgtatgacatcccctcaaattattcatcatctttatgtcctccttcaactttcaaagactgaatatcttctgttctttcaatcattccactgcaaaaatgggacttacagaaatgcaaactgatagctttgaggttgtcatattatctgttataatgtacaaaacagctttcttttgttccaaatctcagactttcccatcaacaacagggaacaagtggctaagtttattttgctaagataagagaaaacaaattattttctgggtaagaaggcttttcgatagactctgcatgggttttccctttggaaaatcaagaggactaatgatttgtgtagtttatgtatacatttgtcatttcttgacatgttaatgtgagaaaaaattttgtgcttctgaaaaataaaattggatggaaatcaattatcttaagagctttaaaagaaatcacgtgtagcattctttttattcttagtcatgaagacaatggggagaaaacttgacaaaaccacaggaaaatgtagcaagttacttagcaggctctgggttgtgctgaactgggccaaatgttatggtcatttcttcttctgtagctatgaatggatctaatccttgcttgttagtcatacacttaggactattttccaccttcttttaacattaaatccagagctcaggatggcttctgactttgtctcatgctatctgcatgacgttggacaaatcacccggcctttatgagtttcagtttctgcatcatactaccactacatcagtggctttcaaactgtgttgcacgggataacaaccaaagaatctcactaaaaatgtcaatggtgtggtgctgcaaggaattgtgcaagtaggctctggggaggtcctcaaaatctatttttaaaaacccacccaagtgatgctgatgcccatggtcctgaagaccataccttcaaaaacactgactagccatttccttctggtccctcttcctcttgttctgtattccactgaaagggagaagaaatcttattatctttccaggtaatatcttttcatctgtgctgtgtgcaaggacatgaaggaagacaactaaagttgaaataatgaaaaaagtcccagtctgatgcttagattctgatttattagaattattttgaccataacaattttaaccataaagtagggtttcttaaccttggtactattgacatttgggaccagatcattctttgccttgtgtgtgggaggctgtcctgtgcattgtaggaagttgagcagcatatctggcctctacctagtagataccagtagcatctccccctccctccaagttacagcaaccagatatgcctccagatattgtcaaatgcaccctaaggggcaaatctgcccctggctgagaaccaccttcataaggcatggtccccaaagaaaataatcaagaaattaggcttggagcagttttcttcggttggttcttactgcacagcaaggcaaagaaggccctgctaaactgttggttcttgacctttatgtaccaagcattcctgggggatctggaactccctggctcatcctctctatttgctggattaatgggatacagacagtttaagtgacttggcaggagaaggacattctgttttattctcctcattttattacactcctgacaacgaattcttaacatttgccttatatgttctgctccctatcattatcacaagatagattagttggcggggggaggggagggaaaccaatatatgcaaaattgctttgaaacctgcaggcaccagagtaatgccaggtgtcatcattcatcctactcctgagcctctgaagccaggggtttcttgaggttataaaagtggtttttttaggggggtgactagtcaagcactccaaagaactccagagtggtcagttttgatcacacagatggccaatttttacccagtctgttagccttttaacaacacacagtgttgcgtggagacccacttgtgtatgggtcttcaacgatgggtggagacccagggctcagctctactcttctgctctggagaactttctctttgttttcttgggtggtgcaagacctacttcactgaaagaaaatgtgttgttggtgtgagaggtactgctaagtggaaattattaaaggatgaattccttatgtctgtgaaagatttctccgccttggcactctagacatttgggaccagaactttctttgttgtgaaggccgtcctgtgcagtgcaggatgtttagcagcatctctggtctccacccactggatgcaagtgacacccttcccctgcagttgtggcagccaaagatagcttcagatattgccaagtttctcctcagtggcaaaatttcccctgttgagaatcactggcctaggaggtgtggatgggacaccagcaatctaatgaatgggcctgatttgtcaaaaagaatctccaccttgaaacatactggaatgacctgcaaagagattggggtcaactaccatttacatctcaactccaccatttattaggtatgcaaaacaggttaattaacctcataaataaaattaagatagtcatactttccttcccagttgttctgaggatccagatgtttgcaaagcatctagttgagcctgtgatgtaggtgcttaatgaatagtggaattgttaccatttcaaacaataattctagcacctgcggtgttggcgttgtcatgggaattctgcaggctttagacaactgaaacactgtgcaactgtgcagaagaaaggagattatgatcagaggaatgaaggcaatagactaacattagattatggatataaatgaaaaatcatttcttaattcccaaatggttatttggaaagtcgtagctggagaaattgcggcctctcctttttgcctaatgacccttgaatagaacatatatattagaaatgtctctttttaggcactttttaaggataccctccctggctctgtggcatggagtagaaattcttcagtgaaaatatcaaaacggcaaaaaacaagataaaccaataataccaaatagaacctactgtaatggtcatttatttcctcacccttcctcacttgttttctttccctgaattctcggattatcatattctcgactccaattgatgcataactttatgatattctttgtactagggtttgaggccaaagacaatggtactatgctgtgccaggatgttctcctctctcttctccatctctcctatgtgactgcagctccagctgcaggaattcctccttcactggtcttcagcccagctgtcttcaggctgggggttgtctccttaaacttacctggaaaaaggaatgagaaccttcattcttccttagatttcttctatctccatatccctggaagggttaagagggtgggaagaaattatggctatagagtaaaatgataattcctgaaatggcatatatgtttacagttatcaggctgagattttacccccactttgctgaaattctgcctaatgagatgtcctccctcaaaagcacattcagtgtatccattgctcctgtctgtgcgtgtgggtgaagtcggccttatcactgccaatgccagggccttagcagggctggtaggtccttcacttacaggagacacatgatttcagccaaggagggccttaagctgctactccagctctcctttctgatcctggagtttgatttccttaatttcatctttgtagccccatgaaaaagacttaaaaaagagacaactctaaactgtgttcagtcttcatataaactgtgttcagtctgtttatacaatagtgtaaataaagattctaattaatacagtttggaaaactgttaggcattgtctagtaaagttgaagatatgcatgcctatgacccagcaattatattcctgggtttggaccctataaaaatgcatgcacatatgcacaaggagatatgtataatgatgttcaagcagtgtggttttcagtggtccaagattgaaaaggacataaatgtccatcaacagttacaaagataaatagtaataaacacatataatggagtactagacagcaattggaatgaacaaacaacagctacatacagcaaacatggatgaacctcagaaacggaatgttgagcaaaagaagtcagctataataaaaacatacttatgaatctgtttacataaagttaggaaacaggcaacactaagctctaatatttatggatgcctgacttcctaaaaggcagtggatttcaaccaggggtgattatgcctttccccactccctgggggacatctgcaatatctagagtcatctttggttgccacaattggcgtagggggaataatactggcatgtagtgggtagaggctggggatgatgcaaaacattctgcaatgtccagcctctaccataaagaatgattggttcccaaatgtcaagagtgctggggttgagaaaccctgctgtaaaagggaagtgaagaagtgaagtcatgacagtgtctaccactgggatggaggagggaaatacagccaagggacatgggggtctagggtactagcaatattttaatttttgacctcagtgaaggttagacaggtgaatgttttgtaacaattcattaagctgcacattatatgctattgatttttccatttcaaaatgttaaaaatactccaggggctagattaacaggacaataggatggcatagtgtgggcactgggtttgggggaggggattccccatcttagagggtctcatagtaactctgttaacaatggtggggctgggccttcaagaagggcctgtcctgccatctgaagtgatttttagtactcagatgggccctcagctcttcctacactctgaagttgaatttgcttccacagatttgggtaaagtttttctgaaaaaagtaatcacccttgcattggcattaactgtggaaaattttaactcagcctataggcaggcagaataaatgcaaacaagtattttaatttaaatgctctggcagaaagggcagcattcagttctggaaatgctgtaatgtttagggacaggaagacatggaaattccacagttagcagggcacgttttctcttaaaggtgatgctagtagagtaactcatacagattatttttaagtcctctctggggtgaatgataaacatcagataaatttattattttttaaaaaagaaaaacaaacaaaaaagaacattagcctagcaggctcttaaccaacaaattggatgaacttcagcctcctctgaagtgaggttttatgtgcttcttgctgcctttttatctctctccattaccccaaaggatcaaatgtgcattttaaaaccacatgccatgtcaatatacagtttagttgacctagaacaatacctgtgcatagtatgcacttaaaaatatttataaagtgtggaatgatagacaatggacactcagaagggcagtggggtggatgatggtgaattacttaatgggcacaatgtacattcttctggtgatggataccctaaaagccctgacttcatcaccacacaatctatccatgtaatgaaattacactgttaccccatacatttatacaaattaaaatttaaaatttaaaataatatttgttgaataatgaccaagtgaacaaataacatgggaaggatacttggaagtagagatatgcaaataagaaattttgattagagtggtgttttaaatataccctgaaatatatttaaatgaaataatgaataatgtgtgaaattcaaattgtttaagattgaacagacttcttagagttctgcatgatcttctagatcctttctggagctttgagccttacacaattggactaagaattgaaggaggtggatgattcattccaaggtgatttaagagtcttgcagcatgaactgatcatttctttaggtgctttgcccaatctcacaaactcttcaaacacagagaaaaaacaatcctattgcacttgaacattttactccaacttagctatgacactttagcaataaataatgctagaaggcagaagtcattcctaaaatgtaagtacacagtgtggggctgatggagtatttttggcttacaagaatgtcatttagtgacttactacatttttgaaagaaagaatacaaaccaaatccaggatgacccagttttaagaggtgacttactcaggggtaatgatcaaaaggctatggttaaggttttaagacccagggatccaccttgtgttgtttaaatatattcataattaaatagtatttgtagggaaagggatttttagcttcaggggcttaaaggcaagcgtgatggaagaaaaagtcctaaggctggagtgttcacctttatgaatagaccacagtgaagtgaaagtccctaaactggggcttgtctaggccattgaattacatctgtacacacgtgcccccatcaggctgccctggctgcaattctctgaaagatgccagatggtgaagctcaagctggttctctgtcttattctgaggatctttgatgactttgctctaaaggttgcttttagcagcagaacagagtgagagtaaagagggaactttagtgtgtcatttttcgagctctgcctggacatgtcacagagcaaggaaggcctccaaggtcaatgggcatgctcatttctcctacaaagcagaagaaaggagacttgggtagatcaggctgtgggagaatgaaagacttgggcaaatagttcaattgactttctcataagacaggcaacactgtttggaagttcctgggtttggcaagggattgattttaaatttatttttatttttattttttatttttgcagtataaaatacatgtagtgaagggtgtaaattacactagtctgaactgtactgcacagtgaatgtttacatatgggtgtactctagtagctgccatacagatcaagatatagatcatttccagcaccctagaaggttcccttgtaccaccttcctagtcaataccaccttcccactttggtaaccactgttatgacacctattaccatggattccatttgcctattgcacttaaacatttgaatttcagttgcagaataaataagtgaaatcttacagtatgtacacttgtgtctgatttctttctcccaacataatgtttgtgagattaatccatttgttctgtgcatcagtagcattttcctttttattgctgaatagtattccatcatgtgcacagactacagttggtttgtcatgcatcagttggtgtacatttggatcgcttttatttggggcaattatgcctcaacacagtatgagcattctggtatatgatgagattattgtactctgtatatctaggggtggaatttgctggattggaaggtaggcctatgattgactttagcagatataaccatccagttttccaggtggataaactgtcatgggactatctaatggtagattcctcaggccacttgcacccctggcttcacattcccactgctaattataattatgctgtgattgttttaaaatattacatgccagtggatggttcattcaactaaattgtaagggctgaaattccggggccacatccaactttcctcccctctcctcccctctcctcttacacagagcaagtggagagtcattcagccggttcagtacagtgggaccctgacaaactggcacaagctacccccaagcacatcttccactttgtagccacccctctggggcttgcattgattgattcatgagtctggagtctctactctggccccaggcctggccttcctctgggctcaacttgtgggaggctggacgtaaattacagaaggacaaggctgtggagggaactcgctgatcttctccaaggtgttttaaagtgcaggtttccatgaggggatttcagagcagaggccagttttaagggttattgtgaacctacagaatgtgccctgcaagcccccctggaactcgggtcaccctaagtgaccagcatcctgggcagccttgtccccgcagcagttctcctgggtagcatgacttggttcctctcagtcctgccctccccaagggtccccacaatttgagactctcacagaagaaggctttctagaaagggaaactctgccctcccaggagaaggctctgaatctccttccactgtcaggcccacacctccttcaaagttagtgaaagtctctctttcttggaaacccaagttcgccttctcgctggcattaaaggctttggcagtccccgcctcagcagccggggtcccacgggtccggggagggtggggtggcaggaggcaggcgtgccggccagcctgacacctgtcgtgggcgcgttcggcctccgcagcccccaacagctgtcagcggcggcggccgccggagggacccgccaggagcggaaggaattaaacgcccgcccatcgcatcagactcggccgctccctcctcctcctcctcctcctcctcctcctcctcctcctcctcctcctcttccccctcccccttcgcgccgctgccttctccaggtccccaccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcggtgagtgtcctgacgcgtgcagaggacacagggggcgccactgggccgctccgggtggggactgcgaggggcgatggtagtcggggctccccacaggtccacggctgagggggtggcgggtggccgggtacgtcaccccgaagtgccacctgctcactaactcagtggcgcttcccgaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtgcggcgagtagatttgctgaagaaatgctgccgggagcgttggggtgcagccgtttcactccttagaaagggagtgcatttccctcctactttgtggcgggacagaatgttgcacattatcattaatgttgcacgctaatacaagagaataccaggggctcttctgtcgtaccttccccctcccttatggtggcttctgttctccctgttgatacaaagatttactggggacctactgtgtgccagggactgcgctaggtgctgcaggtactgcaggaaacacaacagagagaaagctcatgggatttgccttctttgaagaaggagtcaagattttaaggttaacgaccgaccaaatccagatactagatgagtatattctttgagagagagaaaagaaaggaaagaaggaaaaaaggaaagttgtttctgaggaatgactactacttctgaagatttcaaatgccccctccaggaagggggcagggagaaggtttaccttattccagtcttcagacattgattttccacgtgtgagatgtgtcgttttgagatgagacactgcagttgttctgtcatctgctaatttactgagttttccttgaattgatttgcactgttgagactggacgttctgactgccaactttaaaaattggagagaagcaggcagagagttgacaagaatcattaatatttataatcaggcaaagacagttaactgtctggaattcgtgtcttccaaaatccagtccccaacataaaaaaaaaaaaaattgtttttttgaagaaaggagtagaggtggacaggggtggtggactcaggcatcccggagctgctccagttggttcctggtgtcacctcggggctcctggattaattgcagggccattgggcaaattgcacacctcgtacacttcgctttcctccactggaaaaatgaagacctgaattaggaaattgttaagataccttcccaggcaaacgttccaggaacctgtaacagctctttctctggtttttctatagttacttgtcttgaaacaccaaatgagatacttgtaagttactaatgctcgttcatctgtcttggagacaccggtggctcagtgatttgccttttaaagtagtttaaagggtaaccacttttcaacagaggttgctttacactgaaggaagtagagtctgtgctcattgtgcccattcaacatctccaccccaccacctttttgaactgtgtgctggtaccctttgattcatgatctgaggtctttgccatttgcaagagtgcgggtgggggaggaaaggtgagaacgggctccttaattttaaaaaaatctattcattcaatgaatggttattgcctcaattatgtaaatatattacaaaaatattttaaaattgtcatttaattaggctgtctgattcttctaaaatcataaactgaagagtcaagccgatgctaatgtcccctcttggggctctgaagactgctgatgaaatagccctttattctagtacagattatcatgtatgtatattctggtttaagactataaaaaggaagattccagagggaatttgttgggattccaggttggaataagtcacccgggctctctgaagtttcctatgcatactttaggatgagaaagcagcagctctgaatcagtcacgtgtccagagaatgttctttattaagtgcgacccattgtttttcatattagtataacccttggtggtataatatctattctaacgctgcacttttgtttacttccctcatttgggttttgataattccagagcttgttttgccgtttagcacaaatattccacttactttgctcaacagggttttgtcccactgtgcattttcctgtgatcttgggttttttttgggtctgtcttccttgacatgaatgaccctccatgtgtccttaatacctcctgcctcctctgaaatataattcggggataagtatgtaatgctcttccttcagtgctttttcgtttgtccaaggtgagactgcatataagaggtcagtggctcacatttgattcattcaataaacatttgttgaatgcctgttgtgttccaggtatttggtcaattttccaaagagacagttagatagtgaaaatgttaggagttgctatggacatctcactcatctttttaaatggtcataatggtcacagagagcaaaatgcaattaactagacaagaacatcctccatttacataaacagacattttcaaagtataatacaactgtcttcttgctttatcatcacacacagaaaataatgtgtgttagcagctaatgttctcctcaaaaaatttcctcctacagttttcccacgttcagattatggtgactccgtccttccagctgggtgttgtccttgatgccttttggtgactgaatcagatttacattttgaaatgatcccagtatggagtgaggatgaggaggagctagagtgcatcctggtatttgggcctgggagagattcgagaagatgactgatgctagggtggcagctgggtaggaggttgagagcagttggcatattggagagatgcttagaacatagaacctgtcagacttagtttggatgggataaagaggtgatagagtatgaaggatgaggatgacatgaatgaatcaatgattttctggcagcatttctagagaagctcttgaagtttatataataagcaaatagtcataatgatatttccctccttgttactgtcttatacagattgcaaaatatttgaacacagtctaggtcaatttcagtctgaaatccaattgctgccttatgcaggttttctgtttcctgattgaagaaatctaagctcagaacagtagaattcaaggcagcacatgtgtcgctgctgacagaactgagagctttatccaggtgccctgatcctgcagtgctcttctgagtcatttagacaatgaggatagtcgaacctaatcatccctctgcgatccactttgccacagtaataaaccaacaaccaaatgttggaccttcagtgacttaatgtgactatctgtattgtcaaattgcatggccaaatagcttttaaatttgactagtgtagacaaaaactaaaaatttaagtatccattaagttcaatgcaatatctttatgtctttctgaaagacactaaaaaaaatctggattaaaagcttggccttgtgacttactggggaccttaggaggctcaagctcttctctcctggtgccccaacctgtctttaccctcaagtggggcagagaaaagcaaatcagtgtccattatacagtcaccatcaggaatccctggactgacatcattcatttctctctcgctggcaggttgaaaacttgctgggagtagtactatgtgtgtcttgtccctgctgtcacctggacacctagcagagtgctggaagcacagtaggtgctcagtagaaatgtgttgaatgacttcatgaatctagtagttgagacctagtttttgaggtcctaagctgctcattctccttccttgtactggtctagtctgagctcctctgctgctgatgtcacttcctgtttggtgtggtcactgcaccatctgtgcttttgaccacagccttgtaatcagatgctgactctgcccttgctccagttaaccccttcctaaggaactcaccagaagtgccaagctgcttaccctgacagagaacctgttttcacatagaatggaaactatgaaagtttccacgtttgttctctatgaacattcaattttcaaagactttgaagtcattaagtttgcttaataattgagtggtattgaatacaggatactctctggtaattctgaagatgcccagaactgggcgccgttgcaggcctatgctgatatgaatcagttatcatccatcggtgctaacagtgtagacatcttaggaaactcagcagaacttatactgacctgtggcatggcccagaacttacttttataaaaccatttttatattactctggttgtcatttgtctcctcataaaagcaaaattttttcaacttacaaatatgtgagagattattgaatcctcttaattgacacctctactaattgtagataccttttctactcccacccccaacctggcatgcttacttttctgctgcatgcagaaattttcctggatgaggcctctttggtgtggaagccccatcatcttaggaagctacatctcccctccttcaaaccactcattaagtaccactactaattgataaaaaatcagattcctgttggatgttgcatagcagacatctctgccaatcatttgaaaacaattaccaccctttgcctagtcctttctggtgatgaacttttattatttacttttcctgttcccacattgtgataaccctggaccacacacacatgactctcaacttggttgtgaaattattgtccagtcatacaaagtcttcattgggttcttgattcctcacttccctgtcacctgtttcattctcagactttcccatctcagtgagtggttggctgtccctatggccagtgcaatctttttaaaaggtaatgaaatagtgacatttcagtgcttaagctctttggttggtttccattccacttagaataatagcttcatccatgaccttgaccttccaagtgctccttacatggtcttctctgcctcataccacaccccactccacaagcttatcattgcctggccacatctgtgccctttctgttcctcaaatgcgaccagttcttttctgccccaagcctttgtacttgctgtcccttctgcctggaatgtcctctgtgtgataggctttttttttttacatccttcaaattgcaggaaaaatgtcgcctttcctgactgctttctctgaagtgtttctgagcccactcagttaccctggatcatatcacactagccacttccctcattgttcacatcaccacttggtattatattatatattcattgtttgtctgtctcctctgactagtgtgtaagtttattcagggcaaggacccaatgatcctttcccactgtctttccactgccttagagcaggtcctggcacagggtaggcatacaataaatatttatgagaacatgaatctggctgcctgtgtatttttccctaggttacgctaggactttccaaacttaaccctttattagttgatgattgaggtcagagggagagacgagactaaaaattagctttccagtttcactgaattcttactaaacgagaatctctaaggaccagacttggaatcaatcctttgaaaaagctttgggggtggttccaatatcagctgggtttggcaaacactgattaatttacacggtgaaccacttactactcaagcagcccctacaaaatgtaggattcagcagcaaagtagattcagaaagtgcaatacaatacttcacctcagctgactctgaggtaatctagtacaagttttcagagcagtcctttgttttaccacccagtgttcatttcagccaaactctctaatgatacaaaaggtataggaatacttcctctatataatgtcatctggcaatatgtccctcggtatccatattctaggtaaaatcgaccagtggttctgaaccagaggaccctgggcaatgtctggaggcacttttggttatcataactggcaggggttgccacaggcatctattaagtagagacctgacatgttgctgaacatcctacaaagcacaacacaacccaacaaggagttgtccagcctcaaatgtcaatagtgctgagacagagaaaccctgacttaattgtatctcagtagatatcaaaatcttaaatgtttttgagaacaattttgtatggcactttctaaaatacattattcgtagtttcttgggttttcagagatagaggtgagaaaatgtgagtgagcttccctggctgtgagtcacagttatgaacagtgtgtttcatactgtgtggggattactctggagagggtgttggtggtccttccagaagcctcagcatcttgggctttttgtttcttcactcctcaatgccaaagcccttcctaatcttgggttaaaaaaatgtttactgtcttctctctcatgtcagacattagctaacttcttcctttatgaccgtctaacagccttgcctaatttgccacctctcttctgatttagccagaatacccgtttaacaaatgtgttaatcgtgggcctaaaattagaagttataatctccaaatgaggatgtgtggagtgctcagcagccttggtgtgtggatgtgggatctgcatctgtatgaaagtgagaaactagagtgcctgcttctgtccctactccttgaggataatgacacagaccggcctgctctggggaaaagggaagagttgctgaaagaaaagccaaaggaaagagggagggaaacagtggctcccagcgtttctctctcaatcacatcagggttcaaaatctcctgagcagcccagggtggcaggcgggtttgtggcctacctgttctcccattgaattgcagagcccgttcttaactcctggccatgtcactgcatgtccattagcatggtctgttttagattgtgagttacgagatgatggggagggtggggatagatttaacggtcttgggtgcttgccacattttggactgagaccactgtttacaaacacaattaattaatttaatatcttttaatgtactttctgttctcaggttttctcattctaaccttattttcaaaagaccaatttttctgatttattttattcttaaatataccctgaatacttaaaaacgtaaaggtagatccagtgatgcaacaaggactcccaccagtcattatgtggtactgctttcactatctttgtggtgactacttggatgtgaatatgggatacttttcaatacaagaaacatatacaaaatataagccaaattttttcattcaaatacagttactgttactgaagactcttccacttccaatttccttgaaagatgccatgactctttcaaatgaaaacctgtcaggcttgttctcctcttctcttcggatacttgtcattttcttagaacttttctaacataaaaaaaaatcttatagtaaaatttgagtgtttgggatgtcagctaaattagatttctgaaataacaattttagaagaatttggagttgtggctttagagaaaagttgccatggcaacagcaacagaagtagtttagatgaataaacttttaacatatttttgaatgacccctttctgcagttgactgaaatatctggtaaagaaatgtataagccagtccaagtgcaatacagaggctaaaagcatctcagcactttgtggagcacgtgggctccatatttgccaagcatctctgtgccaggtgggtgcctctccacatgggcacaaatccctggacattgctctaggttcctagcttggtgatgccatgttaattagacccacagatgaataatagattagcaagggtatggaacattgagtttgctagaatgatttgaaaatggtaacataacacatagtattatttctgtgggtatctatgcacatgactttcaacagttccattcatgttaagatgccatttcgatggtctgagcaaaatgcaaaacacggtcttaacttttatctcaaaagttaaggcatcctcccacattagctactgattcacagtcaagggctttgtgtcgatcaggatccaaacaggaaacagataaatcactcaaaaggcttaatttgaggaatgaactacgccaatgtgttgacaggtttaaaggaaccaacggtgagtggtgaagcacccagcaattagcaacactgagaagctgttaccagggagggaccagcgttaccagagcccactgacttgcagccttggctggaagggaccctggcaatgtgtccagagaagactccagcaagggcaaaatacagagaagcagggatagactggaacagtaaatactctgacttcttggtctccctgttctccatctccttctgggcccaagcccagccaatccagtgagaccagcacagagaagggcagaacattttatttcctatttttgttgagggctggcgggagggggggtcggtgttgacaaacataaaatatcattacaagcattttcagtcttgtttggggtttgcttacatttatgaaagaccttaaattcctaagtatatagaagtctcccaaattgcttcaaatgtctctttcttccacactgtagattattttgactaccacatttaaagtactcaggtgctatgccagctccatccatacgtggtgtgcttgcttttaaggatttttatatcacaaacctattaaagcatttagtagagagtgatatattctacgtatattttgtcattaatctaatattggaaagttcattactttaaagtgccctggtctaaatttattagtatttattaatataattcaaaatatgtaaatgtattaatatagactacaattagattttttttccctctaagcccattaggatagtctaatgtaatttccttgccaaacaaagaaaaaggaagatttggtttggctttttttctggttgatgggtaaagggttttaactcttaaaattgcacatcaacacaaatggtctaacctgtgcttgactgaaaggcaattttcatttatctctgctggtcaaggaatggttgcagctaagtattgcagttaaaccgccctgtaccccagtaaattttagcagagagaaaactctcatttcaacctggactgcagaaagtacctcttattcttaagttagttcctccttgagtcttctgtgcacccactttcataaatattcatcctgcttctttggagaccatattcacaacagaaccagaaaatccaaaaggacgcagaccagaaccagggactatattgtgtgtgactcaatgcttggccatttatagcatgtgcctgatgcttagtatgtacttgagtgtcaatgaaattaatcagtgatttaaagctctcagaaatatttagtctgacttagagtaataataatagccaatatttattgaatgctctctatgagtcctgcttattctacatatattatctcacttaatccttaaaataaccctgtgagataggtcctattatcctcatttaaaagatgaggaaaccaaagctctgaccttatgtctgtttcagggccacacagctagtacgtagtggggctgggactcaaatccttgtctcttaatttgattgccaagtctgcatgcttgaatcactgtgcagtgggtgattgttgacatgccattggcttaaggtgatacctttgaggtaatactttttaaagcctttcattttgtaataattgaagacttataagaacttgcaaaaatagtactgagaggtcccatgtaccccttatctagcttctctcaatggtagcatcttatttacacaatatcaaaaccatgaagctgacattgggacaatcctattaactagactacagattctcattttaccaggtttttacatgcattcttttatgtatgtatatatgcgtgcagttctgtgcaattttattacctgtacagactggcatatccactaccgcattcaaaatacacagctggtccatcaccgcaaaagcactccccccatgctacccctttgtattcacatccaccctactcctgccctcatcctgaatctgggctaccactgaactgtctccataagatgacacattttaaattcttcctcctgttcttgctgcacggtggaaacattcctgtctccattgattatttacacccaaagcatccataaacataacagaagaaagtatggtgaattgatagggagatcagagaggattttggtgtgtccttgttgtcagcaatgcatatatatgtatgtgtatatatatatatatatatatatatatatatatatatatatatatatgtacacacccatataaagaacatcctgtttgttatttttagttgagggtttgagggttgtggtaattttataattccaacacctgtgttttcactagcaaactgcttttgattgaaacacggcagagtttatctcctgcgtaaatgcggcacactccctctttgcatggctgttctaacggcacatccatttctggaccgacaaccgcgtgactgaacttgcagcagcctggaaaaggtacatgagagctggcactctgcccttgtcagggttttccaaaagtatttacgaacaaggataaacacgagtcctgcatggatttgaggtagccatgaccgagctgggctctgggcagcacaacagttacgtaaaccttggcattcatggcacacatgcatttttattcatccatttcaaagggagtggccgttcgtagacctctcttggggaaaggtttgaaccttatcatgatgaactggttcaaaaaatccttaatagctgtttttattcaggattgctgaagagtgaaaccttatcatcgggacacagttagaaagacttcctgcatttatttggtgctcactattttaaaaaaggtgtccaaactgctgatgctgtctgattctgcaaacataggcaaacttactagatacttcacatatttcagttttaccatatgattatgacttgatatttattagaaaggaagaacattttttaaatgtagtcatactgagcccaactcttgcttttaatgcaatttaattgcattaaaattagacaggtaatgtcaccattaccacgcagatactttgtatcacccattgcaaacatctgtaaaggatcaaaggctcatgtagtgagtctaagaggaaacttggtttgagaatgaggccttccatgatatttctgtgctgccgcaggtgggggagggcacatttttatttaaggcgtcattagaaaggaatgaaatatagaactcctagcatgcatacatatatgcacatagacacacaaaatcgtactttaccttatagctgtgttgtctaaaatgtagaagtgtgtttgtatcagttagctatcaccacactaatgctgtgtgacaagctactctgacattcagtggcataaaaaaaccatcacggatcctagtggatctgtgggtcggttagggttggcttagctagacagagctcagctgtttgaccagaggccaaagtgtcaaggctcttctgtcaattctgtcccatgtgtatctatcctggggcccaggctggcagcatctacccaaagaagttcagcaatgacaaaggcacaagatggcaagtgggatcaactgaagactcttgagacgtaggcaggaatttgacacactattgtctccacccacctgctactggccacagcaagtcacatgtaaaagcctaacttcagtgtgtggggaaatgcactccttccatgatggggctgtggtaaggatgtgaagcaacgagggatgaagagatgggggaattgattcactttacctcagtgtttaatcagtttatcctgagaatgccaatacttttaagaaggtacaaatctatcctgattttctttttctgtttcgtcagtgagttctttctgtcatggatgtcaatatctatgtcatcatgacccaattaaatgacaaaagcagggttttgaggttctctcactgatatcagttcccataaatccacagtgattggagaaagactgagtagacattaagggaatatagaaatagactgaatgatattaacatttaaacagaattgcgacactcgtccctgtttccttgtgtgtagcagctctggttcctcaaactatcaaaaagaaaccattcagaatcacctccctggatactttttaaaatttatttttaattgacaattaaaaattaaatatatttatgatgtacaatatgttttgaaatatgtatgcattgtggaatggctaaattgagataatcaacatatgcattacttcacatacttattttttgtggtgagaacacttaaaatctattgtcttagcagttttgaagtatataatacattgttattaactatagtcaccatgttgaacaaggaatatgaacttactcctcctgcctaactaaaattttgtatccttgaccaacatctccctggagattttttatctgcttctttttactagtatcacttttaaaagatttctgaatttagctactgtttcaaaacctagaagaaattaaggatgaggtgatttatgaatgaaagaaaaatatattaatcctttaggccaaacacaccagaggcaacgtttggcaattaaattattaatttgatcaattttgacatgtaaatggataagctacattaaaagcaatgcacttaaagtacacacacagaatcttgtctcattgaagtttgaacaccttcaccatatcttcctctattatatcaacttgattgaacagttgccaaggcctgtttttttttccagtttgctctgtacgtgatcatatctagtagactgtctgccatattacggtagctcagttcttaaatcaggggtcaacaaactatgacccacaggccaaatccagacaactgcctgcttttgtgtctcctatgagctaagaatcagttttacatttttagatggttgaaaaaaataccaaaagaagaatatcttatgccatgtgaacattttatgaaatacagattttagtgttcataaataaagttttattagaacacagccatgtgcatttattgacatattgtctttggctgctttcacactatgatagcagagttcagtggttggttgcaatgaactgcatggcttgcaaagcctaaaatgtttactctttggccatttacagaaaaagtttgcctatctctagtctaatgctatgtctcaaattaccacagacactgtagataggtctacgttacatcagtatgaaggcaaaagaaagggacacatattgttggtatggaggggagtggtgggtatatttcagataagggcaaaatgtcagtgaacattcattgattcaccagtatatgtgcagaactgggtatgtgtatagcgctaagggaaacatttttttaaaaggttagtctccaatttttactctaaggcttcctcttgaataagaagatgcatctgcaagtatagtgtctgaaaactatttgccttgtccaatctctacatcactggaaaatgctttaaaaattttaagttaaaaatagtatatgtttcatggtttattttgcaattattctaggcagaataattttcataaacattgccattcttaccagtgcgaaagggagacttaaactcagaaaagtgtcatttactcatgggtttaaaatgctagttcttcttgtggatgtatctgagatttttatgttactgtatccagaactccctcagaggcaagaacataaagggcctccaggagctgactctaaaaacaccagtctcctgttctttaaactccgtgtggcttgctgagcgctcagccacaagagctgggggtgagccatctctgggtcctgccaatgcagccagtgttgtgccaaaggaagtagccctgtcttacactttgtgatgtttcttttggctgactcttccacattcttgtgaccctttgaatgaagacgtcttaacagctttagctctacaccatggcctcccgctatcatttcctgcaggtcttgtcttagagctcagcagcttcctgagtaaatgtcaccttggtgtcttctaagagggtctcactgaggttcaaaaaaccatggcttccaccagattgaaagcataatgtccacgagtctttgtctcactggactgtgcaggaggatgaacctggaattctttttggttttgaagcaacgagtaggtcggggcacagaacagagaaccaggaaaatgtctctgagggtggaaatcaaatgaccccagaggaggaaattccagttgaaaatagaaaccgggtcagcacccttgtgagagccacagcatcctagacttggaaagtggcaacctgtggcctgtgaaggctgctatcagaagtccatggactggcctgaaaagagtgttgtgttttatggcaatccaaattgaaacaggatttatctagcttcacagatgtggtctgctggagagttatgtggaaatgactcaatgtcatatatttgtcacattgaccaagggttatttctttagtaggaaaagacaattcgggaacaatattttcttgagaactatgatatatgcatacatgatggtggtagcttccaaattaccatggtacgaattctctccattgatggttaaggggaaaagggttattttgttgcagctgtacaatatcccttcattaattcaatgaaaagatctcaattaatgattattccttaaaatgacagatctataattaacttggaaatgcccacaatataatcatgttgctatgaaaagtgatggtttttaaactagtctaacataattccggattatctttaaagagaatttaatgtctagaaaagtttctgtagctctaaaaagctgcagaataggatgtcattttgggaagtttcccttgcttaattcagcttatgatccaaatttgaaggagaccagtagtccaggagttttgtctgcaaataaaatgaacaatatgtgttctaaagtgttttggatttttgtttttggtgggaggctggttagtcatggagcagggtagaattagtagcttttggctttaatcaggaaaatatcacatggtgttaaagtgctgtctattaattggttattataaactttaaaatgtatattatggtggagaaacttctcatttgggggactgtttttcatagcatttgtggcaacttttatttattacttaaaaattttaaacatcacaaacactgaaattctggggtagagataggattttcttaaaggagagatatatttttgatatatctttttctatctgtgtgtgaaagtgtaatgccttccagaaatccataggaacagaaaatagattagtggtttcctggggctgtggttgggaaaggagagtgactgtcagtgagccccagggatgttattgaagtgacaaaaatgttctcaaattggattgtggtgatggttatccaacgcagtaagtttacaggtgaagtttatagaatgtaaattacatctcaatgaagttgttttagagtatgagttaataagagaatcaaaaagtacttatttacaaatgaaggattaaaatcaatattatacaatcaaacttgaaatacgttagtaatggtatatatatattttttcctttctaggccacctcttagaaagttcaaaatctaataaatgaggggaaacacctttttattttttgctagttgttcaggattcagtgatctgaccaagcacccatttgtagttaagacataaacatcccactgaactagacaccagacttctaagaaactcgactttctaaaatcaaaagcaaaaacatatctgagcagccaccaggactgtctatataatttgataaaaatgttgcaaaactgaattaatagttatggttacacaatttggtacatttactaaaatatcattgaattgtacacataaaatgcataaattttatgctgtatcaattataccaaaataaagttatcttcctataaatatatgttcatttgtttatatatttatgtttattatatatgcatatataaatctaacgtaaacatataaataaatgtttatatatttcatatatatttgtatattttatatatatatatatatatatatatatatatatatatataaataatgtctgccagtgacacaggcccaatatctatattccacataatgaagtcatagcaacagggccataatcttatcttattcatcttattttgggatattttggccttaaccatgtgacactgaaatttgcttgggactgttgaaagcattccccttgtttaaagaggttctactaaaaacaacttttcacccatttttttgtttgtttgtttctctctttttattttttctagcacagtggtaacaccctattcccactttaacttcttttccttccttcttttttgaaaattttctaacttgtatttataattctcttgctcatcaaggtcatccagacactatggttctgttcatgtggaattttagtctcatagcaatcagtaagactgtcttgcgagagccggaaatgtgttcattaacttgagaggccttcctgctaagtggtcaaacatggaaacacaaagttatgtagggacattttgctctgtaaactcaaggtatagcatcatttgtttaaaccctctctattgagatgtaattcacatgtgatacaattcacccatttaaagtgtacagttcagtgggttttagtacattcacggagttgtacaaccatcaccactagctaattttagaatatttttgtttccccaaaagaaactccatgccactggcagtcactctctttttatctcctccaccaatgctactctgagcccctgacaaccattaatttgctttttgtctctagatttgcctgttcttgagattttccataaatggaatcatacaatacgtggtcctttgtgactgtctcctttcactgagtgtgttgtcgaggttcacccatgttgcagcatgtattagtacttcattcctttttatcaccatataatatttcatcatatggaaacatgatactttgcttattcattcatcaagtgatggacatttgtggtgttttcagtttttctgcttttatgaataatgctgctatggacttctgtgtatatgttttgtatggatgtatgctttcacttctcgtgggtatataactaggagtagaattgcttggtcattataggaactctatgtttaactatttgaggagccgccagagtgttctccaaagtgattgcatcattttacattcccacaatggtgtttgagggttccagtttctccacatccttaccagtacttgttgttgttattattattagtagtaatgtttagagacagcatcttgctatgttgcccagactggtcttgaactcctgggtttgaggaatcctccaacctcaatcttttgagcatctgggagtatgggcatgtgccaccacatccagctttgtctatttgatagtagccatcctagccagtgtgaagtgttttattttagttataacttttatttgtataacaaacaagaggcacattagatggtgatcatttgcttcacaacagtattttttgtagtcctccttttaaaatcacaaaaccacatatgaatttaaaaccagatccttttctttaaaaatagtccactgcagtctgcccatattccagcagtatccattatcaaagtaaagtgtacacaaaaggctccctccacctctccttgcttgagaatctgtgtcccctgagtatggatgtcctgctccaccttcacagtgtcaccttggaggaagtggcagggggtcatccacttcaaccattttccagccctggcacttggcagcaagacttggagaggccagaggacatgtggccacaggcccctgcttgtgctcctgagtgaacacttgacatagatatccagtgaatcatggggtgcaagccagagacaaccccccaccccatttcttgcaggctgtggatctacgtgtcggtggccctagttattatatctgttatgctttaaaagtgaagactaggccaagacctacaggctgatgattattaggtggattaacatacggaaaacactatagaaaagaaggaatagtttgtgcaaagatgctgaggagcaaagtggcatagcaagttcaagcaaatgagtgaagaaagtagcagactgagtgaaggagtaaggggaacagtagcagaacagagctttggagagatgggtgcggtggtcaagaaaaatggcagggacttacaggccacagagtaaggatattggagtaaggggaagttatagaaacagttaagcagtgtgagggttggaggatgcgtgtgtgtgtgtgcgtgtgtgtgtgtgtgtgtatgtgtgtgtgtgtgtgatgatcaatttcctcaattagaaaaaagagatgtgatgaaattgtgttacagccttttggacactcagaataggaggtcttttattgccaggatacccatagcattgccaccctcagatatcttgtaaactctggtaggaagaactcatggatgactactttgtcgtcctactgcctttaaatctgcttctgtctgttcccggcacccactgaacggcaatttctacaactctcaatttgggcagcagcgtccatactgggaaaactcttccatcatgcttcctcatagacccctattgactgggtaactgctgcatcggtcacctcctctccctgggcctattatagctatggctaagggtgcttccgttgtacctggatagagttttatgcttataagctgcttgtggctattaaacagagcaagaggaaactgtgtacatggaaggaactttgttgcccttctctgttacagacaagcaaaccaccaatgagagcaacaactttttaagaaatcctggcagacttgtggcaagaataaccaatattgtagttcacccgtgaggcttatacaacgtttgccacactgtatgcattgagaatctggttgcgatttttgttataaactcttccattccgcttccccctccctgcctccttacacacgtttacttcagtgaactctgcttgacagactaaccaggctgaggtctcaatctgtgacctaggagccagtgataacacctttgactaatggacagaagacttatagttctatttttgttgttttgattttttttaagttatagtgttgaagtcatacgttgtctttagttattaatcttactgcttccttcagcattttgttgaatagcatttcatcatgctttggttaagtgatttatagttagctcacaaatcccaggcttaagattaaaaagctactcataaattccttagaacattcattgtgccagcagaaagaaaaaaatactggactataggatatcattcctgtatctgattcctacactattcctttgaatatcatcccacacctcctccccgttcaactccaaatggccaatgaacacatggaacatacatacagttagccaataagaacatgaaaacatgctcaaaatctttagcagtcagggatatggaaatcaaaaccacaaggaaataccactttacacccaccaggatagtaatgatgaaaaaaatacaaagaataagtgttggtgaggatgtagggaaattagaaccctcataaactactggtgggaatgtaaaatgctgcagccactttgaaaaacagcctgtcagttcctcaaaaagttaagcatagagttaccatatgactcagcaattccactcctagttatctacccaagagaaatgaaatgtgtgtacacaaaaaacttatacatgaatgcacatgcattattcataacaacaaaaaagtggaaaaaacccaagaatccatcctaactgattaacagataaacaaaatatggtcaaccatacaagagaatattattcaataggaaaaagaatgaagtactgacacacgctcccacatggatgaaccttgaaaacatggtgctaagtctctcttgagctggacacaagagatcacatattctcttgtgattccacttacatgaaatatccagaataggcaaatccatggagatggaatatagattggtggttccctagggctgggggtgggataaaatgcagagagactaataatgggtatggggtttctttttgaggtgataaaaatattctaaaattggttgtggtgatggttgcacaactctgtgaatatactgaaaaccatttaatcaaacacctgaaatgtgtgagttgtaaagtatgtgaattatatctcaataatgtagttataaaaaatgaaccaagaaagccaagcaatgctagacatgcatggtctattccactgtaaggtaatagtctgtctaggcacatttacttattaaaaaaaaaaaaactccccatttatctatttagatgtttctttgttatatatgtgcttaacaatcttctcagtttacttgcagtttgtaggtgacagtttattttatgtcatgggaaactgaaacagaatatgtcaggactgtttacgtgaacacggtctggcctttcgctggacactgggatacagtatatttcaataccccctacgcacacatcccacacacattaatcagggccaacatgctgggagtaaccacgatggccaaccacaggatactaggatgctttttatatggacatttgtgggtgaatgtaccataatctgtttaactggctgatagtcatggtggcagtggcatatgtgtgtgtgtttacattgtgtgtgagtgtgtgtgtggggtgtgtgtgtgtatagtttacagcaagctcaggcggaatgctgtaagccaaacagtaccatgaatctctaaaaaggaaaaaagatcattatctttaaaagtgcattcttacatgctgtcaagtatttgaggattgcttttcctagctgaggctcagtatagtcttctttagtctgttgccaggggatcagcaatgggcaaaatctccgcccccatcccagtacccactctgtgtcatacattttccttgatgacttatgcgagtactttataatctttacaattctcggctgggcatggtagctcatgcctgtaatcccagcactttgggagagaaaggaggatcatttaagcccaggagttagagaccagcctgggcaatatggcaagaccctgtctctaaaaataaaataaaatattagctgggcatggtggcacacttacagtcccagctactcaggaagctgaggcgggaggatcacttgagcgagggaggctgtggctgcagtgatgatcatgccactgcactccagcctgagcaacagagtgagatcctatctaaaaaaaaattccttacaactctctaataggtttctttatatcattttatagatgaggaaactggggcttgtagaggctaagtaacttttccaaagtcacaaaaataagtggtgaagttgggttgtaaactcaagtccactgattacaaagaccatatttagggtcccttaagttaagctgtcttacatcttcccgaggagaaataacatgcttttttgctactgacttaatcataattattaatgaaactgaagtagaaattgattatttgactagaaattgattacacaacaattcaatgtttagactaagaaccaaggatttccaattaatatgccagagcttgccattaaaattttttaaattgtcatttttttcttatggatatgtaataatcatacagtaaacccttgatttgtaggataccaacctgcaggaatgactagtaatttttttaaaaagaaagaaaaaagaaattctccttaaaagtagaattgggatccagatgtgtttttacccagcagtgtcttccgtcatggatttgtcttatagaaggaaaaagacattccaccccagtggtgataggtgcatgaaaagctcattttgagaactaaggatggagaaagcaaagaggagcagagtggtagagatcacagtggcaacagtactggggtcacctgggacctcaaggtgggcacccatggccatgtggtggtagaagtgagaatcaacagagggacagcagtttgcccttcctgttgacagtggaaaagagagcagcaatgaagaagtagagtcaggaactgctctaacgtttgctggaggggcagccagcagccccttatattaggcctaccaggacgctgggtgccatattgaaaagatataacagtcataatggattgtcagtgtggatgcctgcagacatttgcttcatgtggtaatatcatgacagattcaatcagctctttatttaatctgtattttcacctataattatgcttataagacaaactgttcaatggttttaaaagacatgaaaatgtctccattagagaaatagaagctcttacaataagatagttagaatgttaaccctgagctatccaggatgtgtgcttatctagaattactcgttcctacatgatccaggctcgctgaggatttagcatactgggccttaagagctatgatctgcttttttatttttaatatttttggagatattcttccttcctgaggttacccaaagcagtatcctttggccacattttctttgagctctagattagaaaaacatttataaccacccacaaacacaaaactttttaagatgaggttttggagggtaaaaaacttatgaactgaaaagaaaatttggttcctgttggcagacagtgatactttctttgagttctaattatatggaataatttgtaaatgaattaaacaaatgcaaaacaaagggattatttttatgttttaatgtaaatgttgcattaaaaagactgaggattgacttgaatagattggaagactacttcattattaatgattctcgtgcttgcctttggaatctcttgcttggctggattatgtagaatcggattttaaggctttgatgcaaggatgacctcgatcctgggctgcctgctactctcataggttcttaagccaaaagttgagatgatttgcaatggtagggggacaagacagattagcaatgggagatgcaaagagtggagaggctcatcagagagatgaggaagacggctttgcctctgacccaggtgtgaatcagttaagtggtggaaattaaagaggagatgccaaaaagcaagaagtatcagtaaggcatagactggtgaacttggatatctgtaacatatttgcattcataaatgcaacgttttctctcttgccttgtgcagacctggcctttctgcatctgtgtctttttgaaacattacaggatattcaacattagcacctaattatgagcccatttcaatgttagagcctgttttatctctgctttaacgtggtttaagtatgtctgcaaaggaagaaagtttagttacattgttaaccatcctttttcatgtctcaaagagtagaagatttgtttatctaacagattttgccaagaaggcagtgaatgaaatttcagttttgaagtatatttgaagttaacattttgagatagggagccaagctcagtcaagcaacactttcctatggaagcgccttcctttgagctcagcataaatcatgccttaaagtaactttcagcctgattagtgttgtccaatagaaatgaaatccaagccacatatgcaattttaaattttataatagccacatttagataagtttaaaaataaaaagaaacagtaatatattttatttaacctaatatatctgaaatattattttaatatgcaaacaatagaaaagttcctaacgagatatacacatttgtcatgccaagtctttgcactattatttatttcatacttacagcacattttaattctgactagccacatttccagtactcattggtcacttggggctagtggctgtcgtatttgacaccagggctttagagaactgaatgagcaaccaaaagatgactgatttgactcagtttcctactggggaagttttcacatcaactatctctaactctcccccatacctacacccagccctgagcaccccaagattgctgaacttttctcacactgaaatagtcaggatgtcttatcttcacaggtggggaggatacagagctgtgttttcacatttcgtagtaaaattcagctgctgttctctgcccgtattctactcagctttgaatttcaaccccttggctttcccatactgagcagccaacgcaaactattgttttcaatgacacctgttcctttcgaagaagatgaaggcagtaagcagatttgtgcttagtacaaggtgttcaagtgaaattacctatttattttggtgatcaccctcccaaattgctagggtgtatcttcatctggagttacataaataggatttgcccacctcctaaatagagtgtgtgataatggaggtaacctaggcatcctcctacgctctgccacaactgatgctcaattattccccagaacacctaatgctttatgtaacagagctctgagagaataggggagtggcaggcaaaaatgaaatagatatttcaaacatcactcctatgtgaaacatatagatttggcatttaggtggaaggctcttttttccttccacttacagagtttgttaaattgcaagcatgccttggtgttgccagagcaatgtcttgtagctgatactcacagagagctagtgacttgtagacttctctatacaagcatagttgtggataaagccattctagaagggaggtgacccctgtacaataaagcctgggttgttgcaatgtgagatcaagagagcagaacaatcttctattttgttaattaatctagtatataaagtcttgcttaaattaggcataggctcaaagtctgactcacagtcttttatgttttgaaaatgttcaaagaaggtggaaccaaaatgggtgaaaaaaacttgacacatatttgaattgttctcatttgttcatatttgtaattctttaaaacgagacagacaaacgtacagcatacttttgtggccaagaacttgggaatcagatcctaaatctcaatgcaatgttgtactttgggtttgtgtttggaatcaggcatggtttcaaatcccaactcttgtatctactaattggatgacttccagcaagttatttgtgagccttagtattatatcataattgagtcagcagacctatctttcagagatggagtcagaattaagcagaatgatgtacataaagttattggacagtgatgggacaaagtctgactaaataataacaccactgaattttaaaatttaacatgttatcagatctccttcaattatttatatgtatatatgtatgcaatgaaaacataatgcactagcctttttactgaattattcttattctaaaacaggaaatatatacaatcatatggttttatttaagctaacaaacatttgctgagttttggtaatgtcaaataacttactgttggatactgaagggtatatttttgttcaggtcgtaagtatcctaatatcctgtacatatgaatggccgttaggtcacagcttccctcctgtagctcttaacatgtaatgcctctagccctgtggctctcaactgggggcaattttgccctcccccacccctactcccccaccaagggacatttggcaatgtctggagacatttttgtgtatttgcttgccacatcttggggagggtgctattggcgtataagcaagtagaggtcagagatgctactaaatatcctacagggcacagaacagcccctacagcaaagaattatccagacccaaatgtctacagtgcctaggttaagaaacatggtcttgatattatgtatttttctagagtttattatgtctttcatcatttgtgactttggccatgctatgaggactgtctagataaaaattgtccagtcatgagctggttggacataaagctgtgactacttgaactcaaggtgatacttacctaatagcatcgtcggagggaatttgttcattgggcgggaggctggattagctgcttttggatgctcttccaatcccaggaatcccgtgcttttcctcttttgtcacacaaagctatatttcagcaagaatctctcccaaactttgtgttcaccatgaccagcttcttctcagatcctgccatcaaggccaagcagagtatttttggaatgtggatgaatgtgacaagaatgttattcttaaatagcaattctgctatgcaacaccatgatacagtctcctgaatggatctgattccaagtggaggcttgaactctaatatttaatagtaaactatagaaaccttatcaagataaacagcactaggagtttttaattctatttacatgactagaagttgacattcatgtccttcttgaaactcagacccccaaatattgggaaagtcaaatacaatacggcacagtcacagcatgagtatcatacagtgatagttcatgctaggttaatgtcaaacattaagagtataatgctgaaatatttctggatgaaagataggatatctaggatttctttcaatgtaattgagtgggacagaaatctaaaagttggtgttttaaagagaaattggtaagccacagctgtgaaaatggaggcttaggtggtttgcatattggctgccttgaactgtaaattccacctgaagcagaggtaaacgacagtgcttttagccagggggggacggggtgcgggggggcacgttcattgacaatattattgcaaggtatgttggttcttttttttttcatgactggaacaatgaccagcttcacttcgtcaccttctttctcttctatgaaatgccttccctccttaaacctaaatccaatgcatccctgaagacctagctcaattatcccctccccctggaagcctctaaggtcttccaaattttattaatacttctccactgaactcctgcagtgatgcatcttttgcatgttttaagaaattgaggtctagttcacataccataaaattcccctttttaaaagtgtacaatttagtagtttttagtatattcacagaattgtgcatttatcaccacatgttctagaacatcctgatcacctcataaagaattgctgcattcattagcagccaaccacccctccctttccctttaacacctctggcaactactaattactttctgtccccatagatttgccttttatggatatttcataaaaatagaatcatataatatatggccttttgtaactgtctcctttcacttagcataatgttttcaaggctcatctatgttgtacatgtatcaggatttcattttgtggctgaataatctttcgttgtatgggtacgccacattttgtttattcattcatcagctgatggacatttgggttatttccactttttagctattatgaataatgctgtgaacatttatgtgcaagtttttgtgtgtacatgtgtttttgtttctcttgaaatgaaatatagctaggagtggaattgctgggtcacatagtagctctatgtttaaacttttgaagagctgccagacagttttccaaagtggctgctccattttacattcccaccagtgatgtaacagtgatgattaaaagcaatggcaaaaactgcaattacttttgcaccaatcttaatacagggattcagatttctccatatcctctttgacattttaccctgcacaagtctgttgatgtcactatttgtcctcaggattgattatcccacatcccaaattagtctcacctcccaaattagactgtaagctacttaggacaatgatccatttatttggtctttatttaagccagtggtttttttttttttttttttttttgattgcttattgtgtggcaggaactggtaagtgctaaggctttaattaagaagctctattttgtgggggaggcacataaaatcacactggcctgttttggggtgatgggtgcagtaataacagcctattcaaggtatagcctttgcttcatatagtttccctcccacaatgtcatacttacaaacaccactcaagtctactatttaatacattctattagagaggaacagatctctgtgtgtgtcctctttttagtccaaatgtagaagctctgatttttctgttgggcttttgtgtttaaatgtgcttaaagaaatcaatgccagcaatatttctagcagtaactttggatgtaccatgtaagttattttgaaacagtgaatcatcacgaatgttaatctgttgacttgtatgtataaaagcttcttgagactctaggctaaggagagacaaagcatcaaaaatgtaattcctctggattcagaaataaattatccacatgccattttcacctgcagttaatctggttttatgtttgtctttctgcaactctcattcagtgttttggagaaattaggacatttagaattcctaaatgacatcaaggataaaaggaatcaaactgcaaactgtagaaaagaatgcattgttatactatatataaaggtataattatataattatgactataataattaaaacatattgtgcttaacaatagtatcaaattgttttcatctgagttcttaattacctaatataaatatgtctatgccagccatgccaaagcaggtacctaaaggaatttcttatatctaggaaaaaacgtattgatcacctcatgcatttaagggacaagaatggcactttcattccagcttataaatcatgtcaattttaacaatgacttaaaaattcttttgtgatttgtttaaactctgaaaagaggcttgtttgtgttaaggaaaaatcaaactgagaatgagttatgtgctcatattatatatagatgagtaaaactcttactccctctgcaaacattagaaaacaataagatactcccacggtttctttttttttttttttttttttatagcacttacgcagtccttactatttaacaggcactggtttagaatttttacaaatacttctttaatcttcataacaaccctaggaaacatatacaattattatccccattttacagataaggaacctgagagtttcagtaacttgtgtaaggtcaccaggtagtgtaagcccatgagatttggcaccttttccaaagtggagtaggcctgccccagagtaaagagtgcctgttctagtctttatctcaaagaaagcagtgatttaattagttactatcaatgtggggaatctgttggtctgacatcattctaggtttcagaggcaacttggctgcaggttttgtttttgttttcgtttttgttttcatttttgttttgagacagagtcttgctctgttgcccaggctggagtgcagtggtgtgaccttggctcactgcagcttcgacctccctgggctcagttgatcctcccacctcagcctcctgagtgcctagaactacatgtgtgtgccactacacctggctaattttttgtgtttgtattttttgtagagatggggtctcaccatgttgcctgggttggtctcatcctgggcgcaagtgatccgcccactttggcctcccaaagttctaggaaaacaggcgtgagtcaccatgttcagcttgcaggatattttcatacagcttaggagagcaatgaaattaaatgtgagagataaaatatacattgtcacctacctgtttgatggtatatataatggattatctataccatacattatacattatagataatatatattatattacatcttcatattatgtatagtcatgctgtctttgatatacatacacatatatatgcatatgttatacacacacataaatgcttagccccttgcaggctaccctttcccatgtgcttccatgtcttgggtaataattcttctcagactttcaggaagtacagtgctactaatattcttggaggttattattctttcttcttggtgaagaggatgttgaaagatcaataatttccatctatctccagatagtaaggatgccttgtaggagagagatctgaagaccctgacatgtccacagctttgcagcctgattctgacctttctgctttgggggcaacttccatcaaaaggagtttcttgtcgcagttcttacaggcaggggcatctcacaacagttgctagtaatgataccatctactcccaagaatgggaaacctatactcatctacttggcctcccaaagatggatcccatttagggtgtgtgtgcacatgtgtgtgtttgtgtgtgtatatgttttaaccaaaataattagtgttaccaaatctctaggcctccatgcctagaggatctctcattaagtaggatattctatgcgctcatactagaaagttataaaggcaaaaaagacactagattaaaactgataatgtccatataggttctgagatttttttaaaaaaaagtctgagcttatgttaaacagaggtaatgaggataatcagttgtataggcttccctaatgtaagtcagcgtctctcatcttggcattcattccagaactgtttttaaacaggcttgcatgtgcacagtatgttaccttgccttctaagtactgtcagaattggactggtacctagcaaaaatatcaaaattatgagtcctagaacagtgcttggatgtaataagcactccgtaaatacttttggaaaaaatatgttgatcaactacggttttattagataatttaaaaaagataactttaacccctgccctctctggaggagagagttgctacagtaagagggagcagtcatccccagacctctctttgatgcttctgggtgtaagaagggcaattgaaaagggatttaggaaacaccaggcatgctgggtgagtaatatggctgccacctaagagaccatcagggaagtgtcttctgtggtatcatgccctgagccagaatgccgttgactgcttgactctgaagaaattttaaagtgttcctgagggtgagagaggtcttttgaatcagggattctcaaggtagcctatggtgatttgaaatgtttacattttaatatcacatatactctcctttctattggaagcaactaaaactgatagtgaagacttatgcttttgctgtaaagagtaagagttgcctatctgtggtatgatagtactcctagagggtgattcataggttaaaccattggaacagaaaagagaaaatatttttacttggccatgctctcttttttttaaaaacaaatattactatttttttaaaagccatatcactggcatagttttcagttgtttttacagtcggttgctctttaggcttacaatctttaaccttgaaattattcagagataattatttttggaaggaaagtgacaagggaaatagttatgtagtcaatttttgattatccaagatgattttgccattagaattagtatcttattttagcaaatagcaacagtcaccttctctctttgctaacccttggaacaaaatgttttataagggaacagaactgaattttatttctcctcctgtgccccgggcctgtcttatattttcactgccggtagtacctaatgttttccccatttcagcagtatgctggagccagcttgcgttggctggagaaccagttgtgtgcatctcttcctaactgcatgtcctgtgtcctcaccttggtaccctggaatccgccacaatgagtatttatattatggaaattaacaaatggcgcaaatcagagctttcctccagagaaccagttgttaaatgttttatcagcacactgctgccccattgagtccttcctttttgttttttgatgaatattttctaaaatgtattagatgttgctgtctttgcaaacagggtgtaatagaaaaatttactatttcctggtcccattattatacttcatattgctgggttagcttcttagtgtttcttcacttttcccttcagaagagggcttcttccttctgaaatcttccactcagttcttatgtgttgattttgattgcccttagtccatcaaatgagataaccaagtccataaatgtgcatgtagaataaaatgagagttagaggacttctgttacagaataaacctcttgaataaaatgcatggccttagtccagaatttttgtgacaactagtttgattgccaacaccagctttatgagtatcctacctgtgtggtcgcacagggcccatgctcagaaggacaacatgactaatgttctgctgtcatcattttaaaattattaatctgagcaagaggtcctgcattttcattttgatcagggctccataaattatgtagccaatcctgatagttgttcagatgccttttttgcttctgattttagaaagctgaatttcttagaagtctggtgtgtagatcagtgggctgtttctatattaaccacagatggatgcttggtcagatcactataaatactaaataagtagtaacaaaaaaatgatgtttattttcattcattatattgtgatttttctaaatgggtgtcctaggaaggaaaatgatacattataatgttactcacttattttgaatgtataagattaattttaatccttcacttgcaagtaatttctggttctcttattgagatatatttttaaaataactttattgaagtaattttacatcataaaatttactcagtttaagtgtgcaattcagtggtttcttaataaatttacagagttgtgcaacattcccacaatctgtttagaatatttccatcatcccaatgaaattgttcatccccatttgcagtcattccctgttcccacccccagccccaggtacccactaatctactttctattggaacagctttgccttctatggacatttcatatgaatggaaccatacaacatgacatgtggtcttttgtgattgacttctttcactcagtattatgtctttgaggctcattcatgttgcagcaggtcaatgcacaactttacgctaagatttataggatatgtgaggttggtgtaggacaaataatgcttatctacttatctgtgagtgcacatttatttttgctgaaattttcattgagaatggaaaggtagccccattgcattctacaggaagtccatttttggcttataacgcttatcattttggcaccttctggatcaactactcaccctaccttctgagaaactttaagctatttatgagggtgtaagtgaacttaatatttgagttcaattactaccaagcacactttctggaattactactaaattgcaaacatattgtagcagttctaaagacgcttttttgagttaatgttcatcaatatttaaaaaatatttttctcagtattaaaacaagttaaaaataccattgataagaattcaggctctgggctgagacagctctcagtggaaatcctagctctgcctctcaaagccatgtcctaaaataagctattaaatctctccaatacttgatttcctagattatgaaataatactacacactacctcagagaatcattgacagaattaaataagtcaggtaatgcattgaacacagtgcttagtacaacaaatgttactaaatgtaaacatttctacaatgatgagtgatgattctgttatgtacagatatgtactaccatttgctagtgtatcacaacagaatagaacacatcatataatatgatgcaagttatattaataacataatgtctatgcatatattttgttatatccatagaaaattttaacaaattaatagcacagtgtgtggcctttactacactcaacaaatgttagttatattattattatcattattacttacaatggctttcttcagggggaggaactataggagatttcttcttttcacagtatatttctgctgtttttggtttttgcttttgtttgttttctttaaaaaagtattacttttttaaataggaaaaattaaagactaaaaaacttaaattgctcttgaatagatttgtaatcattatcatatactctcttaaatcacttattattcaccttttataatctttggaataaataataattaaaacttccattttctttaaataagaaaataatactgctttataaatactcagtaatacaaactaactgactatttcctgaatttgatagtgtctttttcaggatatccttcttgtaattcagtaaatagaaagggcccccattaaaaatcacatggagaaagtagggtgtagggttgggacaaacacaccaacgtgacttgccttgtatctcttatttcccattttagatactggtgggttaaatttacttaatatcaagttcaaatgtatgtacagtcttaggacttggttgttgattcttaagagtgtgttgaaaaaataaagaagtcagctaggagaagttgaaagaacttagactttgaattcagatgcctgcctttgattcttccttctgtgattttgtgctctttggcatctcaaaaactcagttttcctaccttgagaatggggaaaatccccaccctatgagtttttcataggcatcaaatgagacaatcaatttgagattaagctataaatgtaaagcctcctccaaaatgctagccagtgtgattttttaataaggtcattatttttcttccttttaggatttctctctcccaagaccaatagtactaaccaatattcaggcttcattcatgtttcagcagggcatgggaatggttgtgggtttctttgagctcactggccatttattgttattgattaattaactcgtgataaacagctggtgaaaaacccaggataaggaaatgagagtgatggggtggggttgggaatggtacataggaggaggctggaatgatgaacaggaaacagccatgcagaactctgctgaaagagccttccagaaaaggaaacgcaaaagctaaggctggggcaagttacctgtattaatataagataacatcaaatgggctgtccttccagaggagtaactgagcttcctttggtctacaatggaatttcttcccattagaaaatttgacccttttttcttgcaaaagataagccaaagatatgtgaattgcatgacagtgatttaggatggaacaattccttatttgaggaatgcttctttttctattttacttctgtgcccacatagcacccagcttacaactaggagcttagtcatagacagttctcaatgctggctgcacattagaatcaaacaggaagcttttgacacctcactattccaagtgtgttccttagaacaccactgttgacattgcaaaatgcagaatctcaggcacaccccagacccactcaattagaatctgcattttacgaagatccctaggcaatctacatgaaagttaaagtttgagatgtgctgtacaatactgtgccaaagatcaagcttcactcctagagcttctgatttatttggtctgggaagaagcctgccttggcatcattttaaaaaagaaaaagaaagcttgtaatctccaactgatgagaacgtacagcaaaacttgaagaccactgacttgattgttctcactcacaggccctcaatcactgatgactatcaagcacgtggaaatgggattcatcaattatttaaattgcttgtttgagagtaccagttatgttttaaagttttctggcttttttttttcttttcttttctttttttaatcatactttaagttctagggtacatgtgcacaacgtgcaggtttgttacatatgtatacatgtgccatgtttctgtgctgaccccattaactagttatttacattaggtatatatcctaatgctatccctccctcctctgcccaccccacaacaggccccggtgtgtgatgttccccttcctgtgtccatgtgttctcattgttcaattcccacctatgagtgagaacatgtggtgtttggttttttgtccttgcaatagtttgctcacaatgatggtttccggcttcatccatgtccctacaaaggacatgaactcatcgtttttcatggctgcatagtatttcatggtgtatatgtgccacattttcttaatccagtctatcattgttggacatttgggttggttccaagtctttgctattgtgaatagtgccacaataaacataacgtgtgcatgtgtcttcatagcagcatgatttagaatcctttgggtatatacccagtaatgcgatgtctgggtcaaatggtatttctagttctagatccctgaggaatcaccacactgtcttccacaatggttgaactagtttacagtcccaccaacagtgtaaaagtgttcctatttctccacagcctctccagcacctgttgtttcctgacatttgaatgatcgccattgtaactggtgtgagatggtatctcactgtggttttgatttgcatttctctgatggccagtgatgatgagcattttgtcatgtgtgtattggctgcataaatgtcttcttttgagaagtgcctgttcatatcctttgcccactttttgatggggttgtttgtttttttcttgtaaatttgtttgagttcattgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctacctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaagtattccctatttaataaatggtgctgggaaaattggctagccatatgtagaaagctgaaactggtttccttccttataccttatacaaaaattaattcaagatggattaaagacttaaatgttagacctaaaaccataaaaaccctagaagaaaagctaggcaataccattcaggacataggcatgttttgtggcttttaatgaatactcttaataatttgtaaatctttctctagaatagacttctagttcccattagaactagactagtggttaacattactgttatcacagatcagagactgggatgcatgataagttttccttgtcttccttcagctctaaccacaccgactttctcatgtttgggggtgatattatttctcactgtatttgcattgcaattctgaaaaatatcttcctatcccacctctgttttgttttccatgaagtgagcaaatttaccaagtgatttggaagaaatttatataattgtatagcttgaaaagcctttttttcccctacaaatgtattatttaggacatgtaaaatttagcaaacacagatattttaagcataatttactaaatattgatgataacgcatgctcagaagtcttcatttagaggactctcaatttgtctgagtgtaaactcaattccaacaatcaaaataatttgatatctggtttttgctttagcaacttcacttggttggccaatgttttaattctccagtccttgatctctcattgtggtaaacccacaggataattttattagtgctttgattttctgtaagaggcttttttgtttttctttaattcagcatataattggtgcatgtttaaacttatttgtgtttcggttgaaaggcagttattagtagagagtatcaatagagagttattatagagagtattagttattatttgcagaaatgttaaccttactatctagagcaggatctttctgcctcagcacattgatattttggactggataattctttactttaagggatttgtcatgcgttgtagagtgtttagcagtgtccctggtcgatccccggtagattccaataacaagctgccaatcatgacaataaaaaatgtctgaaatattgccaaatgtcccctaagggtgcaaaactgcccccagttgagaatcactgatcagtagagatgaaaacagaaaaagaatctgtaggcattttgtgacctaaataagacattcttatctccgtgttgctagcttttattttgtggctgagtgaattgttttcagtgtgaagaccaatggtacactggatttctatttaaagatggtttcaaatatgtaaaataattgatagtttacaagccacccaaacatatttccccacttccttttctgagtttagttgagaaaattttatatgtagaaagctgaaactggatcctttccttacaccttatacaaaaatcaattcaagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaagagaaaataccatcagagtgaacaggcaacctacaaaacgggagaaaatttttgcaatctactcatctgacaaagggctaatatccagaatctacaatgaacacaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaacggtgatcattaaaaagtcaggaaacaacaggtgctggagaggctgtggagaaataggaacacttttacactgttggtgggactgtaaactagttcaaccattgtggaagtcagtgtgttgattcctcagggatctagaacttgaaataccatttgacccagccattgcattactgggtatatacccaaaggattataaatcatgctgttataaagacacatgcacacgtatgtttattgcagcactattcacaatagcaaagacttggaaccaacccaaatgtccaacaatgatagactggattaagaaaatgtggcacatatacaccatgaaatactatgcagccataaaaaacaatgagttcatgtcctttgtagggacatggatgaagctggaaaccatcattctgagcaaactatcgcaaggacaaaaaaccaaacaccgcatgttctcactcataggtgggaattgaacaataagaacacatggacacaggaaggggaacatcacacaccggggcctgttgtggggtgggggaagcggggagggatagcattaggagatatacctaatgttaaatgactagttaatgggggcagcacaccaacatggcacatgtatacatatgtaacaaacttgcacgttgcgcacatgtactctaaaacttaaaggataataaaaaaatttcttcctttcttccttctgaattttaaagctccttaagtcaagtgaaaaatctagtcatttacctgcgaagttcaaataaggaaatgactttggctacaattattggagtgcttcaggtgcaagtggctgtttgggcctgataatttagagatatgggacctcacatttactctctctgcatgcaaagcagtgggtctcagccctagctgcaaattgagatcacctgggagctttagaaacttcatacccaatccccaagccccagagattccagctcagtggtcgagggtggtgcataggtattttgtagagctccccaggtaattctagagtgcagtcagggttgacacccactgatgtaggtagatagggctttgctgcctttctccttcattgatcactttcccacatttccctgtagcctgctttcttcctgtctgcaacatcctggtcaaactcttctgcctatcccttgttattatttttaaccaaatgattttttccaagtgtttttcctttgttcagacttggacttggcgtggaaactgctggatcagtctacttaatccatgaccttctttcagctgctgccttcctttcaactgctgcctttatttcaactgttaacctcagtccaccttaaaaaatatatatggtttttaagcgggtatttcttcctttgccagcaaatcattatacgcagttcctgtctatgtttaccaccatcacttgcctctatttctttttccttactgctatttatagtttaattttctttcttttctttgtgctcttttttattcatgtttccatccttagatgacatgctcacgttttgtgaattaggtgtgtttcaagatgctgggaaagtaagttttctgtgctttataacttcagacccgtgtatttggtttgtgtcttatttaaaaatgtatgttcttatggccctgtttgccccacctaagcgtttaaatgtgacacctcatgtctgttgggctcccaggttcctattatggccggtggatctgggccaggcaaaccatcctaggcctcaggcatctcgtcacgtctagattcacctctccccttcccacaagacaggctcacctgccttccagccctgtagctgctggcctctccctgaactccgtggtctctagcaacctttggacttctaagtaatattgcaaagatctttatccttggcttgcttgagagcatttctgctaagccctaccagcaactttcatcttgtttcctcagttagttcttctaaaataaatcataaattgccccattgctaaaacttacgtcacattctttcaattctagtatctgagtcattgcaaaaaggcatctcaggttcgttccagagatttggcaggggagcttcccacaactcagcaaagtgtttggcccctttgggccttttcactgagacttgaggctagatttgctgtgcctgctctgtcctttcccttctaatttctcaggaattgtctttgctgtcttcttgtgttctctgagatcacacttccacagctgttccagaaacatcacaccacttgtatttttttaaagccttagcttttgcttgtgggttcacttgtacaagaatattaacgttgactctcactttgtgtaatactagtatatcaagctagtcttttaaaaacaccttttttaagcctttaagcccaatttatatatctcatttttttatcatttttgcattaatgtttaaaaacaaaacaaaacacaacacctttcttttgatcccttaaataccagctagtgagactttcaaatctagcacttaattttttactgagcatctaaatattccttacaaaatttaaacttctagatttaactcatcagatttcctcaaacacttaaacagagattgcaaacttaaatcattaagtcccaagtattttagttaaaatcataagttcgatatgtcagattctccaaaacaattcaaacacctcaaagaacaaataaaacttgcatatcctaacatgttgattccagaagttatttttacactcaactcaattgtattaataccaaagtttgattaatttcttcatttgccccatgtattttatcaatattactactagtacctgattagtattaatactggtagcagcattatcattagtattcataatagtgttaatgctagagctatcatcattattagtaccagcaccagcactattagcatagaattagccttggtcttagaattatattagtattagtatacttctcagagttgcaaggttactgacccaaataaggaaaacagaaatgatagatacagttattggttgagaatgtgacttcaaatttataaattgggggttttcagtcagagattttggaccaagacaccaagaactagggtttgccattctgattcctcaatcccactgggcctttattgtgctatagtcatttatacagtagtaagaatttctaagcttcaaccttttcttgtagtctggtgaatcatggtcatttatacttaattttcttacagtgttttcttatgtaatttttattgaaaatttctgtgacaactttttattgcctgattggagagggtgaccaatcatccttgtttttccaggactggagggtttgctgggacatgggaacttttcagcgctaaaaccaggaaagtgtccaggatgactggttatcctagattctaggccagtggttctccacccccactagaatggtctggggaacttttcaaacataccaggccccaagccccacctccagagattctgatttaatttgtctggggatagtgcccagtcattgatattttttaaattttctcaagtgattttcctgtgtagccaaggttgagaaccatcattctgcattctctacccaatttgaaacaccctatgcaacattgtattgtctactttgacctcctggaacttagcaaaacttgaatttgacaagcatgtgtttgggttcatcaatgtgaagtatttccagtaaatattcctgggggaagtcatgcacatctttcttgagcagattatgttatttgttgtttttgagtatatgtgttctcatgacttttcacagagttttttgttgttgattaaactgtcatgctttcattagtgacaactgcattaagctggtccatttgtccagttagcaccacccttgaaagtattcaagcttcttggtaacaacaaagtgttccagactcatcctggtttttcctgccacaagacatggaatcaactacttttcaaggatccctgtgtctttcactttttagttgaaagttttagagaccaaaatcttggctacccgggggcacatcgtgttgttttacaagagcattcatagtaggtagatcttggatccatgatcttatctgaaattgaaattcttaattctctcacatggtttttgtgcatccccattgtccatcctgtagatacttttttatccttattctttttttctataaatcaatatggtgttctttgtgtttttttcaagcattaaaattctgtcactcttttatttactttcctttcaaatttcaactgagaatcaggaaaactgtgtgtatagacttcatttattttctagtttattctgagaggcaaggggaagcaccctgttgtcttttccaggcacaaactctatttccttttatagtttgataatttcttcgttctccagtactcatattttctgaagagtcatcactccttagcttatttcttcataagttatagccaactgagttttatacatgaagtggaaagtggattttcctctgaaatgagaggaagtaggtattttgttgccttttaaaaagaggtagaaatgtacgagcaggtcaccctctcagtcctcatatgggctgataatttgtacctgagactatagatttaggatatggggcagaaattgagtcagaacagtacagccaccaatggcagagaccacaggccaaggctcaaaaataaaacccacataaatgttattttagtgagttttgccctcatcctgggttgttttgtagggaaagtgatgggagagagaagggggcatatcttaagaaggcagtcccttttgcagtgttttctgacttaatcttagacctaactcttaattttagaattcactctgagaagatattaggcaaactcttactatcaaaggatttccctcatttgggatcctgagtttcgtcaagtcacttcagatcagcaataaaatccccttgagagtttccagatttttctccacaatgaaccatgaagcatgctgtttatttgtggaactcccactcctggttcttcagaactccttcatttgccgatctaaagatagcaaaaaaggctcttaaaaatacacgccttattgattttggaatgttctggtaaatgccaatctgattgatgtcatttatgtagggaaggctttggcttaagccccaaagtgattttagccaagaggaagtaacgtatctaataaataatgtggagtttgtgtattcatccaccaaataataattatcatcactaaaaatgtgactagagatgccacatccacttctccattgaggtaaatttctaacagacaaagccaagtgaaatttgatgtccgtataagctgctttgacctcgttgtttctgactttcattacagatgaattttcatttgtaattttgttgttgttttttggtttccttggtactttgatttgtttgggcaaaaactcagtgaatctgtagtgatttaggagacagtttaatcaacacaagtgcccatgtttcagactcagacatgcaggtgatatttattctgggtaattttgggggatctacaccttttgtttattctaagatgacgaagctgcattattattttatatgtaacatgcactcattgtaaaaaagttgcaacgatagacaaaattataaagagtggattgtaataagaaaaaattctgagtacatggcaggatccatatactatgtgtattcttgccttattttattgggacaacaatgaaaataggccaatagtttatcacatgaagagccagccttcacaaatacagctctgtggaattgtatctgagcataaaaacactctttatttaattattattaatataacaattaccaataacctttatatctatctatttacttatttatcttttcctgtggtggggggttcaaaggtttctgggagtgatcaggatgcccaaacttcctctaactttaaaattttaataagtaaatgaagaaagctccatgttttcctcctagagtttaattagctactaatataagttgcttagcccaggatctatcctatggtggtaggtgttcattatgtttagctaaaatttccatcaccattatcatctttgtcatcattactgccatcactaccacaaccaacaacattacaatcaccaccactgtcatcatcaccattgtcatcatcctttaatactaggcttgaggaagctaaagggagccaaatgtacatttatgtcttatgtaacattaatgttacttgtcttattcctaatgcctcatcttaaatgtaaagaaagtaagaagacccagagatagttaactttgtcgtctcttgactcccaggatcaaaaatagttgttgctgcagtgtttggaataaaaaagcttaaaagaccttgtatacaaaagtggttcgtactgccttctctcgtgaattcatgccagcagatatttttattctggtaggaagtaactaaaagctttgttcaaccctggtctgccagcctctgtaacgcacgtctgacaaatatgtgtgactctgtgagaaagtttggttctccccctggtggcaaaaggaaaaactaacactagtgctccttatgggagtgtattgatagggtacgagatatgtaaatacagctttacccttttcaccagtgttgcctgagatttttatctcagcccccttggttacttttgttctttggacaacaactggtttatatcttctatggtcgttgggatgaaagggatttgacaaactgacaaagcattttgcttcagaaaccacttgaaaaacacatctatgtttcaaataaagattatttcaggatcataaaaatatgctcggtgtattagccatggaactagattttaagcttcatgatcatagagatagatattgggtttattttattgttattgcctctgaactgagaaaagactctagaattctaaatataacgcacacacttgaactaagtagacggaaacttacccttctaggtaggtaactctgcttaccttccaaacagagtttggatgatattgcctcatagaaagattttttgatacaatactcaggaaccgctatggactgctgctttggggccaggccccatgccacttgattaaatacatcctcacttaacctgtccctacaacaactctgtgagggaggcatactcataccgaagctttagccatgtggacactgctcccctgaaccacatgcgtagtcaaatggttagggcagatttcagctcatgtctcttttattcagaacccatcctttaagccagtagttctcaatgggggtgatttgactcccagaggacacttggcaatgtctggaaacatttttggttgtcatacctggagaggtgctactagtcggtagaggccaaggatgctcctcaacatcctgtaatgcacagtgcagcccccacaacagagaattacttggtccagatgtcagtagtgccaaagctgagaaactgtactcctaaccagtgctactcaaaatgtattccacggaacagcagcatctgcaacacgtgggagcttgttagaaatgcagaatcacgagccctgtcccagacccagtgaaccagaaactccatggttggagctcaggaacgtgtgtttctacaagcccccaagttcttcttgcacactcaagggagagaagctctgctctaaaacaacagatcattctgtgtctattgagctagacacaatcgtatggtttcctcaccactttcagtgttccgttgtcgcatagaagtatctcctcaagcatctaaaaggggaaagtctggcgtacactaggaacaaatgtgactcatggggaaatcagtgcaattacaaatccaggaaccacacccagctgaaaatctaggaaggttctttttctcttattttctctacttaagaagggaagtctcggagacttagtctaggttcaaaagatgtcaacatatacacaggcttggtttggggtttgattatctaaaattaaaccttaaattgaattaggtaaaacccattttggagagccacagaattctaaattagaaattacattgagtttcgtatttactggcccaaataagtaatcttctctatttgtgcatttttctaatcacaaattgtcttctgagagccagtgaaataattatttttatatgggtctctcttcaataattgctcatcacttggtattttatgtgatttttgtggggcatacattataggcaaggatgtattgtaaaggataaaaatgtcagataaaacatctgtgtttaggtagtttgtacgtcactgtcctccatcccacctcatagattcctactgcttggctataactaagagtagaatttaaggctgacacaggaaaccaggcaatcaagttcattaagtaccttaatcaactctggccagaggatgatctcagagctcccctatctcaagaagaaatttcatgagaaagctttggggttacttccagattaaagattatgttctggacagttcaagccctaaacaacagacacatgaataagtggagccatttctatcatactttttcagggactgaagatataaatattgctatttgttattaaaggattttgtttgttaaacctgatgatacttatttttatgtgagttcatagtattccagctcttcaaaacctaatttgtttgtagatccctcattgtcatctttgaaaggttccagtagtttctggaatactttcttttcctatgccaaatacaacagtgaccaagaaatccatctgaaggatttggatagtgtggtagcatgtattgatggacccagtgttccactcatccctgtatacatgctctttaggtaacatgacagtgccctctaactctgactctggagtcagccttttgactggctttggccaatagggacatggagaagtgatagcatacctgttgtaatcctagacctcaagagacctttcttgttcacacttgtccacttgtgcttctgccatggccatgagaaggacatgtctgagccggattgctggagaggaatgagagacatgtggcgtagagctgcatagctaagcaactccacccaagcccagcctagagcacagccccctgcagatgcatgagctagtccattcaggatcaaccactctccagcttccgagtaggttattacacagcaatagctgactgatacacatgagtagagaagaaaagaattttccaagtaaagataatagtattgataaaaccgtgaagagaagggtctatcaacatgttggatcacgagaaagttggcttgagtgaagtagaacacgcttattgagaaataatcaaaaataaaactggatagagagtgctgactcaaattatagaggagtttaaaagccagccaaaagaatcatagtattgtgtgaaagtgccatagaaataatctggtgccaggtcttcaactaagacaaagtgattagtggccaaacaataatggtacccaagtcttaagtgtttgtaagtgatgcaataggaagagataatggaatgatggaacagggattttaggaaggtaaatacaaccatgagttagaaggaatggtttggctgtccctagacatattacctgtgagacttttgtagtattatggaactggagtcatgaagctctgaagcagaggatggtcttcgggaatggaaaggatagttatggaagaatttttgagaaagaaaaaatattccagttatctattgatgaaacccatgtttctctcctgatcacacttgatatttaatgagagagttcttattaaaagtaaccatgtccatgaaggatcttattgggatgaagaaagtgttctaaaactggtttatggtgatggtagcaccacttggtaaattttctaaatgtcattgaattgcatgcttgaaattgttgaattttatgatatgtgaaatatatatcaataaagctgttaaacaaagaaacaatgaaaatccccaccagttatgttccatagtccctggagggggctgttttcatttgaatacccaaactcatcctgtcaagtacaggtagcatcctcctcttctttctcagatgacactatacgcagcgaaccattggggtgcccacatgtgccacacagcctagagccaccactgtgtccatgccagtggtactccatgtagatgcagggaagagcccttcttccccatcctggcccagactgtcagtgagtaacaatgacgtgctgcttgtatccatcatgaaaacagtccctttcatcttggccagaaaccctcttttcctagatctgagatctatgtcctgtgtttgggcccacagatcagttccttggctccacttctcaactgtcccttccagttgccatccttcttactttttctgtcctggacctatctctctcactgtcgtaaaccctcagcctcatttgaatgttggcaacgaatgaatggtagcaaattctactactaaaatcccgctcacgaggggactaatcaaaggtgacattgaaataagtcttctggattttaagcacaatatggggcaaatgaggaaattgatataatctttttaaaaaatttaatagcattattgagctctgattcacataccatacaattaactgatttaaagtgtacaactcaacggcttttagtacattcctctagttgtgcatccattaccacaataaattttaaaatattttcatcactccaaaggaaactccatacccattagcagtcacaccctattttccccatcacccaccagcccttgcaaacactaatctgctttctgcctctatagatttgcctattctaggcatttcataggaatgaaatcatacaagatgtggtcctttgtgactggcttctttcatttagcatcacgtttctgtgttcttgattcaattaaattaacacaaaactttgggatccattttgtgccaagcactatgctgggcactggttggaaaaagagcttacctttctgggaaagcagaacaacaaggaaacaatgaatcccattccatttaacagagggattgatcatttggagtgtgcaagttgaagcatgaggtatgggactcacactggaagaattttgctctgcaggccatcaaagcaccagagtattgaaccaggcaaattactttaattgtgctcttgagtttattagatgtgaatgtcttgctggcaatcatggttttactatggaagcaaactgaggtcttggagagctcattctgtccttaattgtaacatttagtaccaagaccttggacatggtacctctctgggccccccttgtctcatcaggaggggtagaattgatggtctttgcttatattccacaggtcttagaatgatcagacctgacaatatatgggaaagggctttgtatgctgtaaaatgacaaccaagcatgattttaacaattgtgctgcacaaaataagcattttgctgtaataatttgtgatctcataagcattagtcttctattgatgcaataataaatgaccacaaacttagtgtcttaaaatactacaaaagtattatattctagttctgtagactagaattctgacacagatctcactaggctaaaatcaaggtgtcagcagggttcctttgggaggctccaggggcagatccctgccttttgagctcctattaatagaagctgccctcattcattggcttttgtgcccttcttccatcttgaaagtcaacagtgttgcatctccctgtgcctttgtgcttttcttccatttccctttgacagactccaactggaagagtctcacttttaaaggttcatgggattagattggttttacctggataatccaggataatttctccttctcaaggtctatacacttaatcatatctgcagtgttcctattaccatgtcagtcaaaatattcacaggttccagggatgggtgtgtggacatctttgggaggccatctttctgccaatagatgagtttctgttatttctctccttatcgcatctcactgtgtttgtatgtgcacatgatcatcttgttattttctctcttctgtatttacagtcttttttcattttctcttttcatgctgtatcactgtttatccttttttactatttctttcccttgctacacatttcttttttcccttattgttactatcctttactgcttcttagtattttctttgtatttcttattcatttggctatttatggatattttgaacttcctttatcttcctggctttttctaatttaattttcttatcaccttcctttgagccctcttggtctctatttttacacaacattgagtcaatctctttttctgtccttcttagcttcctcttctaacccttgctctcatgcagaattcttatcttcatttacacacattgtttaacttttgtagctccttcagccctgactgtgcagtttatatcttgacaaatgggaggcgggaaagcagacatagcagggagaagccattggtactgagaatcacaatccacatctacataaaaatgccccatgttctgcagccaaacttgaaccttttggagctcctgctaaaatctcttaaggaaatctcaaagacaacagttacatgattactgattacacatgcgtaaatatagaggtatgtttaataagaaagatcagaatagaatttggagtgatctaaattacctaggatagatgaagttctttttggtgtaaattttcttacaattacagcaacaacaacaacaagcccttcaaatataaatgtttcatgtcattgctttttcaacttatatttattttgtatgattctaataaagtaagcatttgatcagttgcagaactttcatgtatggacattgcagagaatgatgttgctgataatgaaatggcataatgtgtgtaaaactcaggttcttagtctttttaagccccagaacaaatctgttcagaataagatctaagttatacatttgctctccagaggaatgtatatgaagaaaattttgtatctgctttctggaggtttcattcataaattcattctataagtatttactaagcatatataaagtgaacaaaaacagagatactgttctaggcattaggaatacatcagtgaataaaatacaatactttcttttaaagagattatgctgtagaatagggagactgacaagccaataagtatataatatgccaggtggtaatacagaagataaggggatagaatgatggaggggagtcagtaggatggtagggaagctttctcaaaaggtgacaatcagaaatatgacataaaggagacctgatatttaaaggatgagtcaaccattgttaacggcttgctatcacttaggttcctgtgtgggaagtcaatttagatagtcagacaaagaaagccctttttgtctgttaatgtgaagaacaggttttagtttaacttcttacgcatagcagtgagtaactagaaattagcacattccagggacaacatactctttcagatttatttgattttccaatatggctaagcaaacatatgattattcattgaaatagtagctccagaggtggtattagattgcctacttctgaggaattaagagaagaaatggttgcagataaattttaaaaagctaacactttaaatgttatagcacctagatatacagcattgtccaatagaaaattttgtgatgctggaaatatgtaatatctgccctgtcccagtgaatagtcttcctcagaggttttctttatagcttccacatctctgttgtttgagatgtcccaaggaccacaaagatggaatctccaccctagagcccacctgagagggagtgactactcaaagcctctttacgagcaaaactgtggctcctaagtacctggccaagtcaaccacagtcctccaggatcttgttttgaattttaaagctgctctctcttgggcccactccatattactaccacggagagggtagctaggccatagtgcttctgtgaaggaggaagagccccttcaaactccagtcctttacctcaacaggcttagctatagggatgtctcctcaggcttgtgtttgtatcttcagataatttccatgggatattggtcttgattattttattttatgttatatagtcaaaaggctgataattgcttggtctcaataataagacattgcctcctcactgaaatattaatcagaatggtaggtggctgctatctctgtagagtaccaatcaacttaatctcatttggataaattttgaaaatgaaggaaagaaatgtggctacaaacaccatgttttattttttagcacctggaatcccactccaaaggagataaatttatttcactaaccttagcaaacaaatcaaatttacccactaactccacctatgcccaccctgcctaggagttcacacttgttcaatcattccattccattgcagcccaggtgaaaaaggctggttgaatttgagatgtgacctttgcttaaatttcatccccaaagtgtgcccctcagaatgtcacattcttttggtaaatagccctttcaaagtgaagacacaattatttcatgttatttatatgcttgaaatgcagaccttctgtttttcaaatccacaaaagcaatgatttaattttcagtagttaggaagtacttgggtcaaattttagccaccttgcttcaggataaatattactatcatttgcttttttctctctctcttttttttttaaacaatgtcttttttatgaacttgagagggctggtgatgattttgttttgttttgatttattttccccaaagtagagaaaacaagatctcctgttttacattttactttttattttacttaccaagcaggaatttgtcggtctgttgtctcacctactaacatctgtgtatcctggcattgaagattgggaatcacaagctctttaaaaggctgacacagatgggcagagatttagcatcctaattttaaaagtatatatatatatgtgtgtgtgtgtgtgtgtgtgtgtgtttgtgtgtgtgtgtgaaaaaaatagaaaatattcatatttaaaaatttagaattattagaatctttagtttcatggttagggatttgtatgaataatttttatttcaatatttacatatggcaagcattctataaacattccaaattttttgtacctgataagaaagaaaagaataaagcaatattaattgtggttggcttttgaatttccaaagtctttccttaacctttcagcatcagtagaattgtaaatcattgtcccaattaagttaacaataatttcgtttcttttcttttctttttttttttttttttttttttttgagatggagtctcgctctgtcacccaggctgcagtacagtggcgcgatcttggctcactgcaagctccgcctcctaggttcaggccattctcctgcctcagcttcccgagtagctgggactacaggcgcgtgccaccatgcctggctaattttctatatttttagtagaggcagggtttcaccgtgttagccaggatggtctccatctcctgacctcgtaatccaccctcctcggcctcccaaagtgctgggattacaggcgtgagccaccgtgccagtcaacaataatttcttaaccattctgtacaattcacatagcatgaggaatatgagatcaatatcccaaagtgaacatgatttttaaaaaatccattctttattaatattcacttggtatatatttaatcactgactcattagtcaagaagtatctgtagtgagaaaaatgtttagctttaaatactggtttcatgtgggaaaaagttaatatataaacatatagtcagtatatactttatttactaagaaaacacaattttgctgaattttccatctgattataatgacacatctagatattttaataataaagctacagcaaatacttgagggtctttgaaaggagaaagcaggttctatatttcaaaagtagcttggatataaactgcaaaattatttctgcagatgggcttgtttccccttttgttttatcaactttagatatttatgtcttaaaattaactaaagcaggacacagaaataaccctcttctccatttaaatatatattttttcatttgggttctagattctcaaatgattacacatatacattgttaaaagcttatgagatacattaaatctagattaaaatgataatatacttttacagagacatttcctgtagtacttacagcagagtcgtggatcaactcatctattcctaattattatgtagatattaggatatgagcatgagctcaagtactagtatttattttatgatatactggcagaaatcagagctgttgaatatgtttacttgttatctttttcattaagtttccaatatataaaactaggcattatctttctcataaataatatttgattaatttgttagtgattaaccatataccaaagggatatttgcatagaaatttttattccaaatctctccattgtagcttttaattacctctattaaggattatagtaatttaaaattattaaagatatctatgaattcttcaaactaaatcactgaaatgtcaatgcaagcttaatggttttgttgttgttgtttttggtaaagtagcatggtcttttagttaagaccagatagtaaatattttaggcttttctgaccataagatctcagtcacaactctgccatttgagtacaaaaacagtcatagacaatacacaaatgaatgtgcatggctggttccaataaaactttatttacaataacaggtgatgggctggatttggtccatggattatagtttgctgacccttgcttagaggataaatagctgtgtgcttgtagaaccaatctggtgagggaaacacttaagggaccatgttaattttaatgttgcacatatcctggttgctgttctctaggaaatagccatccctccagtcagataatgaaaatatgctggtgatttctcttctttctgcatggaaatcttcttaagggattttgagaattatccatcaagtgagacctatcagtgctcagtgcaaccctggtggaaaatataaattagttattcctactatttctataagtaggccctccagtcattgtgatagttgggccaatctttgttaagaacatgttgttgttgttgttgttgttgttgttgtttgtaagcatactttgaaaatgacctgccatgtaagtgtcaagaatagttaactcaagatggaatcatgattgacctgtagagtgtgatgggcctcaggaagcatgccctggtagttctgtgagttctcactagggagagacattttattatgttcttcatgccataggtactatggtctaagcaagtgtacaatgaataagtcaatgaattaatcaatggaaaattatagtctatagtgagctttgaattgtaggaggtaaacctatagcacattgtcacttcaaactcaacatccagttttacaatgactaagtagagattttctagtaagaaaattatccaagtttctgatatcacttttattctttcactggtgactctacccagagagaaagaacatgggtcctacattaggactgacatcagaggaaagagaaatgtttatagccagaagggaccttgaagatgaggaagagaataacaattttgatgactgcaacaatgatgttgacgctataggtttaaatagtaagttgttatttacaaaatgctgtttcagtcctatcactttccatgagttaaaacgaaggtttagattatgtgacttttgaaaggctaaaataaagtaagtgaaactggaatacttggaattctgctacctgatacccaattaggaaaaagagaaggcaaagtttaaaacaaggtctaggttgatgagttggtctattaaacttttctatttttctaatattcattctctttcttctggtaattctgggttttagaagagtatatacaattgaattgcttctgactgctgctattgacgcatgctaactaaaggaggcagcctcagcccagggaatttaatccagtcaagtgataattaagcatctatgaattggcattaattgccaacttttggcccttcctgtagatctgtccaaaccttgattgtaattcctgcatgtactgacaacttgatagtttagcatatcccagtgtccatttttaaggcactatccaaaatatatctctgctcattaccctttgatatttatctaaacaagtaacttctgatgttaagctttgagtaaaacgggggaaatggcagggaagaactgggcagagaaaacgggggaggaattcaaactacacttgataactgtgatgatgacaatttcagctaccaccagttttgaacatttacaatgagggaagatagtactgttttatatttattatttcatttaatcttcacatcattcctctgagataattgttattctttgtatctcatatataagaaaactgagttttagagggatcaatacattgtgtaaggtcacaaaggtatgagtgatgagggcaaggtttgacctcagctctgtggcttctaaagagtatcctgttgagcactaagcaatgttatgtcataatagctgggctctaagtcatggctaactaggaaaacttggagacccttgttactcaaagtgctgtcctcagcccaacagtatcaggagccccattccagacctgctgaataggatctacattttcacagaagcccccagtgatacattaaagcacactaaaatttgaaaagcatggccctaggcttttcctagacaacccctgcccagtagtctgaaagtccgtagagatactttatcatcaggaaggggagtaggcaaaaaaacaaacaaacaaacaaacaaacaaaaaacctaccacaatgtcctgtaaaaagaaagctttctccagcttctgaaatgcacatgtagaattttacagaggggctcaagggacccgggagaatagtgattagagggtcattcaaactgggatacttttgaaagggaaaagatcactaggaataattaccctggcacattaggcatgaactggaactgcactaagcaaactgggacatatgggcacctaagtcttacttggtgagaatctaccaaaatatcaggattttttagactgtaaaacatgaaaccagagagacaggaaatttaaagtctacaaatttaaaagggtgacaattagttattgattaaattattttattccacaaatatttatcaagctctttccttctttgtcaggtactttataagctacagagatatgagatggacaagacacaatagaacttaacaggactaggtaataccctttaagcttgacaacagcaatattaggaaacataaaattagagttaacttcatggaagtcataaattgcaagcatcctggttctatttctatcctgtatcttaagaagtgatatagtctaatattttaattcatggaagatgaatccaaatgtgataattaaggcaggttgggaagttagaattggaggaggaataagaatgctattttagatgatagccaaaaccatgccctccctaatatgtcacggggatcttctgacagatatggaaccctgggccaaatgggccataatgaaaattagaacacatgtaagctttggagtttatcatcttttgtgtgttttagaaaagagtatttatcctagggctttgttcaccctgagctgtatcttgtaaatgaaaagtacaatgtgtgcatcttccatgccgaaaaataaacagcaaccttacccttttgtaaacagtaatgcaatatgctcaagcaagatttacagatgcatccgtttagataaacaacaagaatccttattaacaattagtcctcatgcaagacccacggcaatctgtgctacataggaaaactattttacgatcaccatgctttctccagtgcctaggacagagtctaatgcacagtatagatcagtcaaaacttgtgggtttagtaaatgagtcagacggcatttcagggatgctgaaagaggagaacagtgtagtccttcctgctttaattctttttgcagagtgcagaattggttgaaggcagttcacgtagatagttccaggtcagtgcaggaaaccaggaaggagagggcaagaattgaccttgttgctttgccaactgactcttctattctggttttgtttccttcatctggagaagcagatgtgcctgcctgatagggcggaagcctggaagtcccacaatctggaggtaacatcctggtctctcaaacttcctgggtgattcattagccagccacaagcacaagatctgtcacttccagaaacttagccccatcaatgttcttatgatatgagcttaagatccagaacaaataacaataattgggaaattttaaatgaccatattatttatatataatactttgtgaggttaaaacaagctcacttaaaactttaaatatcctttgttatagctagttccacatgaaagtactgggtcaatttgtccttgtagtcaaagattcatcacaaatgaaattcaagtatgggcagcacaggccccatttcctcccatctcagaggcaaaggcatctgtcatcctgtccaaatcccatgcagttctgcttcatcagggtcactccagatagcatcatgttaactcttccccagcttcaacttctacactctcagtcatcttgtcatgtcaaaacccttccttgagcaaacctcttctgaaagccatctcttttttgcaactaaatctctcataagaatagtttacactcaaagctagttcacatgctcatctatctactcctgaactctctgctatctggcttctaccccatcattcctttgagtcttctgtcttcagggttataggcaactttgctgcgaattcaggagagtgagtccttattgcatgttacctctggaacctctgaatccagctgttttttcctgacaacgtcttttcttcccttttccataactctattatttctcctcctacctctgggagtaatatgtcttgctctcctttgaaggcatgttattcctcacctgctccttaaacatacttccatcttaggcctcttctcctctcactgtagacacatttctttcacccttttatcaattctgtggcttaggctactactttgttttatgttcttccatgttgcaaggaacagagacacacttggttatttcaggtaggagatatccattgtaaagttacacaggaaagaacttaaaaggggaaaaacatcttagcccttgtgaaaactgaacaccaccccatgcaagactcaaaggaaactcatccctgtgcaaagtatgactctagtaacattcgacatttaccaggctgtagacttgatgctaactagctttctctctttctccccacctccctcacttacccacgtcgctctagtctactctcaaatacctttcgttgacttttcttctctttccctcatggcttctgctccttcatgacatctgatgtctcttggtttctgctatctctctatctacccataatttcttgatagatacaatttattctataacttaaaacattgcaataatttttatatttgctttccttctgctttcaatgccttctggaactaggtggaatctgaatgtatgtatgtataaacgaatgaatgaaatattgaatcagatctactaactttgtctttgtatcctcactggctgcccatgatgtcatagttgccagttaatgagtactatataactgccattatgccacttacacatttcttcaaccttcacacattcttaagaagagatggttttatggactgaatgtttgcgtcccaccaaaattcctatgttgaagcctagccctacagccagtgtgatgctatttgcaggtagggcctttggggagtgattaggtttagctgaattcatgagagtggggctcccatgatgggattagtgcccttataagaagaggaagagaccagaccttgctctttccctgccatgtgagaacacagtgagaaggtggctgtctgcaagccaggaggagatccctcatcagaactgaactctgctggcaccatgatctcagatgtccagcctccagaactgtgaaaagcaaatgatattttgttttggcagccaaggctgactaaaaccagtggtattcctctcccattttttaatgtataaaaaactatggctctcacagatgaaattgctttccttagatcacaatgcaagtggtaaggccaggaattggaaccccaatacctgaattattttatggttttctgcattcattttataaaacaataagccaaaagataaatgaacaattattttttaatgaacgtgaatatgacgtatttaatgaattttatctttttgttctgcttttctattttggtctacatgacaataacacatcactataggcatatacgttacttaatattgctaaggcattaatcaagatatattttgataatagtgattaaaataagaattgattgatcttctatgtctctagaatttttagcttgtgaaaatacaaaccaagagggagaaatgactgtctttaaatttgtaaggcctactggataggtcgaatgaatttgaagacatttgtctgcaagtaacagaagactccccctccattggaaataaacagtaatgaaatttccatctaagatgacaagaagtccagcatggcctacgatctgggtaccatacagaatgtcaggatgttgggtccttctctctgcaggctctgtcctgctctgtgtattgttggctttgctctcaggctggtaccaagatggctgcatcagtttcagacatcacattgagatgtgacactgatcagagggagaagtacagtttatctctttttgtttctctttcatagcaggagactttcccggaagcttcatatttcataggcgggaattgggccacatgctgtgacaatgactactagttgtctccccttctccttgcatttcccccaccttcctttcactacctcctgtatagctaactgtcatcatgtgactaagtcccctgcagtaagggcttcctgttggctgaagttgtccagggctcctagcagcagtgccggacctgagacagcacagcaaaatggcagaaaagtaagctagttgagagcctcatccctgatgcatctatctactcctgaacagggtgccccctgttgcctaacacctgtcttcttttctccagtatataaaatataattccccagggaattatatttgcatcttatttaagaccactgttatttttatttcttgctcttttttgtagttatgcaaccaaacttaatctgatatgcatttcccttcttaaaacattcctggcaaatggaatagtgtaaccacaagggaccaaacataatgaggatctatctttggagccgggatgggtcatctacccttggtcacgtggcggaaggttgaatagccaaataacattagacctctctttggaagaaggagggaaggggaaatcactgttgggtaggcaactaactgaggctgctaataaagttaattaagttttccaaggtcacatggctaattattggtggaaaagtaatttctttttttttttttttaacatttttagtttcaaaggtacatgtgcaggtttgttatataggtaaattgcatgttgtggggctgtggtgtagagattatttcatcaaccatgtagtaaacatagtactcaataggtagtttttcgatcctcactctcctcccaccctccaccctcaagtaggccctggtgtctgttgttcccttctttgtatccatgtgtactaaatgtttaactcccacttacaagtgagaacatgcagtatatggttttctgttcctatgttcctccacttatgataatggcctctagttccatccgtgttgctgcaaagaatgtgatcttgttcctttttatggctgcatagtattccatggaatatatgtaccacattttctttatccagtctactgttgatgtgcatttaggttgattccatgtctttggaatattatggatagtgctgtgataaacatacatgtgcatgtgtctttatgatagaacaatttatattcctttgagtatatacccaataatgggattgttgggctgaatggtagttctgttttaaatgctttgagaaattgccaatctgctttttacagtggctgaattaatttacattcagaaaagtaatttcgacttaggttgtctaaaagcaagttcagtggacttctgtctataagataagcttagtcaatgatttgtcattgatattataacagaaattcatacacagctgggagatgacacctagctgttaaacatttattgcttcatcaattccctcttactaagatacaaatgtgagcagttacctctacattgctgagaatcatatgcatacaggtcaatgttatactcatatggaaagaagcagaccgcgcagaccacctcaaagttatatatttggccatgggcaataaggtgagaaaaatctgctttgctaatgttgttggcctgagctaaatattgaaatagcatccagttactcagcatgtgaaccaggcagtggggagtcacgcaaactgggactgttttgtgtggtggaacagaggtgatccaaatgtgtgtttgtgtgctttttagagtttgaggccaatttaaaaaatagtctgcactgcaccatgcacgtgggtttctttgtcaacaccatctgggtgctgactctagaagtttcacttcccttagcatactgtggctccattaggagatggggcacagcactttgatttcaaaggtggttggcctcattagctatttgtggaacttagtaaccagcagaaatgatgctgttggaaaaatcctctaccttaactttaattcatatggttttattttttttcttctgcttttgaggggctttcaaatgaagtatcagaaggaaacagtgctttttatatgcgcatgtgtgtagtttttttcttagtcaactgaaaagatagaaaaaacattctgtgtttgtggacagtattcatataaaattcaaaggcaaattttatctatgtgaccgataaacaaattactaatgcctgttaatcccagtgaattttacaaaatgatttgactggtgccgaaggaggcaggagaaagacagcaaatctgaactctataaaatccctcaaggagtaccttcttagaagacaagggaggaaatactttttttcaaatgggaagcaaatcacaatatagaattacagtgtttattattattattattattattatactttaagttttagggtacatatgcacaatgtgcaggttagttacatatgtatacatgtgccatgctggtgtgctgcacccattaactcgtcatttagcattaggtatatctcctaatgctaaccctccccccttccgccaccccacaacagtccccagagtgtgatgttccccttcctgtgtccatgtgttttcgttgttcagttcccatctatgagtgagaacttgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatccttgttggacatttgggttggttccaagactttgctattgtgaatagtgctgcaataaacatacgtgtgcatgtgtctttataacagcatgatttatagtcctttgggtatatacccagtaatgggatggctgggtcaaatggtgtttctagttctagatccctgaggaatcgccacactgacttccacaagggttgaactagtttgcagtcccaccaacagtgtaaaagtgttcctatttctccacatcctctccagcacctgttgtttcctgactttttaatgattgccattgtaactggtgtgagatggtatctcattgtggttttgatttgcatttctctgatggccagtgatgatgagcattttgtcgtgtgtcttttggctgcataaatgtcttcttttgagaagtgtctgttcatatccttcgcccactttttgatggggttggtcgtttttttcttgtaaatttgtttgtgttcattgtagattctggatattagccctttgtgagatgagtaggttgcaaaaattttctcctattttgtaggttgcctattcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatgcagtttcagctttctacatatggctagccagttttcccagcaccatttattaaatagggactcctttccccattgcttgtttttctcaggtttgtcaaagatcagatagttgtagatatgcggcgttatttctgagggctctgttctattccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacggtattgattcttcctacccatgagcatggaatgttcttccatttctttgtatcctcttttatttcattgagcagtggtttgtagttctccttgaagaggtcctccacgtcccttgtaagttggattcctaagtattttattctctttgaagcagttgtgaatgggagttcactcatgatttggctctctctctgttattggtgtataagaatgcttgtgatttttgtacattcattttgtatcctgagactttgctgaggttgcttatcagcttaaggagattttgggctgagacaatggggttttctagatatacaatcgtgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgagatacgtcccatcaatacctaatttattgagagtttttggcatgaggggttgttgaattttgtcaaaggccttttctgcatctattgagataatcatgtggtttttgtctttggttctgtttatatgctggattacatttattgatttgcatatattgaaccagccttgcatcccaggaatgaagcccacttgatcatggtggataagctttttgatgtgctgctagattcggtttgccagtattttattgaggatttttgcatcaatgttcatcagggatattggtctaaaattctctttgttggttgtgtctctgcccggctttggtatcaggatgatgctggcctcataaaatgagttagggaggattccctctttttgtattgattggaatagtttcagaaggaatggtactggttcctccttgtacctctggtagaattcggctgtgaaatccatctggtcctggactctttttggttggtaagctattgattattgccacaatttcagagcctgttattggtctattcagagattcaacttcttcctggtttagtcttgggagggtgtatgtgttgaggaatttatcgatttcttctagattttccagtttatttgcgtagatgtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcgaaaaaccagctcctggattcattaattttttgaagggttttttgtgtctctatttccttcagttctgctctgattttagttatttcttgccttctgctagcttttgaatgtgtttgctctggcttaataatgcttgtgcaaagatgattaggaattttgaatacattggaatatggtgataggaggtttggtactgatacacatttttagcaagccttttattataggctaaataagatttagaagttgtattgataatacatatgagcaagactgtttggttacctttaatcttcctttaagtgccacttacagaattaatttgtttattaaacataatgtcctcttattatctaacaaagtttcttatcctgaaaatctgaataattgtgtgttcctgaatataaaaatgtttacatggaaaaacttgtttgtttttggtgtcactaattcagattgatccgtttgtctcatataagatgggtttggcactaccagattttacagtgagcagaaaatgtttctgtacagattcataccatcagctctcagaggacttgacattcacacaaggaagaaattatttgtaatacctagtacctgaggtgtttgctttataaggagatgccataacagataatattataacaaagagttattaatgaatggggaatttacccatttttttacatacagaattcttctaaatcaagctgaatttatttttaaggagataagtgcttaggatttaactttctttaggactttgcattaaaatgtttctagacatgggtggaggacctttatgaagataaaatggaataaaatataccaaaccaatttttctattataaaaaggcaggaagtcactaaatcataaaagaatttacagaagaattgagaccactcatagctacctgaggaaaacaattaagatatagttaaggccgggcacggtggctcacgcctgtaatcccagcactttgggtggccaaggtggacggatcacctgaagttgggagttcgagactgtcctgaccaacatggagaaaccccacctctactaaaaaatacaaaaaattagctgggtgtggtggcgtatgcctgtaatcccagctactcgggaggctgaggcaggagaatcacttgaacccaggaggcagaggtagcggtgagctgagatcacgccatcgcattccagcctaggcaacaagagtaaaactctgtcaaaaaaaaaaaaagaaagaaagaaagaaagaaagaaagaaagaaagaaagaaagaaagaaagaaagatacagttaaaacgtagaactaccatatgacgcagaaactccactcttggttatctacctaagagaaatgaacatatatgtctacatggaaacatgtacatgaatgttcagagcagtgttatttataatagctaagaattgaaaacaatccaaatgttcatcaacaaataaacaaatgtgatatatcaatacagaagaatatatttagccacaaaagggatgattcctgcgacaacacatgcaaacctcgaaaatgttatgctaagtaaagaatccagacccaaaaggctacatattgtatgactggatatatatgaaatgtccagaacaggcaaatccacagaggcagaaagtagattcatggttgctaggggttgagggagagggatgtgaggagtaactgttaatgggtatggatttctttttaaggtgatgaaaatgctccaaagttgattgtggtaatggttgcatgactctgaatatactaaaacttactggattgtacactttaaagtggtaaattttatagtatgtgaattatatctcaattttaaagaaagatataattaagactcaagttcgagaaaaagcagacctgactagtagttctagcttttctatccacacaacagatatttattaagtaaatcgctatatccctagtgtactgctgttcatgacttgtaggatacccaagataatttctgggttttaaaagacttattagcatgggggtgatgtcatctctcacaaaggcagaatctttgcagctggccagagagaccccatatccaaaaagtaatgcagctttgggggaagaaaggagaaaaaagtactacatctgtttgaatacaatggatagagttaggagtctgattaactgacccaaacacataaaatttggagaacaataaagccatgagccaaatcataagagtgtaggatgtaagtttccctaaccccatccctcatctaacttaaaaagagaaaacattttccatcaactgagtgggaaaaaagccaggaatctccatgaatcaggaccccctggatttcttccatcctcattgctttggaagtgattaagtccaatgatgagccagtgtctataaagaattatgctttgtgtatgagcctgtcattttgaaattatattataaaaggtaaataaaggaaaatgacttcccaattcaatgcagtttggggtcggtccataagcacaataccattgtaattaaaatctaaaatgaaatactcagagacaacaggatcaaaagccgtggcatttcaaattgacctgaactatcacttactggcaggtaatatggctgtgatgaaattcctcagcaagaaaaggtttcaatggattaaggagaggtacaggctcgggtagtattatgtgtgtagccaacatagcaacaaggaggtaaagaggatatttgaaaatgcactccctccattaattatgctctacaataatattctaaccttgctttaacactgtagcatcattttcctcatttctgggtccaggcaatatggatattttgtgttaaatatgaaataaattctcaattttctttagtataatttaatacataaatggatgtaattcttctagaaagttttgttagatattaaggtacatatatcaaaacataatgtatgctatatattttatattatatcaaaatatgttaaatcactatagtgttgaagcacagtctaacaatattctttaatgtcccatcagacattaaaaagtatattttaaaaagacaaattttaaaaattaacagtgatcaagagatttaagaaaaaaacccacattgacatactactgtgatatttttctcaaaaaaacagcaaaaatgtttatatcaccttgatgtcaaagtacttcaacttaggttgaggtcatatatcctagtgaaagtagtcaaggaaatagtcatcttgccaaacaagtttctttttgtttttgttttgtttgtgtgtttgttattttgctttaagttctgggatacatgtgcagaatgtgcaggtttgttacataggtacacatgtgccatggtggtttgctgcatctaccaacctgtcatctaggttttaagccccacgtgcattaggtatttgtcctaatgctctccctccccttgtcccccacccccaacaggccccggtgtgtgatgttcccctccctgtgtccatgtgttctctttgttcaactcccacttatgagtgagaacatgtggtgtgtcaaactagtttctactgttgactaatcattcctcattctttagcctgaactccctggagcaaaagtagaaagttaataaagctgctgcctagtgcctaaggtgtcatgaggactgtgaaaaagaataaaacatcattccagcatggggagggaatggattagaccatagggcacttgggcagctatctttgactcagttgtcattagaataggactagcattgagtaaaattccaaagtttggtttgagcctttattaattaattagtatgaattcatttatcatgggaactatgctacctgctacactcttcagctacccaaagccagccgtaaactgctctttccccatttccagccatccccttctcctctaacgaagccctccctcttcctcatatcactcattgacactttacacaggagaactgaattacagttgtggcaccctaacggtcatatgtttggccactcacccaaaacaggattcctttttaccacattcagaatggataatcagatggttatctgcatgaacctttaagtattaagaatccccttacccttaagtcacttatccttgggtgaatgttttctttagatatagtctccttgaaggaggcccaggcctacttcctgaaattctcattctgtcatttgaaatctgctctcttgaaagataggccagatctactacttcaccattcaaatattttaggtcagcatttctattactgcacagcctttgcaacttcagtctcaacatcagtttctttcatggatttcaaaggtttgtcaaatgaccaagctttcaccatcttcccctctctagcctcactaccctcttcagaacttgctggatgcctcaatgtctttcaaaggcgtatcctccagaccagagtttagtgctccatgtgtgctctggctggggtggaatccattgcgtggtcacttttctcttttcttgagttggattccaaagtttttttcatgcagctcaagtttccattgcctggtgtaatgcttttgtcagacttggagttcatttgagcttatcggacaattgttggctcattagaaatcctacctcttccttttcacagaattaaactcaagttgcctctctctgtctaattaattgttacaatttaaatgcaaatttctaatttcttgaatttttaaagtatcatcctaaccttttaatctaattaaattattatatataaattacaattgtattttaaaaccccaattctctcttctattatattatgcattcttcctagcttagttgtctagtaaaaatttgataatcactgcccatgcttttatgtaagtttctgatgaagatgttaaacaagatgggaccaggtacctgtggtggtagatttgcctactttgttaattagtacctgatatgcatagttcttcagtccatctgtatgtacagctgtatttgctacattttactgtctgatccacaaagtttccggaaaaatttgtccagcatgctgctgaaatcagtaatttatctaaatcttttggagtcagattccatggtaatggaagaaaagtggatatatggtttgtggggaaaatatgtggagactgatgaactctcaggggatccttctacatagagaactatgtattattgtgtttacctttcagtttattctatcatggatggtactcctgtcctaactaaaattttataatcagtagtcctcatttcacaataaatgatgacaatgatggtggtgatgatagtggtggtggtgatcatggttataatgattatgatgatgctgatgaacatatatatatatatatatatatatatatagagagagagagagagagagagagagagagagaaagagagagagagagagagagagagagagctctttccatgtgccaggtactacataagtgctttatactttttatctcatgtaatcattgcaacaaacttgtaggctaggtgttgctcactgaccctaactagtttagacattcacaactggtaggttctctttggcagataatggaaacactggagaagtgacaagtggtaaaagttaactgctgtactaccatgtcactaccaggttgtatgaaagagcaaattcttctacataaccatttaatagccagcaggcaccaaaaatccagcctgttttggtagcttggagataatcaatttatctgtctttttgggctttctaagcatttctttgcatgaaaagtttgcctgatgtagtcacaaacgattgttagctcattaaaaatcctaggcagtgacttttctagaatatggcttcacccactctatgagtacaccctttccaatgatgaggtcaaggaaaatgatcagaaagtacagagaggaggcagaacaattagggaagagagaactaaaatagaagtgacgggtcagacaaaaattcatttgggctacttgccacatctctaatttcaaactccttatcctaaatcgggtttgtttaactctcaagaaataggtgtggcccttgggacaagttggctcagattgacatactaccatgcatacacacacacacacacacacacacacacacacacacacacacacacacactataagcaatactgttgcctgagacaggttgtttctgattaaataaggacaccctagcaaatagctcaatactaaagacttctaagcactggccaagttcagtaaatgtcctgaaaggaagaagtttagttctcagggtgacttgaaattagaactttttttgctgtttttgttttaaaatgctttgcctgggagagagcactatgtggaattaatatccccttctgtctccacagcaccacactagtcagcctaacttagagagggaaattctttgttgccttttttccaaatacctgttaaagaacttttgctggggcttacctctgtgtgttgatcaaactgaaaattttccaaggatctgaggcttctctggagggtaggttggcattaagatttcttcaatagtgcaaaggatgttgtttttcacaaccaacacagatgtgcatgcttacaatttaccttcagtctggaaacatgttagtgaggcatgaatttctaattggctacccacagatggatacggtactaagtatgcttgaactgaatcatataatttgaaggcatttctaaaggtcagttgacatatattgtataaaaaagaaagattatatatatgtgcatatgcatatatatgtagtatatatacctatacatagtatgtatacatcaatccaggtgaacagagtgtatatgcataatatatagtctacatatgtgtgtatccatatattatattccaactaaaatatcattctcaggcatttaagaaacctgctcttacctcatttcagattccccatgggtactggaatattttatccttggggatgattaagtaagagagatacaacaccaaagctgacttatcattagtgactcagtactggagaattgagaattattcagatgtgccgaaatctctcttctgaccccctacatggaggacaagtcactacactgaagttggcccttgtctgtccccttgtcctttggttaagaactttgatcaactgacttaaggcctcagatatgggagatcctctactttttcatgccctaatttggtcctcagtggtttctgtgctgtctttaagtagataagggaggccctacttcttactggtaaataaactgaagatataccaaaggtacctgcttcagcatgaccattgccttatttggaccagttaacagtgtgtacttaaggctcccaggcagtgaatatctttcatctcctagcagattacaatctgctactataataactccccatctctgttgcattgttagctgtctttgtgtgtgtgttgtgtgggtaaactatttgatcttgtatttcatcaacttttaccaaactacctctttgctattgatgagaacagtaacctttctacacgtaagttccacttattcaagaggactattaagtgatcatgtctctcagttgattagaacatggtgttactgaggtataatttatttttgtagtcgttttattaatgacaacagtaaaatatacacattacttgccatggaacagatcacatgctgagtgttggacttgccttatgtttctctgtgtaagagttgactccaatgatcactcaagtatttccagaagggaaaggtgagaagtgattggtcaatgcctaaggctctcacaacttgtggtctacaaccctgtttgacagtgagctgtttgggcctcggtaggaattttcccacagaaaggatgttctcactggcaggctcccaggaccgcccagaaatccatttaaccataacagagctgacagcactgtcaggactggagttggcttccaagtgggaagtcagcctagtattaatagcacagttccagctgcactgtgggtccagcagacttctgacggtccggcctgggaaccaaggcactctttgtaacatttatgggaaatggagtcctcgttgagaatggtgggaagacagtactgaggcggtacaaggcccatggcttctcacttcccctttctactctaatcacttccaacgccactatccagcaggacgagatggaggggaatcctagaggaatccttctctagccttcaagtctggggagagcctgccctgttcctggcctggctcacttgggtcgactgttctcatgtacaggatatttgtaagttgggtgtttctaggtcacgtgtatttagttatatgatatgaatgtttattttaatatagtagctcttgatccaggcacaaatatattagaatgtaaagttcatttttatttttaaaagatttttcttcattttgactaatttcagttctgattatgatctcctgcttctttaccagtttaaaggcatcatttttatgtaaataaaatgggtgtgcatgattgtagtaaaacattccgttttgtggttacaggaggaaatgagagaagtgggtggtgcactgtgtatgcatgcgtgtgtgtgtgtgtgtgtgtgtgtgtgtgtgtgtgtgtgtaatttgaatatgacctaaaggatgggggtgtttgttaccccaagacatacttcaaggaattaaaaattgtgttgtactaaagggaagtctttttcactaataacttagaagtattgcagaccatttaggtttttttgttggtcagaagtattatagttaacagatttttttcccccgggagctctttgaatacataatttctttaaaaagatttttaaagactgaccagcaacctgaaaattattttctgctaatcccaagtaaatgtctctgtaatgtaagtgctgctttaaagttatcttatggggtacatatgacccaaagggaaaataacttgtttattaagttgattttctttcttttttcatgattcacaaattgtcaaattcattctgtttgggacagtagaaatgtggaaacatgtaagtgagtaacaattttaaagtgtaaatcaactaaaatgtatatgaaaccctgctgggttcttaggcagtctcttgatatttctaagctacacttctctcttctaggattctgttttgggacatagtcataaacacaaaaggaagatttcagcaccaaattatattcatctttaaaatattggggcccttcagccccttccaaacactggaaaactctctggagtttggtttgccaagacatgggaaactttttttccgaatatttttaagggaaaattatattttagggttatgaatgtagaattataacacagataatttaataagcctctatagctaagtctaggttctctttaaaagatcttgttttttcacccagccccatagttacatatttgagggagtgaaactgagcatacaggatttttggagtggcaggtccatttgaaatcattctcgtccaatgttttcattttctagaaaagggaactggagcccagaggggttaagtgacttgagcaggctactgttggtgatggcaatagtaggagtggccatcatttactgaagatcttctttttctgggtttccttacgttttattttaccctcacaaccaccttgtaaggcagggggccatattccagttttataagtgagaaatctgaagtttgggaagtcctctagctgctcaaagtcaacaggtactaagaggcagagcaagaatccactgattctggatgcctggtggcttctgcctcagggtgttttccattgtaccagacatttcccaggcctaagtagaaatacaagaagcattccttctttatacatgtttacttctaatatatcaagagcatctgtatctaagcaatcaccctggttactcaatcttttggatagtagtctggggtattgggtctccttaccttagtttttctgacaaaaaataatcttcctcctactggatttcataatattccaaaatttgtcttcagtggatgcctcaacatatactttgaaatgtctattttatttagatctgaagaagagtattctttttttttgctctcattcagtgattcattcatttatttattcagtaagtatgttttgaatgcctactatgtgcagatgctattctaggctttggagatacagttctggacagaacagacacaaacccctgccctgatggtactttatttctagagggccaaaggatggccaatacatacacggtaaaaaataaggtaagtgagatggtgataaatacactagaaacaaaaaacaaagaaatttgtttaatgagtggaaggagacaccaggaagatggggtaggacttactcaaaaataactgagaggggaaattggggagtgcttcttatcacattgtcaattcagcaaaaaatgccagtgtctattttgttcagcaaattcctttccaaaaatataagttttcaatcccccaccaatagtaaaatgcttatcctaactctgtctctatccttatgatatcttcccatccaccctttatggaacccattgttatcactattataccaaaaaaaaaaaaaaacaggaataacaggagttatccacatatctaagggtaatacaatttgagagtaagagaagcttagtgcctggcctatttttcccaaacatctaatttatggaggagaatcttgaatctcagaaatattgaaatgttgggaggctggggcaggagagttgcttgagcccaggagtttgagaccagcctgggcaacatagtgagaccctgtctcttaaaaaaaactttttttaattagtaggtgtggtgcccacctggagtcctagcagtttgggaggctgaggcgggagaatcgcttaagcctaggaggtcgaggcttcagtgagccaagatcacattgctgcattccagcctgggtaacagagggagtccccgtctcaaaacaaaacaaaacagaaaaataaatgttcaaatgactaaatgacgacctcagatcaaatggcaaggtgcttattattttatttccagtaaatgatgtgctgagttcccatggtgagctaagtgattgagctggatccaggggcctcagcactgacttcagaggagatggtctgtggcctggaggcacagagaaagaactgatacagacaaagacttctgatcccaacccagtgctccttcccctatcccatgatggggactctttgctgttttccagggtctcacaacggtgagaatggggttcccttttacatttgtacttcccactctgtacttcacgtatgtcataggttaaatgagactacttgagctgacctacgaaccaaaaccactgtatctttatttctatgggaaaatgcatgtggactttgaaatatccagctatcttaacagactttcagaattgaggagtgtctgagttggaaaatataagcaaagatcatttagtgttcagtgaggcaaactctagctgcccagcctctaagatactgactatctcctagagaaaacacaatcctctgcagtcctgaaggaagcatcagatgagatacaaataagtagtaacagtttcttccaaattgtatggggaaagttttcttctcttcactatgaagaaaacctgatgatcataaatagtgaccattttttccacaaagtggcaatttgtgagtgtgtataccagccattctgtagtttgtcatagttctctagggctatggggacctatcacaggattgtagctcatttaatctggattcactactttgtgggctggacttatgtttctattaatggtagtagccagtatagtgtcccaaatgcatgttgaatggcgtggagtggaaggacatgttctcttagctattctgtatgctagcaagtgtcattttcctgtctgccttccataatgggaatgccatggacatttcagttcgtgttctacattcctatcatcacctgattgattggaatgatattgctatataataaggatttcgaacatacataagcattctgaggaaacatgaggttagattgaactgcagtggatgctctaccacagttcaagggcaagattattacagttgccttgacaaccatagctctgcactctctgttttattacatactcttttcctatttgggaatccttttgagaagaaacaaaagaaagaatgtcagtaaggtctcattttcaatttatgaggcttctggaaataatagagtcttatatagctacaaaaacgtctccatttcttaaaatttccccaaacattggaaagtccaggcatatgaaatgaactaaaaataagcttttacttatgtcaaaacacaaatatcatctttactccctatagaagtaattattttgtaaggactgaaagaaaagattacttttctatttttctctagcgtacagctgtgacttctatttttctataaaagggaaatatttttgcctataaattttcattagtatttttacctgtattacagttattcaactgcaaataggtatataagtaaaatagtcttactctaggaaatggctaggttgagagactatcaaacagtgatattttaacaatgtgttacattattaattatcaacacatcctcttttaggtttcctttgtagagcacactagtttgtttgtttgtttgtttgtttgtttgtttgtttttcaagagaaaaggtgacaatatttgggtctttataattgttttttctgtattaaagcaaaaatgtagtataaatgtatactactgtgtgactataaaagtcattgagaaatattattttttattttgtccacttgttattaaatctttcttttcttttctttctctctttctttctttctttctttctttctttctttcttttctttcttcttgagacagggtctcactgtgtcacccaagctacagtgcagtggcatgatctcagcttactgaaacctccacctcctgggttcaagtgatcctcccacctcagcctccccagtagctggcactataggcacccaccagcatgcctggctaatttttgtagagacagagttttgccatgttacccaggctggtctcaaactcctgggctccagccatcctcccctctccgcctcccaaagtgctgggattacagtggctctatggaacaaattcatatgttaataccctaggatgggagttagggaacttttctgtaatgggacagatggtaagtatttcaggcttttgaggctatacagattttgtcacaactactcaactctgatgttgtagctgaaagaagccatagataatatgcaaacgaatggactgggctgtgttaaattaatactgtattcacagaaacagacagtggactggatttgtcccaggggctgtagtttgccaactcctactctgggagaaaaattgttttgcttacttatctgtccacagtctacaggggagtgtagtgcttcaggcaaattgcttcttttataatatatgcctaaactgagcatggtggtgcacgcctgtaatcccagctacttgagagactgaggtgggaggatcacttgtgccccaggagtttgtgtccagcctgggcagcatagagaaaccctcatctcttaaaaaaaaaaaatgtgcctaaaagtccatcttttcactctgacttttgtgtaaaatgtccccattgctaccatattggttctattagagagaaaggcaggggttacacacttttgcaactcattagggagagtagaagcagatattgataataatttccttgttttaaaagctgttagagcacatgaaaaaaaaattcaactactaagatttccttacaccctagctgaactgctcagttagaactgctcttgaatatcaaaggctaacgtgccctgcctgcgtaaggtggcaatataaactgaggtagacactgtgggatgcagccccttggcccccagctggcctccccatccccatggggtctacatagtcacctggcaccaagaaaaacgtgcttttttctttatttttctttgaagtattcactggtgctttgttcaaactgattttagcatcctctttgagtttgaatcagatacttcaaagaaaaatatagaaaaacgaaaacaagtatctatgtatttgttactcagatttagtaactgttaacatttgttcttatttgctttggatatttttatcttttttaaaataaagaatccctttcattgacacaattgtaacccaagaattttccccattctttctaaagaggctattgtcagaggaatctgaattattttccacttattaaaattggttattgagaggcaaaagaatagaaagaatattgattttatagtatatattcagagcatcactggtgcatagtatgaacgatttgatccaatttgtatggttttctgcccatcgaagactgaataatatcatgaatctactcccaagagagacatagagaatgcatcacatctctttcctattgggaatgggatatgaatctaaaagacagtaaatataaaccatcctaattcataatagagagctggatatatttttcaatttcaatggcaactttgaaaagtacattatttttctctgctgcctttaacatactaattgccttgtggtataaatgctttcataaatgctctctcatctgatcttgtgtgatagttacaatagatggtattacagctctctcccaggtaagggtatggatgcactgggatgtctgtacagtgtttggcagtcttggctggacctttgtatcacctaccgagctttgaaaagatactgattctgagcctatccacagaggttcaatccaaccagtctgagcaacagtattcttttcttttcttttctttcttttcttttttttttttttttttttttttttgtgatggagtttcactcttgttgcccagactggagtgcagtggtacagtctcggctcactgcaacctccgcctcctgggttcaagtgattctcctgcctcagcctcctgagtagctgggattacaggcacctgccaccaccatgcccagctaatttttgtatttttttagtagagatggggtttcaccatgttagccaggctggtcttgaactcctgacctgaggtgatctacccacctcggcctcccaaagtgttgtgattacaggcgtgagccactgcgcctggccgggcatcagtattaattgattctactgtactgctgaggttgagaacccccaatggaccgaccagtggttctcaagtagggactatttgcccccgcaaggggacatctgacaatgggacattttttattatcacaactgagaaggggcatcccctggcatctagtgggtagagaccagggatgctgccaaatatcctatagcacccctacaacatagaattatctggccccaaaggtcaataatgcttatattgagtaaccctgatttaagctggactaaagtccctctgactctaagccatattgtttccccagtctcaagttgctagattattcaaattagtcatcctcttattattgctgctaataaaatatattttaattaggttgttcttcaaaacaacatttacaatgactttttagtttatcaggaaccaagtgatcttgtgtcataaccatactgggataggcaaaaatccttatattaaacattttcaattacttttatcagaatacaaaacaagcaagcaaacacacaaaaaacaacacaccatcaaaaagaagaaaagagctatttctcaacataaattgctctgtatgtattatcccagatgagcaatgtgtattatataaagcagtggatttcaaacttgagagtgcattgaagtcacctagagggcttgttaaaatactgattgccggcctcatctccagagtgcctagtcagtaggtccggggtggggttcaaacagttgcattttgaataagtttccagctaagattgacatttctctcctagggactatactttgacaatcattaatgtaaagaatttctctatattagcatttcaaatgaatattaaccctggggaccatctattaaggcctcaagttaatattcctaaaagttaaaaatcattttatcatagtatacaaataacttaaaatatgattcatcaagaaatatagagggcttcctaattctatagttacaatcaggacagccctatagaatcaaaccttttgctcccacttctaagagcagcaagagctagcaacagcaagctttgcttaagaacaagcctagtagttttatgaatgcacagctctctacctgatcggaaatgaagggatgccagttcactgagacatttttaaacgcatctggtcaatgagaaagttgatattttctgtttcctgatgtgtatccttcaaattatacataagtgcttaagtgaaaatgacttgatccaaattcccttagctttggatacattaacatatgctcatggaagggtggatgggatatctaaaattttattgaagtgtattgcctctctataaaataacaaaaccttaactccttaagtaattaaaatatttggcagaagtggctaaataatgttagattcaagtatggaatctgaagcccatttcaggtatttcaagaacaagtcaattattcatccagtctatcagccaaagacacttgacagagagcagtgacatggtgttttgtaaaaggcatttccatagtactagtgctctcattttgttgtcatccagtagaaagaagtgtacacatttgtgaagaaatgcatgaggtaataaaactatttaaaaatccacattttctcaatttagatggacttttcttaaactagtataaagttaggtgttaccatatattttgtaggcataaaaatctaaacctcaaagtggcagaattcaagagtacccatcccttattttctacaggagttcatctgaatcccttgatagtaaagattttctttctttctagaacctgacataattcctagtacataccaagtgataatgacactttcattgaatttacttaaatagctatatgagaggtccatgtatttctatatttcatgaatttcaaattatatatttcagtcccatttaaagttaggatctttataaagaaaatcctgaagaggatccagactatagcgtccaatgtgcaaatttttaattgtgagctagagattgagaataaaggaaagttattggaaaattttccaagaactaagcctttctgttgtgctggtattgatgatatatgtgtcagtcagcaataagactaccaaaggtgaactaaataatccggtgccataaaatgtcttataaaacttaagctgctaagaaaatctaaggattaaaaaatgtacctattcgcatacttctgctgttgtgtgtttaagagcaaactgagaggttgctatggcattacttatgcgtgcatggcaacagagcgaacttagtgattcagcttgataaaagaggaaattagctcaccatttcccctttccccaaatcagagtcagatatccaaatatttcattttgaaatggtatatccatcaacacgttctaatggatgaaagtcagtgggggtgggggtgggggaaatgtcataaggtgaaattcgtatgtcatgtgcttactttagggaatgcaacttgtgtctaaacagtctattcatatctctgcatccttctttccccctgataggatggggtttctcagtggcatctgttgggtgaatatacgatgatgagtaacactttggcaaaagacagcaatttatcagcccgtataactttgttctaatggaagtggatcatcccagaatttgagaaagaaacattgttcagctgtgaaactccaattccctgtgtgtaacagccctccagggaaggagtagattttgtcagcataatatgtgaagtttagtcattatcaactgcacaaagcagaggtcaggcgtgggcgtacatgtgggaggcactattatgaaatcaacccacagccactgccctgctggggtgatccaatacaaacagagccaaatgtcatgaataaatgctgacattttatcacatgattagtttaaatattattttactactgtgctttttcttgtattatttatctttcacatctttattttgtttccggtttcctttctttaaactgataaatgaaaaatagggaagtatgttttgagtcagtactttgaccatgaacacaggaagttaactgaaccctccaccaccagaacaacaacaacaaaaaaactctaaacctgtgaatcttggaatcttagatttgttctgggttgacatgggttttggaatcataattttattaatttattttttaatttacatagagtaaaattgaccttctggagggtatggttctatcagttttgacaaatacataaagttgtgtagccaacatcacaattgtgatacagaagaattctatatataccaccccccacccccacccccaccaccaaatctcttccttctgccttttcgtagtcaacccctcttttcaccctcaggctctggcaaccattgatctgttggaactgtattaatctgaccgtttttctccactctgtccattcatgcaacaaccgtttattgataatctatgctgagctccattttaggtgctagggatgaaatggtgaacaagactgacatagaagtttctatctggaaacaagataatgaacagtagtaaatcagtaattccaaattgtggcaaatgctgtgtaaagaacagaaatatttctgtgacaacagatatctgaaggcgaaatctttttttttttttagacggagtctcactctttctcccaggctggagtgcagtggcgcgatctcggctcactgcaagctccgcttcccgggttcacgccattctcctgcctcagcctcccgagtagctgggactacaggcgcccgccactacgcccggctaattttttatatttttagtagagacggggtttcaccgtgttagccaggatggtctccatctcctgacctcatgatccacccgcctcggcctcccaaactgctgggattacaggcgcgagccactgcacccggccgaaatctattttagacactgttaagaaggttactctgagaaggcagcatgtaatctgaggactggaggaggagaagaagccagctgtgtgaggtgtgggtggggacacatggggtaatcattccaggcggagggaacagtatgtacaaaagagagttgggagtctagtgagtgaagggagcaatgccatgaggtgctgtagatagataggcagagcttcactaaggtgtatgtacttcattgcattgcagtgagaagccattgaattaggatggggctctaatggggatggtttgattgatgttttgagctctgtgtagaaaatctgtggtagaccagcaagaatggatacaggggaccagttgatttgcagccaccatccagttgactgttaatggaagattgggcttggcagcagctgtggagatggagaagggatggatttgaaatatattttagaagtataagcaacaggactaagtgtttaattagatatgggtaaggggctggtgaaggaaaagggggaatcagatgtgactctcaagagcttgcttgagcaactgggtgggtgatgctatttactaacatgagtaaaatattgagagagaaacaagtttgtattggaaaatttaaaagctggggctttggacaggctgaaatagagaaacccattagacatccgtttggagatgtgatgcccctagatggggatatgcatgtagaattcagaggagagctcagagctgaggagagagaaatttgtgtcatcatttaacttttaattattcattatatcataaatatacaatttaaatatattattatattttgatatattaacgttaatataaaatctgtattattaacaatttattcactgatatttattgagggcccaccatgagggagacttagtgaggaaatggaggtatgatggtgagtgcaagcctgtatgatctgagacaggctggcagtagtcacacagatatgtgtaaaatttaagggacctcagtaccacaaaggagagggttctatgaaagggcacgagagggagattcgactaaatctgggtggaggtgagggtcaggaaaggcttccctgcgcattaaagaatgaggaagtgggagaggatatcagattaaggaaagaacatggataaaagtcggtgtggtagaagaccagagattttggttctcagatgcactgtgattccaatttagatgtccagaagggcatcccaggaacatctcaagcacttcaggcaattcacattccttcagcaaatatttgttgagcacctggagtgtgcctgagattctttcaggtgttgggaattcagcaatttatgtgcaaaagttctttccctcatgaagcttgtttctttctggtggagctgattcaggaggttcacaaattccagacacatcttcagaaggattgactaagagatgttggcctgcaacagagccatgaggagtgccagcatttagagctctaaaggagcagaagcagcagcaaagaacctagagcaagtggctagtgaaggaaaaagagagaaaaggggtgcgtatagcaaaagctgggggaggtccagatggcaaaggtaatgaatggccagctaggtttagtggtgctgagggatcaggtagaataaaagcagaatagtcgcccctcagctttataacatggcagcattgggaatttttaccaaaccagttttatctgaatagtggaagtagaaaacagattgagttgcttgaaggagtgtctgggaagtgaaaactgacaaagtgagaagatattggcaattgagaagtgaaaaattgctgatgactttagagaagtttgccttcagttcgggacttcattattttcctgcaggaaagagtcttctgttagtggggagattaattaacttatttttgcccaacttgtctatctaaaaggaagaaagtagtaatacattaaaagattgagactgctgaggatgaaatggggtagtatatgcatgcagtggatgctcactaaaaataagagcttgcatttatagtattttaagtttgccagtctcactctacctgacataaattttcagtaattatcttattaaatgccaagtaagattcaaattattattaactgatactcaagggaggaaatagggtaagttaagcaaattgccctaataacgctgctcataagccatggccctcggagaatttgaatccatattttctgtggtttggacatggtttgtttgtccccatcaaatctcatgttgacatttgacggtcagcatggtgatatcggaggtggggcatagtgggagatgtctgggttacagggatggatccctcataaatggcttggtgctgttctcatggcagtgagggcattctcactcttgacactagattggttctcaggggaattgattagttcctgcaagagtgggttgctagaaagccaggacacccctgggtttggtccctctttgcacatgtctgcttcctctttgaccttctcagacatattttaatggaacacaaaagctctgctgaaatccaagcagatgccagtgccatctatcttgtaaagccagcagaactttgaaccaaaataaacctctgttgtttattaactacccagccttagctattcctttatagcaacacaaaatgaagtaagacaacatctgttgacttggttctatgctgtgtttgctccacttggtgttgtaattttattcccctataagaattgtatctgcttaagtggagactgagtattcatctactttgtatccccatacttaccattgcatttagcccagtgcctggcacaaagtttgcagttgtgagtggcactgatatgaaatttctcagcccttggcccagccttcttgggctgctcttgtttttgaagctccagtttatactcaggagaaatgctttggacttcagacctccaaactgattcatgttacacatatcatcagtggagaaagtgggacagagtaaagggtggagatagctcttgaacacgacagtagaaatggtatgatgttagcagaaaattaatatgtgcacatcttgttgtactgagaaatactctaacattataaggaaacaaataaaactgatcattgctaggtgacgtattatatatatagtatataatgtaaaaatacatatatagtgtatgttgtatataatgtaattgaatattatattgtatattatatgcaatgtacatctatatatctatagatatctacccttgtgtatttttttcctacaaaatgaaatactttcaccatcagagagtaccaagtaggaatattcccaggagggtctgagattgggatgcaatctcggaacccattaaagagcctggggacaggtgggctgtaggagtcctgtggagagcttaaaaggtgtctcttacctcttgaaagaaatgactgtgaggggtgaagtaaactgacccggtgtacgtctccctgggatatattacttactaacttttaggtcttacctaggacacgtatataggaaatgttcctgaatcatgcttggctgcattatttccctgtagtggcaaaagtggcctgcagaagctgtgcattctgggtccttgctagaacccagatgaatgttgcttgggaattggagaggaaaaaaggaaacagagcactcccaaattctttcccaaatctcttggatcgaaacatcttaaattgccatttttatatgtccaagatggtcaaatagtaaccatttcacgcagctcaaccaaaaagtatgatccagctactacagagatgtggacattggaaggccttcttgttggtttcaagtttggccaattggtagacatctggggctgtatattaaggcatcttgattttgtgagccagagcaaaggccttcttgttcctgtctctatttgaatagtatctttggtgagagagtgccagcgtcatctatttattatccttcatgctcagtgactatgtgaaaagaaaggaaaagacctttaaagctggggtgattgtctagacagtcctaaaatagctgctccaggtgcaaaggaagccataaaatgcagacaaagcatgagactcctttggcgaaaatacagtgtgtttgaactctcataggctccctgtaaattatgaagtagaaaatgcccaggagactagattccaataattatgatcattagttattttaaattgccaccacttacttcacacagaggcattctctgtgtgctaaattaaatttaaaatattttaaaaataattatttgaataattcagagctgaaatagtccaggttgaactatttagcaggctgaaacacctgtgcaagctttaattcaaaatatacagagaagtgacttcatttttcactccactgtggaggtcttctaatacaaaacaagaccttcagcaggagtccatgccccctggttctgcaccttcttgccttctactttgtcctgtgcctacccactgcactctcaaggtccaccatgacccggccctgctccactccagccgtgtcctctaggggatcgctgccaccttttacctaggcctccccaccatggcctctgccagagccagctccttgtgggcccatgtggaaatgagacctccagatcccatcctgggaaccaccaaagcctttaagagggaaatcaacagcaaaaagatgaatctgggagttggtgcctaccgggacaataagagacccagttagattaccataaaaaatttagacaacagcaaagacttggaaccaacccagatgtccatcaataatagactggataaagaaaatgtggcacatatacaccatgggatactatgcagccataaaaaagggtgagttcatgtcctttgcagggacatggatgaagctggaaaccatcattctcagcaaactatcacaagaacagaaaaccaaacagcgcatgttctcactcataagtgggagtttaacaatgagaacacatggacatagggaggggaatattacacaccggggcctgtcacggggttgggggctaggggagagaaaacattaggagaaatacctaatgtaggtgacgagttgatgggtacagaaaaccactatggcatgtgtatatccatgtaacaaaactgcacattttgcacatgtaccccagaacttaaaatataataaaaaaatttagacaaggaatacctgcccatttggggacaagctgaattttccaaggcatctgcagaaccagccttgggtgagaagagcaaagtgttgaaaagtggccagtctgtcactgtgtggatcatttctggaactggggtttaagggttggagccagttttgtgcaaagatttttaaagtttttgaagacagagatgtctctgtccaaaccaccctggggaaatcacacacctatcttcagggtagctggcatgcaactacaagattatcaattctataaccccaagacttgcagttttgacttcacgggtgctatggaggacatttcaaaaataccagagcaaagtgctcttctcctgcatgcctgggaccctcatgcaaagcagtgaaaggaaataataatagtggcaaagaaaaagaaactgcgttctttgatatggcctaccaaggctttgccagtggtgatggtaacaaggatgcctgggctgtgtgcaacttcattgaacagagcattaatgtttgtctctgtcaatcatgtgccaagaacatgggctttatatggtcagtgtatgagagccttcactgtgatctgcaaagacagtgaatgaaaccaaaagaggggagtcagttgaagatcctgatccatcccatgtattccaacccttctctcagtggggcctgtattgcctctaccattctgaacagcctgggtttgtgaaaataatggttgcaagaagtgaaaatcatggccaactgcattactagcatgcagactcagctgatctccaactgcagtaaggagagttcctcacacatctgacaacacatgactgactaaattggcatgctttgtttcacaaggctaaagcctgaacaggtggagaagctaaccaaggggttttccatctgtatgacaaaggatgactgcatccctgtggcagggatcacctccagcaacacgggtaatcttgcctatgccattcaccaggtcaccaagtaatgtccctggtgtgagggaacaggtacaacttttctgtcttcagctgctgctaccgtgagcttcacatggaggataagggagggtagatggtggtgagtagatctttttttttttttttaaccacagtgcgtaatactgagtgattgaatgcatttctcagaaaagaacatgtagcgacattgggcagaggcatctgtggctggtatctggaactttgtgactctaaaccaaactctcccccatctttttatctccaacttttccgaaagggtttacatgtgtgagaaactcatagcaccaaaaaacttgtcaattatgccactgcaatatttcagaagctttaactgaagcatcttacggtgtcaggggttcttcatgagaaatagcacacattagaggctttgagagaagacctagttctgtcattaacagtcagcctcaagtttgtcctcccatgatggagcaaccttatcaacagaccatatcgcagaagttgtgttttatgaaaaccaatgagtttgctgccactgcagcaaggaaaataaaaggtgctttttcctctcatttaagaaaaagaaaaggctatctcttctcctttttcatgctattcttttccttatgcacaaagatttttaactatcctagattttcatcccattctactgctggattgaccatctaccctgtattagtccattttcgtgctgctaataaaggcatactggagactgggtaatttataaaggaaagaggtttaattgactcatggttcagcatggttggggaggcctcaggaaacttacaatcatggtggaaggggaagtaaacaagtccttcttcacatggcagcagcaagaagacttgctgagcaaaaggggcaaaagccccttataaaaccatcagatctcgtgagaactcactatcacgagaacaacatgagggtaaccatcccattgactcagttacctcccaccgggtccctcccatgacatgtggggattatgggaactataattcaagctgagatttgggtgggaacacagccaaagtatatcaagccccatcctacttggatttatttaagaataaagaacataattttctaatgacgccatagccttactgttctcagtggagaaggtaactgcaatttatctgagcatcttcttcgatgattgtgtaattgtctcctgctggatgttgcctctgcccagttggacatcctcccttcattgaatatggaaagcagattagtggttgctagatttaagaagatgatgagttgagagggaggtgcaaatagctgtaaaggggtagcaagaggaatccttgtggcaatgaaactgttctgtgccctgactattgtggttgtcacacaaagatacatatgtgataaaattgcatataactaaatacacacacatacacacattcacacacaaatgataacatgtaaaacttgtgaattctaaataagatagttgaatcaatgtcagtttcctggctgtgacattatactatagtcatgaaagatgttacaactgggggaagctgggagaagagtataggagatggctctatattatttcttacaaatgaatgtgaatctaaaattatctcaaaataaaaaagtttagtctaaaatgcattcatcaacatgaacttgagtcaaaccatcttggaagagaggcactttgatgtattcacttcacaaagcatagggatgaagatctctggtagtaccagcaagccaaaacacatgactttctgctgtctgtaccctgtggccctgcactgtggataagggaatgtatgtgtcctctagaacatttttgttttgattgctttgtgtttgtttgcatcaagaaaaaagttgcaaattaatgagaatatatgtgtatatctctaagattcatcagcacccaaaataccagagcaagccagacgtcatagggaagccctgagcagaatctacaaaaaaggattgaataatttgattattcagagaaagcatatttctaggggatggatctaagagtagcttgatcatgaaaatggtgggaaaaatatagcggcaagagggtcactaggtggaagtaatatgtctagtttttttgagaaccacacttgagctaaacctttaaaatccaatcaaagaatgaaaatgaatagattagtgtgaggaggtaaacgtatcatttgaaaatagccttggacttgggtactttgctctcattgatttagcaatatgccccattttgttagttgtttatacagagcttcacagttttaaagtaagcatagccagttatgtctatgatttctctgtattcagttatatttgcccaggaaagtctaatcaacaaacagttatcagttatcttacccatgacaacattgtgagatgttgtgagatgccaagaatagaccacaagagcctctttgtgatggtctcagacctccaaaaccaataaagaagaataacacagtaaatcagtaacatatctatagcatttgaattcacatagagaatttgtttagtgggcctgactaaatgccttcactttgcagcttacaggggcttgtgtttattctgcctatcttaagcatggttttactcatttagtgggagcagttggctcatgtcttttacctatttcatttactaactctaagggagtcaagaagaaacttcccctttgcgctctaaagggtcactgaaaatatactggcatgaggcagattgattaacagaagaaaaggcatacacgtttatttaacttgtatacacagaaaccttcggaatgaatacctaacatacaggggaaaatggacagttgtccatttttatgcttaggttcaacaatatgtggacagccatgtagaaatgtgattggacagaaagggtctgatttaaatgctaatggactgagtaggggaaacccagtaaggcctgtccatctagattattcttggcctctctgagaagcatttcttccttcttgatgtgagagaggaccctgtctggaacaggagtcttaggatctacagtcaaaccagttaggtcagatcatttcttcatggccagtttttacgtagaatatttttaggttttatgactgactttcaggaaaaggggttctgatttgtatgatctatcttggggaaaagggattctagtttccatggctatccttagggcaaaatgggactgagaggaggacaggagaaggtcaggagaaacttttgcttctgaagctgctcagcagcagtcttcattttgagatactgttttctgagccccaacaaaattcttctaacatgctgaacatgtgccaggcactattctaacatccatgagaatagagaggaaaggaagagagggatcctgcagctttccagttgggtgctgagatgatgacaccattcactgggtgactccaattgatttgctaaatctattctctgcattttgactctgccaccttcttaccgtgggtctatgagcaagtttctccactgttctattaaatatctgtgaaatgggagcaatggtggtgttgtgatgattagatgagtaaacacatctagagcatagagctctatgcctggcacaaacgaagccctcagttaatatttgcgggatgtgtaaaagattgtgtttatctggttttcaagaccatcctcctcagagacgccaaggagatagttgctatgcttcctggcgttctaagacccacatgcatctcgttaacccttgagaaatctagtgggctctcagaatttttaaaattatatattaataaattataattgtatttatttggtgaaaagtgatgttatgaattttgaatacaatgtggaatgattaaatcgagctgattaacatatacatcccaaatatttaatctttttgtgattagaacatttgaaatttactctctgtaattatgaaatgtatggtactcagttattagctatattcaacatgctgtgcagcagatctcaaaaaaaactcaaatgtcttcctcgtttctgaggctttgcaccctttaaccccattgctgacatcccccagcctcaccagcttggtggaacaccttgagatgtgcttataacagtagctgggatgtagtcagtgctaaaaaattgttagcttttgctgttgtgcatgtagttgttgttgttattgtaaaatggtggctggaatccacttgcgaatatgcagtcatgttacaaatgaggatgtttctgtcaataatggaccacatagacaacagtggtctcataagattataataccatattgttactctacctttctatgtttagatatgtttagatacacaaatactattgtgttacacttacctacagtattcagtatagtaacatgctgtacaggtctgtattacaggagcaataggctgtaccatctagcctaggtgtgtagtaggtttgtgtaagtacatgctatgatgttcacttcgtggtccactaggtcactagtaagcctttctgtacctttttgtatgtaactctttgtatgtctgccacactgtatgataatgcttaggtgtttgtataaatacactctatgatgttcacaatgacagttttctcaggatatatcctcatcattgacacgtgattgtactttaacagagatacaattcttgaacatcttgttagaaggagatgggagaaataacagaaataaaggtagtgtcttgcatttttcaattattaaactaatcaattcattaaaacagctgtcattaattacttaaagtcaggcaggtgagggaaagaatggcttgacgttttctaatttatcactctttcctgttgcccctgactaaacaaactgtggctgctgctacagctaagtatgtcaaactgttgaatacccaagccaggcttttgaaatattgaaaaatgactactcccatgttgatccataaaatctttaccatcttacagagagctgatgaatcatctctctagcaccaggttcacgaacttcccataatgatctcataactctggtgccaacattgcctgggctcggtaaccttcatgaaatttattattaaagtttgaaattcgttcttgtgtaggtgtaatgggattagtcgaattgcaaagatgatagggctgctatttacagaaaaagctcctttctaacacttgccttttctaatgagtcaccataatacctctgtaattattacattgattgtcttttgcagaattagatttttttgtaactctgggagattttgattagaacattcagttattatgtctgaagagtgatctagctacatgagttaatagtctttggattgaatgtgttgaaaattaaattgaaattagaatttttgtacatcaaggcttcaggtgccctttagcaactttgggagacgaagatatctccacactcagaaataggttttactgaaaagtttttggtggtgaaaaaaataaaatacctcaaacaagctgcagaaacaaagattttcccagaaattctcaacaactatgaggatagactagaagttctgcaagggcagacacttgtacatcattaatccttgacagaattggtaggaaacctttggattttagccagtgtggcagagtaccctgagacgtgacagaaaagagtggtggtggtcaggcactgaattcagttaactgttactggtttctaagaactcatcatgcattcacatagaatctttgtcaacttcacaaaaatcctagtagagtgagatttttatccccattttaaaagtgagccatgtaggtaactcgctcccaaattactcaataaatgctgcatctgaattagaatctatcggaggctggctcccccatctggacttcagcatgacttcattaatgttccctaccctctccagccctatgctggtccactagtcactggtgtaccttcctataccataactgtatctcctgtacagaataataatgctcagatgtttggagatgtatgtgcaaagttcagaaatgactttagacaacattttaccttccttcacgatgaaatgagaaaaattaacaccaatctaataccaaaacaaaataatttaccacaaaagtgattatcttgtaatgtgaaggattcaatatgaactatcactgaatatggtttgaaagggttccatattaatgcatgtcagagaagcaggccagatgctgactaaatcagcaatgtctttgttgatgctttttggcctgtaaagtacctgtaaagtacctgtaaagtacctttaaaaccctgtaaagtatcttgtaatggtgtagaataatcaaagacttgggataacttctgtggtcacaaagcctgttgtaaatgaataaccaggacttttgttttgataaatctaatctacattcctctgtagcacacgattatactcaaaagcaggttatgattgcccccaaattcctaggtaccattgtgaagtcaggctcagacctgactttttgatatctttttacctgagcccctacatccctggcaccaatagaggacatggtaatagtcactaaatgaacccataatatctgtgtttaggaggagtgacattttttggcttattgctggtattcaaatgcctctttactcacctatctttgacaacatccctctggattatggtactcacttagtatgcccttcccataggtgttcaacattccaaaattatttgatactttgcaaaacatccagcaacatcaaatattttccaatctttaaagggctgaatttagtttggccttagaacaaaacaatctgattgaagtaatgcatactaaaaagtgaatgacgaatatgttttgttttgtattatttgaaattttagacaaacttttcccttacaagtctttaaaacgaaatgtgtgagcaagattttcttttctttcttagcaggaatgaatgtcagatgtccttttcttacctcaacttctctttactaccccattcagaaacttgacacctttctcctgaagtgttgatgacatgtaatctaaagaatatcttggacatttaggaaaattaaacacataggaaacttttttttccttcctagcatgaagttttctatttttccttcctttgggtgggacaaaacattagtaacttatacagtgctactccctaatgtaaaattataaagtcatttgtatttagggatgtaggggttttttttagatttaatgtgtacttatcatgaaatcagtggatgattgggtcaagtctatgacattatttaactaagcggtctgccatggcattatttaatgaaataatttttaaaaatgcttttattttactgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccataggaaaaaaaaaaaatcccagctgggcgcgatggctcacgcctgtaatcccagcactttgggaggccaaggcgggtggatcacctgagatcgggagttcaagaccagcctgaccaacatggagaaatcctttttctactaaaactacaaaattagctgggcgtggtggtgcatgcctgtaatcccagctacttgggaggctgaggcaggagaattggttgaacccaggaggcggaggttgcagtgagccgagatcatgccattgcactccagcctgggcaacaaaagcgaaactccatctcaaaaaaaaaaaaagaaagaaagaaagaaagaaaaagaaaaattcctttggtaaaacattatatactctctaaacagggattctcttcacaccattttgaattgcgtgcttcttgccttgttgcacagattaaactgggaaacaattttatgtgtagcagggtttctaaacctcagctctattgacatttgggggcagatcattcttttttgtgaggggctgtcctgtgcattgcagaatgttgagcaggatgcctgatttctagccgctagatgccagtagcaccttcccctcagttgagacaaccaaaaatgtttccagacatccctaaatgtcttattgggtgtgaagtcatcctcagttgagagctactaatctagcaaattagcatatttctagcaaaatagcataactacttttaaaaataagtttggtctaggatgtttttctctttcaaatgaggtatattttagataattttcacttcaataataaataataattacagaaaccaaaatacaggtttcagatgttatctgtgtaggaatgtgaataacagtgacaacattttctgaaagaaaaatttgtatgtagagactaacaaaggtgttttttctcatttgtgcatttaattatgatacaataatttgattatatttagtggtaaatgaataatcttcattagaaaattatacaaagaaatgaacaattcagaaaaaaataatagctttcatattttgtcctgtattattgaagtaagcatgttgcacccacttgatatgcttattattcttaaaaatttcccacatttcttggtaaatttgagtaattcctgtattgtcagtgaatacattataattttaatagtgattgataagcattttgatctctagatttattatcattaaacaatgcagtcacacactttaaacagaattagtagaaacattttcttatttttcttatttggaacatttatcagactaaagaattttaagtgtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagtcgagattgcgccactgcagtccgcagtccggcctgggcgacagagcaagactccgtctcaaaagaattttaagtgaaaccaaccactactttgtgctgcatatatgagagcacttcaaaaagttcatgggacaaattaaatgaaaagataagaaataataaatagaaactttctcagcatcaagctcaagacacttttttgatcaatgatacccgccattttagtccatctctaaagaactaagggtcctgggaattttaccatgtcattgcaatcttttttattttattaactgaagacaaatgggtgccctttagattttttttttttttaagattagtaagcaaaaagaagtcagaaggagccaaatcaggactggaaggtgagtgcttagtaatttcccatagagactctcacaaaattgcccttgtttgataagaggagtgatccaggagcattgttgtagtcatttttctgctaaagctttggctaactttctcaaaatactctcatagtaaacagatgttaattgagttttggccctctaaaaagtcaacaaacaaaatgccttgagcatcccaaaacgctgttgccatgacctttgctcttgaccagtctgcttttactttgactggaccacttcctcttggtagccactgctttgattgtgctttgtcttcaggatggtactgggaaagccatgttttatttcctgttacaattctttgaagaaatgcttcaggatcttggtcccacttgtgaaaaatttccttcaaaagctctgctcttgtctgcagctgatctaagtgcaatggttttggtaactttagggcgtaaagtttgcttgactttaatttttcagtcagaattgtgtaagctgaaccaattgagatgtctatggtgttggctattgtttctgctgttaatcattggtcctcttcgattagagcatgaacaagatgaatttttttcctcacaaattgatatggatggcctgctgctgtgggcttcatcttcaatatcatcccttcttcttttttctttttttttttttttttttttgaaatgggggttttcactcttgtcaccagactggagggcaatggtgcgatctcggctcactgcaacctctgcctcccgggttcaagcaattctcctgcctcagcctcctgagtagctgggattacagctgcccaccaccaagcccagctaatttttgtatttttagtagagacagggtttcaccatgttggccaggctggcctcaaacttctgacctcaggtgatctgtgcacctcagcatcccaaagtgctgggattacaggcgtgagccaccacactcagccctcatcacttcttaaaatgagtttttcatttgcaaactgttgatatctttgggggactgtcctcataaacttttaataaagcatcagtgatttcaccattcttccacccaatcttcaccataaatttgatgtttgttcttgcttcaattttagcagaattcatgtttccctgacaggggctcttttcaaactgatgtcttatctttcttagtgcctcaaactagatcttgttaaggcaggttataacaagttagtaagaatttattttggtgtaatatacatttgaaatttttgtatagttctttcataatgcatattttctatgaactttttgaagtcccctcatactttctctttgttcattttactagcgtgtttgactaagataagttttaaggacaaaagtatgacttgtatggtttttataattaagtatttctgtaatattccacattattgccagttctgtccagggagaagtttttccagctcattcctgaataattgttacaaaccattcacattcatctaaggtatttctgataactaatatcaaaaccttcagaattcagggtatactatgcttagcaatattacttggagcttctattcaaacagcagaaacagattgttttcctttatccaaaatataatataagttacatcatgtaaagcagtgataacattttgggttaaaccccaaatcacaacttctgggtgagaatccttcaaattttaatataatcagcagaagcattctagtagagtttaaaaatgtttatacctaagaaatagtcactccagatttgtcaatctattgtgcttaaatatgaaaaatgtgtacatacaacacttaggcaaaattcacagaatgagttctgtatgaatataacattgtggacaattttatcctatttaccacatcaattgatcaaataagtttatgtgaatgtatgctatcttggaaggccaaggcaggtggatcacctgaggtcaggagttcaaaaccagcctggccaacatggtgaaaccccgtctctactaaaaatataaaaaattagccaggcatggtggtgcatgcctataatcccagctacttgggaggctgaggcaggagaattgcttgaacctgggaggcagaggttgcagtgagctgaggtcatgccattgcactccagcctggacaacaagagtgaaactctgtctcaaaaaaaaaaaatatgctatcagtgtttttcactggggaaattttgtacctccccccaggacacatttgccaatgtctggagacttttgtggtcacatttgggaggggtgatttgctactggccaaggatgctgctaaacatcccacagtttagaggacagcaacacccaccacaaaaacaagtgatctcgcccaaatagcaagaatgccaagattgagaaactctgtactgtagagatgatcaataaaatgttttctttattctccagtgattttcttgagatgttcttcagatttgggacattttgcaaatgttaacttgcatcactgtatctgtgggtatgccaacagtcttactcacatatgtcacgtcacagcagaaagaaaagataatctcttaattgtcattttatcttattttccagagcgccactttaactgcaatttcttcacaaagatttctcaccaggaaactggcagctgtaatatttatgatccgtttcttttttatttttaatttgttttaatttttaatgtttgtgggtacatagtaggtgtatattaatgatgaaagtgcgccattcctgtggcaaatgtttttgaatttttgatgcagacttgttttgaacatctgctttgtgctttatttgtactctttagaatcttttctttttgaataatatgaaaattgctataatggctgtggctaaactatgcatttttggtgtgatggacagttacaacttcttttaacacaggcttatttttaataggataacattgaatttgaaaatgtgtgcgtatatgtgtgtggctgttgaagttctgggagctcagatctgagagccagcaaatttagatgtattattttattcaatcattcattttattgagaagttacttgtgagtagcatttattgcactatttttatattcaaaatattactatttttagaaaaggtacttattttgaaaaatgttcacttttcctgctttttatactaacttttacatcaaaataccactgtgcaactaaatttgtgcccaattgaacaaatttttaaataaattagaactacaggccaaattgttacattagaaaacacttagaaattgttaccatttcttctattttgttgcttccagtaaatttccttcatggcacaatttacaaaaagtaataaatattgaacatgtatttaacattaaaaacaccgcttacatccatatacagttatggctcttaaaatgcagacttttgtattgtagcagtctatgagctgtctcttttgcaaaatatttttctttgtagtaacagctttatttcaatgttggctgactatatcttttattcagggactatttgctgaagtatttgcaactaggggcattttggatgtttaatgggaacaaggagaccttatatataattagaattattccataaggtctgagtgtgtgtatgcatgtgtgtatgcatgtgtgtatatgtaggtgtatgtgtatatatatacacatatatgtgtttgcgtttatatatgtgtgtgtgtgtatattatacacctgtgtgtgtgtgtgtgtgtgtgtgtgtgtgtgtgtgtgtgtgtgtaaagagatattttctttgaattgagcaaaacacacatctcccttttcttcattagggcacaagattttttcctattcctttaactattctgttctgataccataaaagccattcacaataggttgtaggtggctgtaatttataatcatttcagtagtaaaattcatcatccctgggattattccctctcttgtcacacgttaattcctggctccagattgtctttgctgtgacttcatctgtaaagatttgcttcccttttcaatgtccgccttttgctttctggagatataacctttgtttctcaagatctgaatgcatggaatatgaaactttccccaactccaccagcacaagtgacctctttctctcaaccctgcagttgtttatccattaaaattaccaattaaatttccttttatacatgtcttgtctcccactaattggtagccgctgaggtctgagacagcacagcccatattctttaacttgaccctgaggagatgccggtctagcttttatttaggttagggttggcatctgaggaactgtgttcctattgcatgctgcagtcatgagctaacagaacgcttaaatcaaaagctgtcaacctaacatgaagaggcatccacagagctgtctctgagaagctttattctttgactcacatctccaatgtgagtaatgtggttgaaacctagcaaagtcaaaatttacttgaagtgatatggtggatccggtgctgtagatgatgattgtagacctgaaaaaaagaagttacgcgaataacatctgcttttctgtgtgatattttcccccccagctgtttagagaattagaaattgctctgtcaagggtttgtttacaaaagcctggccaatttcaaaatgaagctgcctttgagttgtccctgtttcatctcactgtttggaaaataaatctgaaccattaagatgtaaatacatcaagttagaagccaaaggcagtgaaaaccaagtaaaagcaagaaatgtaccacgatttaagtattctcctgggaggaaaaatatacatggtaataatttttgtatcttataattttattattaaattaaggggagagaaatttgaaatcagcataatatctattttgtgtagtatttaacactgtgatgtatattgacaattgataatgaatcaaaatatgtgcgggtaactgtatgttcattaaattagagtttggtaatgagatagaaagagagaatgagaggggtacaggtgtaagcagcagttctcaaagtgtaatcccggaaccatcagcagctgcatcaccctgaaacattagaaatgcaaattctcaggccctgttgaagacctactgaatcagaaactctggggatggggcccagtaatctgtgttttaacaagccctccagaggattctgatgcatactccagtttaagaagcacttctatgtagatggatggatggttggatggctggcaagatatgtgggtacaatgacacatacatatgtaagtacaagtataggtatgggtataaatacaaatatgaatacaaatacagatataaatacagatattttgagagagagatatatagatagacatagatatagatatagatatagatatagaaatgtggagttaccatcacaggacttttttagaggagcaaattatttccttttacttattatatgattgaataaaagctgttcttttctctaggcaatgggtctatcatttataaactgagaaaatctactggtggtccatttgttgaaccattttccattaggttcacttaaagtgtttgttccatcaagtctgccacctgggtggtttccttcactgcaaaactggtttgctcttccctcccctctgtcttcttggcagctgctgtctgccctggttcttatccattggtagatctgattgctttggggactggatcaacagttgaatcctcacaggattttgaagccaacaatatcctacatattggtccatttttcagaatttcttcatttgtgttttatccttccatttttctttctaagcatatataatttatttagattggtgcagaagtaattgcggttttgccatggaaagtaatggcaaaaaccgtaattacttttgtaccaacctaataatttcagccaactattcatatgcagcactgtttacaatggggatgaataagtaacagctaaatatctgataaaaggggatgttttaaatatagtagattgcaaaataatatgatactttttgagaagaaaatttcaatatgcaaaaaatataggggataatattcattaagacataatcaatgattgttggattatggatgattttaattttactcattttgcttatttttatatttatgattacattagttgtaagctcaaattgctgttataagcaaagataatgcagatttatatgtatatatataaaacagtaaaataaattgattgtattttttatcttcttcctttccccactatgctatgaacttaaagtccagcaattatgccagctgtatctattcatcatttttcacattaaaagcaatattgctggatagtagaattaaatgacaactctgcttttggaaatgacaggaagtctgctgtaaatagataattgatgtagacgttaaagccaaatagaatttccatttatggagaagggaatatttaagggtatgtggctataagaaaatatttccttttgcttttaacacaagatgtaacatgacttgtcatgctcaggatgtgttttgaagtggataatggcactttccctaatatttggaggcaccgggcttgatcctcttttgaaggccttcctttgaagataaacatagacattggttttagcttaattctccatccctaaaattccttcctgctctaaaattctataattccataacaacagtgtataagcaataattatgaaatggaaaaatgagccattctacttgccatccttcatgtaaagctgtactatggaatcctgctctaaggtggggccggtgtcatttctccaagcagtatgatgccctggaagaaagcaatgtacagtggcctgtgattctggaccttggatcactttgatgcccttggcttataataaaagcaaaatccatttaaaccaccttaaataattaggaattttagaggctcatgtcaccaaaatccataagtatgtagggtttcatccagtgacttgacctttttcctgcagtgctcttcattttatgtccctctaagtgtcacctctaggctgatagcaacagaacctgtggcagtttggggataaatatgacgatgtctaagctagtgtttctcaactgtgggtgaccaccccaggagacatctggcaaagtcgggaaacatttttggttgtcacaagtggagaggtgctactggcatcaagtgagtaaaagccagggatgcttctaaacatcttcggtgtgcaggacagccccaccagagagaatgatccaacccaaaatgtcaatagtgctgagtaactctggcatagaagaagaaaggtttcctctgcctataactcacttacattctaggaaacatttccaaaggcttccagccacatttccctcacatgctggtgcctatagtacaaaaggctttaggcctgggttctgagatcaatcgtgggtggggaacagtattaccaagatcagctcactgagccccaaaatgcatgtggcatgtccatgctatacactgtcaaccagaacaataaatacccgtcatataatagtactattttgttattagcaagagaggggaattcaggcatcattactattcagccctaaaaaagaagaaattcctgttatttgcaacaacatggatgaatctggaggacactgtgttcaatgaaataagccaggcacagaaagcaaagacaaatgctgcactttctcacttacatgtggaatctaaaaaagttgaactcatagatgcagagactaaaatggtgctttccagaacctgggggtggggctgagggttggagagatgttggtcaaaggatgcaatattttacttagacaaaaggaataaattcaagagatctattgtacaacatggttactataattaacagcaatgtattttattttgaaaatcactaacagagtagattttaagtattctcaccacaaaaagtgacagctatgtaggtaatgcatatgttaattggcttaatgaagacatttcacaattgtatatgtatgtcaggacatcatcttgtacacaataaatatgtacaatttttatttgttaattttttaaaaatcctgtgaactgctaaagaataaacatactctccaaacctttctgtgggatttggggaagtgtttcttcacctgtatttttttctgggttatctgcattaatatctttctagaaaaggatatgactggaagtggcttattgacaatctggattttcccaagagaaattaccttcaaccaggagagatgactactttaaagaagggctttgcagaacctatgtctttactgagtcattcagcaatccaagtgagagatgatgatagcttggaccaagatggaaccattgaaattatgagaagaggtcagattctgacatattttgaaggtacagccaacaagatttactgacagattgactatggattgtgaaatggacccattggtgatagagagtggaagttttggcctgatctactggaaaaattgagttgctattgacttagatggggaacactatagagaagaatattgagaagaagttgaagaactcagggaattcaagaaaaaaatgtcctagttggagatataaactaggtaactatcagtgcatagatgtcatttaaagatacaaggttggttaaaatcaccaaagaggaattgcagatgaaaaataaaggagattcaagaacagagccatggtgaattccaacattatgttacattcagagaggtgatagacactcaaaagagtgtggcatccacaaagcttattctcacatttgttaattgacgtcaaaaacatggctggttgttttgtttttgtttttaacttaagctctttcaaattctggaatttgggtatctttccctaaaagagaaaaaacagccttcgtcttttgagcaagccaggaagcctcttcctgccgtcaattattaattttcttaacatccacttatcatctaaaacaggggttcccgacccccgggccgcagaccagtaccagtccatggcctattaagaatgggactgcacagcaggagtgagcattactgcctgtgctccgccgcccgtcagatcagtggtggcattcattagagtctcataagagcgctaactctattgtgaactgcgcaggtgagggatcttggttgcaagctccttatgagaatctaactaatgcctgattatctgaagtggaacagtttcatgctgaaaccatccccgccgcactgtctgtggaaaagttgtcttccacaaaaccggtccctggtgccaaaaatggctggggtcagctagtctaaaacatagcgaagctatgggctaaggaacttaccttgcttttgtttttccatctgggcaaatggttcatcctgcccctccagggtgagaaatgcctgtccctttctctcaatctgtatatgcaggctaacaaaagatatttttcagagatgatttatttcaccagaacgattattgataatttgcatttatggacacttggtgatcttatcaatatttttatgttttctcttttttagcttttaagttcaagggtacatgtgcaggtttgttacatggataaacttgtatcatggggttttgttgtacagattatttcctcacccgggtattaatcctagtacccattagttatttttcctgttcctctccctcctcccaccctctaccttctgagaggtccccagtgtgtgttgttcccctccatgtgtccatgtgttctcatcatttagctcccacttataagtgagaacatgcagtatttagttttctgttcctgtgttagtttgctaaggatatataccatggaatagcatgcagccataaaaaagaatgagatcatatcttttgcagggacatggatggaggtggaggccattatccttagcaaaatgttttccctttttgtgggacattatcttgaatttctcagaaatcaaccacaaatttaaagagtgaacactggatatctattgcaaatttttctaaaataacatacataaatctagctatgagaaaaacagctttcaatttttattttgcataagagtttcttggaaagtttcttaaaatgcagattccttgacatcagaagttctgttatgatcaatttgggactggactccagctggtccatttcatccatcccacaccattatctgattacagggcagaggatccacaagctgttcaggagctcatataaatttctgcaagctgaaaaggaaattattgactcccaaagtaatgatgtaaatactcacctatatatctaaaaacatagcaagtgccaatttcattgtcaactagtatttttaacaatctcatcacatgtaaaaacaattcgtaatgtacattttgttctcttaacaagtattcctgaacacgcacaataattacttaaaaaatcacagccaaacgagaatccgatgaattacttattgccaaatcatgtcaaaatcaaaattgtaaaaattcttgataatacaaggagatgaacctcaaaagtaagtgcttaaaatagctcagagctcctggaactcacttttaacaaaaagtaaccccaggtgattctgtatttgatcttttgcccacacttggagaatctaaggtctgtgtggggatgcttcatatcatcaaagcgtacttgtcttccttcaatcatttatcaaaattcttagcacctaaacctagcatcttagcatgatgctagattataaaaatacagtgataaacaatctttctaattgtgaagcctccagcccagtaagagagacagccaatagacaaatgcacaaacaagtaaaatcaattataggttgagataagtgctaagaagaaaatcaacagtgtgttgagatcaagaagccaggaaacattaatatcagattggggaagtcaaggaaggctttttgagcagatgatatttaagcagagaccagaaaaaggaggagccagccctgtgactgacgccttaggaaagcagttcaagcaaaggaaacagcatagacagaaacccctaatcaggacccagcttgccttgtccatgagtgtttgaagaacaggaggaaagagaggaggcatgaaaggtgaggctaaggaagttggtccagaccctttgacataggcaagttctatgtggatggattttattctaagtgcaatggaagcccgttgatgatctttgcttgcttgtttgttgttatttttttaaggttggatatggtgtggtactttgtgtagcagttgaacacataactcgagccagactgcccaggcaggaattctggctttgcctcttataggcagagtaaagttgagcatgttctaacctctcttcactcacttcctcattgtaaaatggaagtaataacagtacctacctcttaaggttgtttagcagatttaataaatatgtgatatgctctatgtatgtctcaaaatgaagaattgtctttaagaagattactgttatttcccccatgaacaaattgagtaaggacaagagcagatggctaggttgtctggaaggctgctaaatttgtttgggagaaatgtgatgggggctggaattggagtgatgaaagtaaagatggagaggaggggtcagattcctgatttattttggatgcagagttgacagaagttggtaatagattaaaagtagaacatgcagtgaagaggagaataaagaaaatgacttagttcctggctcaactaactgggtggataaaaataatcattatttaataataataataatcatcatcatcatccacaacaacactgattaagcgagtgctgcataccaggcaggcattgtgataaatgctttgtaaacacctctaaagatgtgggaggctaggataccaaaacatttgccagaagagaaagtcaagagttcattagtggataagggaagtttgagatgaccctgagacaccaggtagaagggtcaagaaggcagctggatagtcagctccataaacacaaagatgattggtttggagatagtatttgagagtcctgaactttgcaatgggatttaccaccatgtttttttgtataatggcttgggctgttacgataatatttttgtcttttttggtctaattctttttagttcaagacctgctttgtaaaaaccttagtgtcaatcaaattttcagtcagttctccatagtgtaaaataaagtattgcattaacatttctgactctgaaacaactctactgaactaaactacttaatctgaagtttgtgttgtgtgtgtctgaaacatttcctcatcaaaattcaaagaaactttagttcaagttatggcctgaaatcaacagaattatattaattcatatggatatagaaaatcatttatttacagtatttaaattgacatttaaacagtttttccaatcccacacagttagtggcataaggtcttgagaaagcatgaaacattttttttttatcagcctcatatttcgttgagcttgccaaacacagttcattttccatagaaatttgcaaacctgagtagtggccaaattttcagagtcgctgaatgtaagccaatgaataaaattgttaaaccctttgatttccccccacttttttcccttaaaaagtaacatagcgtgtgcctgagttttattttttgacatctattacccacaacactcgagtgtgtttcagaatcagcctgtatggacatttcagtacaaaatgaacacagccggcgctttggggaacgttcatttgcagctttgttatccttagacaggaagccttctcctccacactttgatcgacatttttcagaaggcaatggcatcaacctttaaaaatggatactttcaagggtttaaaggttgagatttttaagacaaacccagaataggcaaaagttacatattggccaaaaatgtgactccagaaaccatgtgttgtagctaactggggccactagcaaatctttcttttgagacttctgtcctgttagcagaatgcactgatcgaactaaaccttgagcatgacacaggatagaactagttattgttaagaaaataatgttcaagggcattggtccattgtacccaggaatagtttggaaagatgaaggatatggaaacaaacaagcaaaaaaagaagaattaaaattaataattaaaatgtcagtaactgtaatgtatttctcttagtggatgataaaattacataagaatgtcgaccttttctttaacccaatgaccatagtggcagtctcttcattggactgcttccttcattggcatcgccttctaatttcatttttacttatgatagtgaaaatgcacaatggcccctggaggcaataccctaatttttttgtttaagtgctcaaaaaagtatatcctttccctgcgaaaaaggcagagggtcacaattaattactgaatttcagctatgaaaaacccactgaactgtgagagtccattgtgcttaagttgcatttaatctctttggagatgccaactacctgatatacaagagcaactgtaagttccaaaaaaactctcacagataggaaccatagacatggagagaagggagccactactcagaaatgaaggagttggggaggagtggggctgaaccatgaagccagaacagaatttttgtcagtggcctagaagcaaagctgagaagaagggtctgaatgtgctggggaccagtggttgtagctccacactgagatggaagcctcctctcactgtagcttctgccaaaacacataggtaaatttgcaggagtaatggtgacctcggaagagcctggtgtaattggggaatgattgttgcaagggaataagagccagtatttcatttggtcttttgtgtctggcatttttcactcagtataatgtccccagggttcatccatgttgtagtatttatcagtacttcatccctttttgtggctgaataatattctattgtagggatatgacacattttgtttattccttcatctgttgatggattatttgggttgttttgactgtttgactattaagaataatgctgttaggaacattcatatgcaagtttttgtgcagacttacatgtttttcatgtccatatttcttgggtatatacctaaaagttgaattgctgagtataatggcaaatgtatgtttaacatttggagacacattctcaccagcactatgtaagggttccacatccttaccaacagtttttttttttttttaaagctatcctagtgggcgtgatgtgataatttttttttttttttttttgagatagagtctcactctgtcacttaggttggaatgcagtggcacaatcacagttcacttcagcctcgacctccctgggctcaggtgatcctcccacttcagcctcccaagtagctggaactatgggcacgcaccaccacaccaggctgttttttattttattttaatttttgtacagacgaggttttgccatgttgctcaggttgatctcgaactcctgagctcaagtgatccgcccaccttggcctctcaaaatgctgggattaccggcatgagcctcactgtgattttgatttgcatttccctgatggctaatgatatcaagcatcttttcatatgcttatcagccatttgtatatcttcttcagagaaatatttattcagattttttttcttatttttcaattaggttgtctttttattattgaattgtaagagttcttcagattctggatacaaatctctcatcagatatgtgagtgagcatttttttcaaatgattttttccctccagcaatcatactgcatttctaccatctactgtaaactgccatatgtctacctcatttatctcaactttttaactttttaacttttacacttttcttcctagtgggtgcttgggggctttcagccttctgtgcctggggaggactttcagaactaagagctccccagggtgtctgactcagaggatcacagtgacccaaggctctctccctccgagatcctctagttgtgcattccagacagggagactgcctggccggctcctctagcactttgagcagtgtccctccctgcctcctgtctccttctctgttcccacactgcacaggggctctgcgtggggagtatgggggctcgctactgcctggagctgctgctattgctgaggtgtaagaaccctggagaggtaagaagatacggtgtgtgtatttcaggctctgtgtttcgtgcctactgctagaagcaaggtaggacccaagccaggaagacgtgaaagattccatggggtaataatcccagagcagcatctggaaaaggtgaacataagtaggaaagaaggagggaagtaatagcgttggagggatttgctcaatgtgtcctggcgcttgagtctcttttaacatcaaagctcaggtggttcaaatgacagtcacactgcctctgcctgttgctttaagagtaaattcagagtcttcaaaccaggcttattggaatattacataccattgccaagacgtgtatatttttattgaaagttcagagcaaatcatagtaaggacccaccatttcttctgcaccattccttttggctattttctcagtatttgaaaatcaatggaatttgactttaacatgcacattggcttataatgttactgttgcatgggtcttaatgttactgttccagtccagtgtttttgtgctagaggtaaggaaactgaagttcagagtgaatcaggcattgccaggatcaccagactaatccaggatgagccaaaacatcattgctatggagtgtctctttgggtctcaatcattgggtactatataatgactgacgactggggacaagggcataggttgcccttttccttagtatgatgaaggatcaagattctataacatcgataactgattagggtactaatgtggaaccacaaaatgtggttcagctctgtcctgtggccactccatgcagcaaagacagatggctggttcagaaaactttggttttgttgtttgcatacaataaaggtagcatctggtgcaaattttattttttttaatgattccagggttttttctttaatgatttcatagaaagaaccttaaaactcatcttttcagaatattaatttagattgttaccgaagtgttcacagagcctaattaaatacttgctggtttcatatagctacaagtaaaagctgctttgaatccttcctaaacttatattggtttatttggtgaattgtgtgttaacaccaagaaagtgaaatcattggcttttctacagattggtgatctattaccttaaacaatatgatcaggccacatcaattcatttgcaaatttcttcctctctctatcatgtgcacatgccaccataggtataaagtaattaaaatatatacgaattatttagtttgttaaaagccaagttgcttttgaagaaaatttgctgctcttagattatgattatttacagtttgttaagtgatttcattttgtaggcatagactttttattgtgattctgattatttacagtaatagcaactatcaaatcaactaatgtggtggtgattgcagatttttggatatctattactgtttatcgggaacattttttcactaccagaacggggaaaaaaaagccacaaaagcagtaaatcccattgctttccaagtgtcattgtaaatcctgctgataagaactgcacattttagcaatgtttaataagtactttaaaaattgagaattgtctcaaaagaaacagattttgaagttcctctgttgtacctacttccagattaagaaaaatcatttgtggaaaacaagttgatcccaagttcctaatcacagggagaagatgggattttgtaaacctgcagagcctgaatttgttattgcatgcagctgtgcaaatttgcaaacatttccttccctagtcaggaccctatggaaggagccagtttggactgctgccttgatagctaacatttgtagaggctgcagtgcaggaagctattggggtacctgaactttgtcatctattttaatctgggcattagatgccaggtagagagagtatgcaagccaattagttctgcttcaatgtcatggtagggatatatcagtagccttattattcttgtcattctcggtgaatttcagaatgctgcttgaaatgggctttctgtatgcgttgagtgtgtgttcagtgggctgtctgggaaggaagatagcggagggccaaggcctgggtctcctaaaacacatgattatttcattgaactaatcagtgagagaaagacagggccttgtggtttctacgagcactggacttgcgtttctttgttttccatccatcctttggaaccagagaaggcatgaggaccatccatgagcaggttcacactcaaagctggttgcccttaccctggttgccatggcaatgttgtcctagcgtaggggatacttgcctatgtttgtagctgtctcctccccatctttggcagtttagcacaagaggcaactccctcatgcaactacagagcatttaatgagttagggattcttcattttgagttacagttagctctctagtatatttttgggaggacaaatgggcaggaaaaattaagtcacaggagacaagcttcatgactctaatggagttgaatttacatttgccattaaaaatagctatagattgtttaattagaatcctagaggcggatgacgaattagtttatctttcaaatggtactcataaaaaatggggcagtgtgtgtgtgttttaaaagagcctaacttcttgttaaaatttaaagttcaaaccctcatttgtaaattggtgatagagacaattctataacgttgtgagaattaaatgagctaatacatgtcatgtgcttagaatagtgcctgaaatataataagcccagtaaatgttcagtgttattattatcattacttttatatgacagcatcctgggtgtttaatgctaatgatggctcattgagcagatattaagcatactgaccagtttccaggtatttttccaaatctgcctcaaggagcttgacagctaagggggagacaaaagtagaaagaagcagttgtttgaaatagaggcatggtcaacatatcctgggaaacctctgagcctgtgcactccagccctgtggactagcgagagaggtttctagaagaggtgacattgaggtgttggtcattgatggctgctcccagatgtgtggatatgggggcaaggagacaggggaacctcacttccaggagtgccagccaacgtagagcagtgagagaagatttctagaagaggtggcattgaggtgagggtcactgatggctgctcccggatgtttgggatacagcagcaaggaggcagggagatcctcacttcagaagtgccttgagttggttatttggacagatagggtgttcgatggcctgggtctgtcagatattctcagctgcccaaggtcagtgcttaatcatcttctctccttacaatacactgctttatattctccatggctgtaggggttttattctgtaacaattttgtaacaaaaacttcttaatcaaaagaatcattcttttggagagtggtggttctgaaaatcatgagaattaaggcatcttaaattactgcccactttatggacagaaccactcatttctcattattctgccagatccaagcaaatctcagaacagaacttatcccagactaattgaataaccttgaattcagtagttacactcatggctaaatttattattttctcctctttatcactcgggtagacacaatcactttcagaggttcttcagtctgatttacaattagctccttagcacatctttggaaggtcaaacaagcaggaacaattaactcacaggagacaagcttcttgtaacctcccaagaaacaaatactcacttctaagtaagttctgaagaagcaaataactattctaacttctgtcggacggtttttaaaaattttgttttaatttactttttttattttatagatttagagggtggacatgctttcttacatggatatattgtgtagtggtgaaatctgggcttttaacaggatagttttgatttagagacattagctgacttaatcacgggacagcactttctttattttgcaaattctccttaacacccctaccactccccaagctgttttgatttgtttagatccctgttgtgactccagacattgccaaaggtcccctaggagacacaactgtacctgcttaagaaccactcatctagaggaaaacggtttggtaaaggccgggtgcagtggctcgcgcctgtgatcccagcactttgggtggctgaggcaggcagatcaggaggtcaggagattgagcaatcctggccaacatggtaaaaccctgtctctactaaaatacaaaaaaaattagccaggcatggtggtgcctggctgtagtcccagctactcaggaggctgaggcaggggaatcgcttgaatttgggaggtggtgattgcagtgaaccgagattgagccactgcactccagcctggcgacagagcgagactccatctcaaaaaaaaaaaaaaaaaaaaaaaaaaaagtaaaagaaagaaaaatgaaatccttataatgtggaattagctgaattgtgccaatgccagagtgacaagggaagggtctgagttgggagtcactgtacacaaaggctcagccctagaaagaaggtaaaaggaagacatgcagagagaggtggtctcaagttctagcctccacttagtggagcgcccccatgacacttgcctggtgttgctctcctgttaccctcagagtggtgaattgaggatgaaggcttgtcttggaggcagcaaagaacagtgtctggggatatcaggtaggagaaggcaaagatcatttagggtcacaatcagtaagggaggtgttcaggtggctacactgtcagagtgatgcactgataaatgacagacatgggccgggcatggtggctcacacctgtaatcctagcactttgggaggctgaggtgggcagatcacttgaggtcaggagttcaagaccagcctggccaacatggtgaaaccccgtttctactaaaaatacaaaaattagctgggtgtggtggctcactcttgtaatcccctctacttgggaggctgaggctggaggatcacttgaacccaggaggcggaagttgcagtgagccaagatcatgccactgcactccagcctgggtgacagagcaagactctgtctcaaaaaaaaaaagacaaacgtgatgtacttcagtgcctgtggcatcaaaaacttccatgtcatatcctaattttgtatcactcctgcttccaactgggtagtgttctctttgggagtctacagaggcaggacaaagctctctttctgattacaagaactgtagctaacatttattgagcttggggctcattaacatgaaaagactcagagcagagcatgatattagtacattttatagacgagtgtactgagccatagagaggccaaaaaaattgtccaagtttccacagcagataggcaatggtcatgattgtgaatcaaacggtttggttatggaggctgcaccccctaccatcacactggaaagccggctttgtgcttctgtggacacttaactgacacccccagagcctgcacattccatggccaaatatgaagcatggaaaattatttggagaggcaaacaaaatttggctgtttggaggaattgagattttaatatcgttcatttttaaaattaatagtaaagtgaattctgggtcctgtggtgttttttgttgaccataggacaatgatatttgcaaatgggctttattaatttagattttgtgatagaggattcaagtgtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaatttattttctttttaaaagtcttggccttaaactcagtcttggtattttcagctattgtttactaccaaaggaaaaacttcggatttagagaaaagtctgtatttttattttgtgtggagttgagaaaggggatggtaaacttgacattgcttggaaatgaaatgcacagcttgatctttttttcttgatatgatttttgtattggaagaactgtagtatgtcttggtggtgataatgaataccataaccacataatcattctctaaatgattgtaatggaaagaagttttatttaaaatttcaagttactcaaatggcacatgtctccacatgtgtctttttactacaggtaaacccagaaagcatgcgtggttatgggtgtgtgagtgtgtgtaacgtgaatgtgtgcctccctctatgttatgttgcactattagtttgaaccacaaaatagaaaagaatgtaaatatcttctgaactctggatttatctgttctaaatgaaagctagaggggaaaccattttagtatgtaaagtttggcctgaggaagagaatggcacttctacagttcttagaaaattctcatagaggatcaggattactggcatgcttggggaacaacttgctgtgggtagctgagattttcagtttcaaccagcaaatctgttttgtttcatcttttgtttaaaatatttgaattaataagaattatttttcaacttcaagaagtagtacatagagcaatgctgtctgataaaactgaatggtgatggaaatattctgtatctgtgttgtccagaatggtagccactagccccatgtggctatttagcgcttaaaatgtgtctactatgacggaggaattgaattttaagttttatttaattttaatttatttacatttaaatagccacataggacaggactaccatatttgacagtgcaagtattagagtataattaccagttaatgtatgtctctggtttgaaacattcctctgtattatcacactacgtatctgaattttgatttggaaaccgtggctgaatgctgggattgattccagctctgccaacaggaaaggagtggtgaggaaagctgttggacagctagccaaggatatttgccatatttgccagagtgttttgactgtacttctgtcatagtattaataccatttggcctttttaattgttatttgtgggcttattttacccctttggtagattctagattccttaaggatggggccttgctcttttcaccagcacatggaatagtgccttgccctagagtgtgcttaataaatattgactcaattgattagaattggtccatgccaattgattaaaagcttttctacctttaaaaaattgaatctaaattctttaaaatcaagttatttgtttgaatattgacaccctcccaataaagttatgtttattcattccagaaaatgattaaggggccttaatcataaaggtactggaataaagttaccatgggtttgtgtaatataaaccctgcaaagactgtttacaattctgtgtgggtgtaggaagaaaaaaggattcaaatataaatatgagtgagaaagaaaacttgttttgagtccattttatgcatttgttaacattttgaagactatacagtacaatttatcttaaagttatgaggtgaaagaaatgacttgtgtttaaaatcactgcaattctctatttgaagctccattgataacattttttgaggaaaacaaattacttgaataactttaaattcagtacattattatgcatatcacataatttcatttaaaaatctttttccatagaatgagatcaaaagaccagattttgattgccagtgtggtgtgaagtgtaaagccagtgttccatgtcctattttgtttcataatataaacattcttcaaaagtttatctttcttaatgtaaagaatttttcatataaacttcccttcatttggttcaggttttagttattgtacatattcataaattttcattttatcaactgttttaactgatgtataaactttgttttttaaaaaagatttgagacagtataatttaaattttctctaaaaagaaatatattccttatttgcttgccaaatggtgaatttgtatgactaaatgagcagttcctacctgattcaagaatactcattcataatatatcatctcaaatgataggaaaatttaagtttcattcaacacaaagacatgaatgatttttaatgcattttattgtctgctaatggtacttttttagttacagaatttgctaagtaaagtgattataagcaaaaatcattgtgttcttgtgtcactcctgaaagcatctgaagtattcattcccctctcatcttctgatcttttaatcctgaaaaaaattgcaaaagaacagttaaaataatttacaaatgttcctagtgagtaccatttacaataacatgtctggcttcagttttgtcaaaacaatgtacaaccatttaagttgaactctataatttctgaagtttctttgttatttcgttgtcattagatattaggtgtccatgaggactgcttccaccttcaggacacttaaagcctattattttataataaaataacaattgctacctttttggggggtacgtcttgcatgtcaggctccaagcttatcacgctattttgttttccataaaacaactctaagaaactatcaatgtttatactcaaattttacacaaaaagaaactgagttttaaagagttcaaactatctgcccaaagtcacctttccataaatagctttgtcaagatgtgagcacattataaagttcatggtattaattattcataaagaagtaaatgcattttctatgtacagagagaacatgtgccttggactagaatagccaatgataggcaccgattacttgggattcaatcaattttcaaaaaattctgccccatattttccgtaaacatgctcacaattatgaagccatttatgacatatattatgatttttttaaattcagaaactatggtatttataattggacagagacttgaaaataatctgatttcgtcattttcccccatttaaaagaaaataaaacaccgatacatttgaagtaacttttacaatactgcctcgtctttgagggcaaagccagaattggaacctttgtgtcctggcttcttatcctggtcatttccacctcacttctctcttcttctcagtagcaaatcatcaataacatgtataaattggaattacagttggatacatatacatgataggatcacataatctcgtatacatagaagtaagactttatggatgtagattaagtttgttttgttgactattcccattcatttgtaagagctacctgtaatggaagatttagtgctaaattgcagtaacttcttgctaaaagcttaatcatctatagaaccccagtacagaaaaggaatctaacagtatgtttagtttagccgcctccaagttagattgaaaactactggaaatggggaatcttcctgtaggtttttgaagagatttcccgtctaccttttgtagcctgttcagatatttgcactctcaaaattatccgctccctcttgtcttaagccttcagtgcaactctagcctattcttgctagtcaaacctttgaaatataaggagaactgatattcccttatactgttgcccttaaaattcatggggtttagtaatatatatttctattaatgggttttggtaatacatattctggtagaaattcagtaatagtaaaattgaaacctaccataaaaactgtggtcttaattaccaagccatttagaggaatttgtctttaacataaaggtatagcatattgcttggactaatagaatcatagacctgtaactactacaactctagatccttggttgtcggagaccttagaactctggggcctattttgctgcaccattttcacaggatttgcattgtagtggcttcaaaatatactcaccacttcctcccgcttggtcttgtctgttgatggccaagcttccagagtcagatcaggaagcatgggaggcaggggctgcatggggaacatcggaggcagaggtggctgtggcggcaggggctgcatggggtgcacaggtggctggggctgcatgggctggtgaggctgtggctgaacaggctggggctggtagggctgctgggcgggcggagggaggtttggctggtggtgttggattggagtcatggagtgttggccaggaacgggcatcattggttgctgggggatcacgggctgctgagctggcaccactgggatgtggtgatgaggctgcagggtgtgagtcggggggtgctgttgggacagcacggggatgatttggtggtgcagccatccacccatgggctcgtaaccataggaagggtactggtgagaaacagagaggcaggtttaccattggctcaggtgactccaaccagagaagcagcagtgttttctttgccattatggctataggaatattttattcatttttcctttgcaaaaatttgtaactgtgtacacagatatgattttttacaaactaaatttcccattaatgtctgcatgtggagtagacatgatatttcacttaatatgggaattttaatgcatgcctaatattttcagggaataaggaacaaaatgtctacataccggtggccttatgctctggtaccacttcaaaggggtaagcaccttaagagaaaaagatattagaacccatttgatttaatttactttcatccaatatagaaactcactgatgcagtaggaaatatagactcactaatgcagtcctgtcaacattgatagcctgagaatgtgagttctacaaaagaaagaagaaggtaaaaatttgttgggtgcttcctgtgtgacaggcactgtgtttacatccatcacacacattcttcatcttttcttatatgctaggaggcaagtattattactctcactttttagataaggttatggggagttaaagagattcattaacttgactgaggttacacagggagtaaatctgtttaattccatagttccttcttttcattgtaagagcaaaacaaacacaaaattatgacataataatatgacatgatgttaatttcatttttttctttgatgtcacaatgggaaaaagagaggtgcaaacactgtccctcatcctagaaacacagattgactgatcagatgtgtcaatcttttcggttcaacagaaaatcttgcctcaaaatcttactaacatttgtcttcagcttttataagtaaataaactcatagattgttacctgaacctgtgagagaagtaagaatcttattcctttctgaacagtatatatacttggttagccttaggtttgaggattcttcatatagtaatacggcatttaatcgatacaaaaaataatcagtaaccttgctcatattatacttgacaaagcacttttcatattcattaactatattactctccaaacaatattttgaaatatggttattataattatttcctttctccagatgaggaaaccagggttccagaaagaggaaatgatttgcccaaaatcacaaagttagtaagaggttgaggagaacctcaaacccgacgtccaaaactcatgcattccgctgttctgcggagtctctcctataccacttagtcactaatatttcagcagaggcaagcaagagacacacatagagtgtgactatcttagaatcaggagttttttgagctggaaagagttttaaataacatcttacctaatccttacattttactagctgggttagaaccaagctggtcagagtttactttttgccctatcatggagcctccctgagtagtggttcatgatgggtaagcttacggccatatttaggaggacagactgagtcagagtggccaggcgggaggctgctgggacgacacaggcttgaggccaaccatcagagcttaaactgggaagctggtggtaggaactgtaaaatcaggaccacttgagaaacatctgggataaagaatcaacacactattctttacagagcccagggcattgttaacgcaaacaatggtcaaaattagtaaagagaaaaattacctcatagctgaagttgatataaccagggtgcccaggatgaggtggtagcttttacagggaggaggggaggagaatagaaagagagaggaagggagagagtgaaggaagagaagagagaggaagagattaagtcagtatgcaattgttcacattaaaggagactgaagctactttaaaaaaatctatatagtgcagaatatacttgaggtctgtttttagtttgaacaaatgtgctgtatagaagaggagaccttttattttaaagaggttcagaacagctaaatgactgttcctggggttatagccttatggctggagacctggaagcagaaaccagcacacatttattctccagtgatctttggacagcatcccacccccacgcccagtgttttcaatgaatcctaccctatcctgcccaacagtttacttgctgataaaactcaccccataatggggagagaagtgtgtttctctttcacaataaagaaatatcaacaaggagagaattgtctcacgaatgttcccttgtagatcaggaggtggtcaagtacttttaagtatcaaagggatttctcataattgacatgcaaagtaaacaacacttccatacaacaaaagaagccacaaaagaaaccacaaggtgggaattattgatgaatgccagaacaagatgggtggagcaaagtggaaacattataaatcccatggaaaatgaaagagttgatttatgacgtttaggccgatctttttttattattctgccaacggttttatggcagaaaaattttcaagttaaaaataaaaggccacctgaatgatgatctgaatcaggactgtctgtcctctcaaaagtggggcccaagtgtctggtgcctgtattgtggaactctggttgtgcctggggtccagggaggagagacggtcatgcagaaaatctccctcagacattggcctcatttaggattggctctattatattctttaaaaatgctcacatttcatgggaaggtttattctctctcatctggatgtgaatggttttagtcaggtcctataccctcttgaacaataccatcttagagagtgggaaaagggctgaatttgtaaggcagggacccctgaggaaactaggaatcgctgcaatgcaggatttcaggaagtcagagcacagaatcttggttttgtgggtgagagaggaagagaggaggcaagggtgcaagcttgctggcttctggttgtatcaactgctctttattccaccaaaaagcagatgcagcctgcttggcatgcatgtgatctaagttctctgcccttatgcacctgtgtccagacagagtgggtctaatgtcctgatctttaatacatttgaatataaaatatatcactatgtattgggtgtaggcaggatcccgggcaaccacaaaaaagtcacgtactcatcagatgtacccaaaggggtggggcctctgagaacaggaatgtggctcaaaaagtggattcctaacacaaaaatcttaccccctgaggggtaagagcagcaatatgtggagggcaggaagagatttggaatcttgagaggaattgggttttagacaaaactggcatctctgtaatatttgtccaaagctggttaagcactttctctggagacctttcaagggtcccttccaaaagcttcctccatctagagatgggtggtgatatttacaagctaacagttccaacagaatctcctggggtgcttataaaaatgcagagtcctgggccccgccccagctgtaccaaatcagaatttttggtagcggcatttgagaatatacctttttaaaacaagctcctgaagtgtttcttcaacccagagacatatgaagacatctgatctcatactgttttaaaccctaatttcaccaactatgagcagatttttatgtccaagtttgtgaaattggacactgacttatgcaaggggtgttttactcacaggcatggcaaaagctgctcccaggaggcaggcaaataaaatccaggtccccatttcttgatggttctgaaatgtaagtcaacatccacttttcttatctcttctgaaacatggatgtaatgaatgctccataaaacacacataatctacattagtctattgctagtaagaaggatggagccattgtttgtgaatttacttcagtcatatgtgatttccagctctcagcctatttcattgtttctggagtcacagtagtgataaagatgcatttaatttaggttgagggctaaacaagttacagggacatgaatgatctatcttcatatgactttgcatgccattttcctatgcctatacagcccttagtcatagaagctaaattgtatttataattaatgattaaaggaataaagttggctctaaaggttgggaagatcatcaaagtgcacagtattttataattttagaacaaggaggcacagaaatgtctcgtgcacagtctacctggacattgctactgttaaaaacaaggactaatcatttgagaaaatatattaatttgccaagatagattttagttccagaaattcctatctacagaacttcaggcaagaccctccagtaacatctctgagctccagattgtggagcaaaagatgtggctgaaccaacaggagaggatggtacgaattttatgtgattcttcaatgaattttgaatactttctccctaagaggtttcattttctttcaatggaatcttcattttgtttgatgttgcactgtaattattctataaataagacccttgggacattaagcaaaacaggtcctcctaaaatgtgcacattgatttgtggcacaaattactgggaaaactgtcagaagaaagaccttaaattttgtataagaagtgaatattacatgtgataatgctgtctatgaaaagtacactaaagttttctaactcctaaatttgttttttgtttgtttgtttgtttgggttaatgagaaaaaacacttcatggatggttctattttatgtaattaaataaaaagcttttcaaagtagtagatcacagcctgtgaatgtattatttttactttaatcgataattaattaaaataaatattttactgtgaaatgtggccaagaaagacctttggaattagacaagcactttgttgcattataaagttaaaaatcatttcagtaatcagagtctaatttaattatgggccaactaaaaagtaactattgatggcatatagtattagaaatgtagaatacatttatatcttttaaaagaaatgcagagaaagaaataagcacaataaaaaggatatcaaattataaataaaatccacatacctttgaatgtattcagtgcaagtttctgtttgaaactcagggatgcttgatcctttagatttcttccaactataagctcaatttatatcattcatggcatctgtaacaaccaatccagtttctaaaggaaaaatgtgttgagtataactaaaaatccctgtatcatgattttttagaagctatgatcagacataaggctgtatgttgtgattagtgcatatggaatctttcattatgggcaataataggtttaacaggcaaagagtttcatcacgctattttgaagtcagcaaattagttgactgtacatgttgatatattcagatttatttttaaaaagcttctctgccatcgccttttcctcagttctagcaaacaacgttgttctttacaaaaatcaaggtaggtggttgagattctctagtgtaatctggatatcctccaggatttttccagccctttcagatcaggagaaattgattcaaattcccatttgggtaaaaccccaaagctctctctagtttctctctgaggaattataattttgggatcaccactgctctattatctgcttccattgaaggtattttttctctgttccccttggctactcctttatcacccctctggtgtccaccaaaacaggggacaaagccccttctcggccccatgctgaaacccatctaccgtaaaaacaatcaggaacttaaggttcttgcagtagcaaagcttttactgatgatctatactacaaggcaaggagtgcacaccagacagcacattttaaagtaaattttgttttttacaagcaaactcatgtcacaggggatgttgtcctttgcctcccatctcacagagcagcttggcctctcagtatggcggcccttctttgcccatatccttctggcccaatcccactttctcatacaggcaaacccaaattcctctctatttttcagagtctcttaactgtctggctagctactttgtttccatgttctcagcagcctcccctttccctaagcaatgaccaaagctattcactttctaaaagaacctctgatcatctacctattaaattcatgtgtgttttacccctctaccttggtataacacatgggctttttctttcattctggaatttgattagattgatctaattgagcaaagttgtaattagtggcaggagctaactgacgagtcgtccatcaatattagatcaataaaggagatactgaatatctacccagatacagttgatgttatacttggatctctttgaatacacaagtaatacttataaagtttgtatatatacatatgtttatacgtatatatacaaattacttagcctgtctgagcctcaatttcctgatatgtagaatggaaataataacagaacctagctcagggaattcatgtgaaaagtagatgagtgacatctctggggaaatggaagtctatttattactctccccaaccctgtcagctggcatacagtaaatgtttaaagaatgctaataaacaagattccaagatgatctttggggataaatcagtagggatgaatattgcaaagaaaggtaagaccttccaatcagggagagagagattgcaaagaaggaagtagaagattataacaggtaaaatgtatgcatgaaaagaaacatagaatatgattctaaaagccaaatgtccccaggatttggctttatttatgaatatatttattggtgaattttatagcagagacaagaaggattccctttgaaggaagttggaaaatggaccttaggaggattggcaggggtgtacagcaaggtggtaagggagaggaaggaaaatgtggatcacattttattcactttcaatctttttcccccattttatataattacatatattggagtgtctgaaaggattcaggatattttttttttctacaaagttgtgggtaatctctactaatgaagtcaatgatgaattactagtagccttgtagttttagaaagattgatcttatactttttctcaccttctaagaatgagaggatgatatatttggccataatgatcaacaggatgctgccttaatgtggcattaattcctctggaccactggatagtgagttaccgctaattcaccatggacagttgaacaagctttgatggccgattccatagaaataattgattttcccctactgcatatcctgaatcataggacattaaaatatggatctctgtttgaaatctcttccactaatttaggccccacttacacagcttaaaaattggtaaatgttttgaggaaaatgaaatttcaattgaaatatttttcctataagcaattattttatttatgaataaattgactgcataaaatagttcttttgctcatttttttgtagtaggtattctttttcttgacttgcagcccagtacgttttgctgttctcacaatgcttatgttagcaacttccccacttctaatttgctgcttctaatttacagtatgctagaaaatcatatgcccaagcttgttaaaagtatgcgtgaactgaaagtaaaggaacactctaagtggggctggcctgggagggcctcgcctgtgagaaaagcaaatgaatttcggttttgtgacacttatttttgactgctgggagggtgtttggtttgttttggggttcctctccactggcttactgcctgggtttcaacagcactcggggtatgagggtggcctttggataagtcaggtattatgagtttgcaaagcctttcctatcatctgtaagagttcaactcttgagccttcttttaaagcatccccagggttatccaatattctggaataatttcaacagtgagtcttcttaagtagctggagccaaagctggcttttaaatattttctctgtagatgtttacttacaagaaaacatcattctctaggatagcttttttttttttttttttgctggggtagagttggagttgtatgatcttcagatcttaggcacaaaaccaccgatgaattccgatacacatcgtaactttgaccccaccgcaacccttagaaatcaggtattgtgtcttatactttcttgggagctccttggtacctagaaaaagctcttatacaaagtaggtgctagataaatgtgttgatgaattaatgaaaatgtagaaaagttttccatgacattgtaaacatagaaaatgtggattctgaaagaaatcctacagtgatttagatggaccttttcaatagctaagatggataattcagcattgctctcaactgctcctgtggacttctgtgcaaatgacctctgataagtatctgaaaagggagatgctgtaaaagcgctagaatctattatcctaacagtctcattacatttggctctgacctcttagttcaaattataatatactccaaacaaatacactatgatagataattttttgttgttgtttttgagacagagtctcgctctgtcgcccaggctggagtgaagtggtacagtctcggctcgctgcaatctctgcctcccgggtttaagtgactctcctgcctcagcctcccaagtagctgggattacaggcacatgccaccatgcccagcttatttttatatttttagtagagacggggtttcaccatgttgtccaggatggtctccatctcctgacctcatgatctgcctgcctcggcctcccaaagtgctgggattacaggcatgagccactgcgcctggcctatgaagtaacatttaaaacaaaatgtctaccaatagcggggctggttcaaatcgattatggcacaaatagcattcaagatgaggatgtcactctgcgtttgtcaacataaaaagatgttggtgatacattgttaagtggaaaaatagattttttaaagtccccttctctaatttttttctccctccctccctgctctcccttctctccatttggggagatattcgccaaaacacagtagttatctagggactccttgaaaatctctgggtagccgaggtttaaatttatttcttttaaataatctgtgaatgcaacaaatgcaggggaaatacgagaagtttggagtatgatatttctcactcatgttcagcaagagagatgagtaagtgatagtgctacttgcataggccctgggtatatccaatgttcattcttagggggaaaaaaggttcaacataaaatccaagacaaaaaaaaacacacgattttttaaagtgagagagcccttttaaatcatgagtaggaaatattttaataatataaacattcacagcaagagttcatacagcttgtaatttgaaaagtccgtaggcatttgctaaatatcaggtggaacaattttcaacaagggaaattatatgcagttgaagagtgtgttgtttggattataattaactggtaactgtcaggagtgaaaatggtacatctgtgttaaaagaggtaggacagtaatgtaaaaacaagcatttttattcctgtttattgggtaaaatataccaaagtaagttcaactttcctgctgaggttcagtggagacatacatagattagtagttttttaaaatattgttcagccataaaatggaatgaagcactgatccatacagcaacatggatgaaccttgaaaacattacattcagtgaaggaagccagtcataaaataccatatactgtatgactgtataggaaatgccaagaataggcaaaatccatagaaacagaaagtagattcatggttgccaggggttgagggaagggggaaatggggagttactgctaatgagccccaggtttctttttgtgatgatagaaatgttctggagttagacagtggtgatggttgcacaatcttgtgaatatactaaaagccactcaattgtacactttaaagtggtgaatcttatggtatgtgaattatatcttaatttttaaaaggacacatattatatatggtatgatatcggccctcaaaaaatgtacagcctttatacattatgtaaaatatagattaaaaggctaaacacggtgtaatggtacagaacaatagtgtaagtgttgccccacgatgataaagttgatgatgacgactatgatgaagatgaaactaacctttattgccagccatggttctaagcatttaacatgtttaaatgtttattggtcacctcccgcatgccgggtatattctgggtttatgttttacatcagtgattaaaacacacaaagactcctactcacagtctcacagaaagcaactatgaacaatggatataataaataaggacagcagaagagaaagcctatggaaaaggaaaaagtagagcagctaagaaggattagacgtgctgagttgcacgtttcaatagggtggtcagttttaaacaatttcttgaagaaggtgaggtgttcgcctgagcatctctgggatcagcacaaaggcaccagcatggaagtggcccagtgtgttagctagctggcaggaacccagcactgctggtgtggtgcaaggtggagggcataagaggagctgaaggccaaaaggtgacatcttctcatgcttccatgatcttagcaattaaatgtagaattccttgcctaaaataattctattgttcattgtgtgccaggggcttcaggctttggagatgtgaaggatttggatagacatagaggctatttcctcacagggctgagtcattggaagaaagagaaacgggaatgggcagagcatgcttggtgtgcagaaaaagaccagctaggcagcagcagaggttttaggtagaaaaagggcaatggcagatgggctgttgggaacagagagaccctgaatgttggacagggaaatccacttgtgtcccctctgcagtggcaaagcactgagcatttgtatccactgtccttgcttgctagggtttctacaagaaagttcgtctggaagctcagacttgtgtcaagaatgagaaggtagaaacacaaagcaatcagatgacttggctgtcttcacatcacattgagagtcagagcagacgcaagacccctgggctctggccctggctcagacactcttcacccacttgctcacagatgaatgaggcataccttggggccccagatcaaatgataacattataagaacaactggaaatagataagtctttaaaaatacagaacataatgtttttcctgtgaaatatagggttgcattcaaaaactgttaccagagaatattctccagagaaacctacagctattcaaaactgctctacaatataagctcttgtttagtaagaaataaaagctatttaatgaaaggtctataaaaacggatttaataacttaatacataattatatgctataaagttcatgtgttgaaagggtacacttgagtgggttttagtatatttttaatgtatttacaaagtttgccaccatcaccatagtctagttctagaacattttcatcacctgaaaagaaatcccatacccagtaacagtgaattcccattctcctccccttagcacaagacaactaccaatctatttcctgtgtctatggatttgcttatttggtacatttcatagaaatagagtcatacaacatatggttggaaaatgtgtctctgagaacctctacaaaaaggtttgtcggtgttagcactcttggcatttggggccagataattatttgctgagggatgtttagcagcatccctggcctctaccttctaggtgttagcagcaacaaccctcgctcttaagttgtgactaaccaaaagtgtctccggacatcgcatatgtttgatgggggagtgagggggcaaattcgcccctagttgaaacccacagatttacagttacctaagaactgagctgggtgtaggggtgtataaagtgaggtgggtgcctggacccagggtgctgttgtggaaagacaactatttcagggtctgtgaaggtccaaagtttgtaccccaagttccaaaactctgtgattcattttagcaaataggaaagagatgactaggggcaagaggcacaactgttatttagatgaagttattgttcaaacaatagctggtggggaaaaacactcattttttcggtcactaaaaaagatagagggtgatgggtgcaccaaaatctcacaaatcaccactaaagaacttattcatgtaaccaaatatcacctgttccccaaaaacctatggaaataaaaagacattttaaaagatagaaattgttattttaaaataaaattcaatagtatatgccagtggtctttaccttccttataaaggactggaatcatggtgtcaataattcaaaaagtgtctaaatttggatttgggctgttttatgttacaacagtaagaattaatggttctcaaagagccttacttaagtcagctttaacattactctgcagactataaacaccccttgagcagcaaaaggaagcatgaaatttgatttataccgtagctaacgaaaacaagtgggcaatcacaatttgatcataccctactaatctaatttagtctcaggaatggactaaaaagaggaagcttgtggactttagaaatatgtacatttcagaaaatataagtgtgacctcttttcttttcagaattgtgtaagtgaaggaagctgtcatcctccctggtaaatccatttgtaaataaacgggctaaagaaatcatgactgtggtcctttctagttcttaggatctgtcctgctcagagtgggaatcacaaagtgattgaggtaataactggtatctttgttgttctcagtttaaaggaagtgttctctcaaactgccttagactgcgcagccttgaccctctaggacttgatgccctgtgtatggcattgttatcagatgcaagttagtaaacccagattgtgtttacaagtaggttgtcattatacagtggcttctctgtaagtacaaaatgtatatttcctttttatttatcatggactatagcaattacagaatgtagctcttgtttttatcagggatattactgaggcccttaaactcaagctgacttacatttattttaaaatacatgttccaaagatgtttttaaaattttaaatatgcatatttttaagattttcccctttaacctgttctcccatcctgacatttaggatggggaatagacagaacatctgagggagtttgggtctcacagatcggctgtaaaattgagtaagagcaaaatgtttggaaaaaaaaaaaaaaaacaatctgtgtggttgttcatctggaaagatctgttccccactcagtagcttacagaaggctcaacatgatatggatcagctcgaattcattatctgaccaaacagcaactcaggaatcttatgtcctgtccaaggtgtgctgtgggactcaataatctctttccagatctattatatctacataaaaatatgcatgagaatcagataaactagtgggcctcaaccaggaatgattgtgcccttcagggtacattttataatatttggaagcatttttggttgtcacaattggaggatacggatgttcctggcatctagtgggtagaggccagagatgctgttaaatattctacaatgcacaggaaagccccccaaataaagaattatccaaccccaaatgtcagtagcattgaagttgggaaatcttgttcaaggaaattcccagtgcctcaggttgtcttatgagatgtggagcatgtcaatatccacagttgccagttgtgccatatggaatgctgcaaggagaaaatatagatacacatgaaaatgtgtttttgggatttggggaaatacatctatggatttgatactttggtgttccaaagatgtggctatttttgcccacaagtgttgcccaaaaccctggggctatgtggtgcctttttcacagagcaagtacataaagtacagactgttaaacagatcactcacctgctataaaatgtcagttaataatgaggtcctatcatggatattagttgaatgataagtgccacttctttcctcttacatgtttattagtgtcatctaaagcaatggctctcaaaatgtggtggctggaccagcagcattggtatcacctgggaacttgttagaaatgcacattgtcagccccctcccacacctactgaatctgaaacttttggggtagggcccagcaatctgtgttattttaacaagcttccccatgattctgatgaactttaatgcttaaatcggagaactgttggggaccaccagcacctgggagcttgctagaaatcacatgactaggccaggaccttgttgaaaggcagattctcatttagtaggcctgagaaagggatcaagatttgggactacagatatgatagcttgggtaaaaactacaaaatttctcctttttgagccttctatttccctcttcaaaaattgggaagacattgtattggttccctgttgctgctataataaataatcacaaacttagtcgcttaaaacaacacaaatttattatcttacacttccagaggtcagaagtctgaaatgggtctcactgggctaaaatcatggtacctggtgactgtaggggagaatcatttttcttgacttttccattttctagaggctgcccacattccttggctcatgtttccttcctccatcttcaaagccagaaatggcctggtgagtctttctcatatcacatcactctgacactgacccttctgcctccctgttccacatttaagttgctcctgtgatgatattagtcccatatacataattcaggacaatctccttattttaacagcatatgattagcaacattaatcccatctgcaactttaactcctctttgccaggtagcataacatattcacatattcttgagatttggatgtggacatattttggggggcattattctgcttcctacacaaataattttacctttattctccagcaaaatttgtgtcatagagaaaaatcttggaaggaatccagtcaggaccaatctcctaccaattcagaaatcttcctgcaaaatcctccaaacttggccatgtgatactagcttctcagctagactgtaagctgtatcctacagaagaccctatcttatagttattctccatctcctcagtgcctagaagagaatttagctcataatagatacttagaaaacattctttgattggtacactgctttcaggcacatagagcacgatatgactatatagactgtggaatcttgactttgtgaaactgagggattgatgctgaatctctgtcaagccttattaccctcctgtgtaaaatggggataatattacattctgtataggattgttgttggaatcaaatgaaatgttgtaaatagagcacatggagatatagatataatttacatgaaacgtctgaaaccataacatggtagaatactaccttgtgataatttgctaacaaaactgcacaagataaggacaggtggtattgagtctctttacataatgcttactgaagtgtcgcctctggcttcatttataacatcaatttagaagcagtgtttctcaacatagactatatttttgaaccattcgtgtagcttttaaataatatttttgcctgggttccattctacctagtttctgatttacttggtctaagcattggctccaactcttgctatgtttttgaatcccctggggaagcttttataaatatcgatggccaggtgccacctccagaaattctgtttcgatcaaatataatgtgtagccatggttgagatccattgaacacaacttattctaccttataaattgttacatctgccagacctttactgtatatgagaagttgtagttttatcaactttgcctgaatcagtggatgtttttctaatttccattcaatgtcattggtggaattaagaacactcaacataatgacatttgcaattataaaggtggtatcacatccccagagttttagcaggatggcagaaccacagtgagcactcagaaaacgtttgctaatgatgggccaaaaaaaagtgtcttttatggtctcttgatttattcaggaatattgcattgcagttgagtctctcacagagtccacttgaggctgctaacatgttgatttaatgaatgggtgcatttcatgaaccacccatccgagtgaattactttgggtgtagctgttttgatttttccttcctctgagtatatggttttgttaatttaaacaaattcagttgttttaccattttgtagacacattctttgtgtggccaagaatcttgtttgtggtggccacaccacaactggatttgaatgtagagcaacccagcaaagaagtgctaatttgaagcaattgttaacattgccagcaacaaaccaaagtgacctccatcaatgggttcagttagcaaccctgaaggcaagacactctgtttattccattatcgtttccttcatctatcagaaaccctaatcttcatggatgatgaaataataacaatctcaaacttaagatatattttgttcatcttaattttctaaatgtccttttttcccctcagtacaaacataatacatgtaaataaattccaacactataaaaattcattaggcagtgtcaaagtcccacaaatcccatcctccagtgatggccactaataaccatttgagaatatataaccccagatctccctgttaaattataataaacatttatgtccataacttgtgttctgcaacttctttgtttaactttacatatagtggatatctttccaaatttattcagagagaactactccactttttttcatgactgcccagaattccactgaatagataccccgtagtttagttagccagttgctcactgatggacacttaggttttttatgtttctttaaacatatatgcatataactaatatataataaaattaattatatataagtattaatatatatattttggtagattataatacacatgtagagaagtgcacataagtttacaacttaatgaatttctgcaaagtgaacacacctgtgccagatggagaaccatccctgaccagcacctcacagggatcccttggactcccttccagtcacttctccccaaaggtaacccctattctgtatttttgtagcatatattggttttatctggttttatagattacattactggtatcctacagcatgttattttttatgtcagacttctttcgctcaacgtgatgtctctgggattcatctgtattgttgtaggtggttggagtttgttttttcattcccattactgcatagttttccattatgtgatataccacaatttattcagtctactttcacgaacatttggataatttacagttcggggctgttttgaataatgctgctatgaacattctagcacacatattttggtgaacatatgctcacatttccgttgtttttattggtgactgggtttttttgctatcagatattgtactgaagtgaatgtctttgcaaatgtatcttgcacattttgcaagtattgctataaagtagatattagaattgctgggtcaaatggtattcacagaactgctccgaaaaaaattttgattttttttttttttttttttgagacaaggtcttgctctgtcgcccaggctggagtgcagtggtacaatcatgtcttgactgcagcctcgaaatcctggactcaagcagtcctcccatctcagcctcccaaagtgctgggattccagatgtgagccaccatgcctggcctaaatattttgacttttaagctaggtctggacctcaagtaacctattgtggatacacccctttgctattaccattatctgtgacacagacgctgctattgtgtcttcctgactacaaggcaagactaacaaaaaccagaatcttctggctcttttcagtcacgctctagtgagctagtgcctctttcatgtatccactgagggacaaaaagataaaatgacctagtgtcccaggatgccagcttaaacttttgagtacattgatgctatgataatatacaccaaatggactctgtggctctaagtaccatccactccagattgagataacctcctttcccaagtagagaaagaagattctaacctggaggtgagagccatttgcatgtcttaccaaaaaatgtcccattcagaatgagctgacattgggagacattaggttagagcagtgtttcccaaccttggaactgttgacatttagggtgggatcattctttgctgtgggggccgttctgtgcactgtaggatgttgagaagcatccctggactccacccatcacaactggcactttcctcctcagttgtgacaaccaaaaatgtctccaggcaatggcaaatgtcccttgaggggcagaatcaccccagtagaggactactaagctagtgcttatagaagaccccagctctaaatcagattatgttcagattctggctcagccactttttatgtgacctaggacaaagtacctaagttctctgcctcatttggctcatctgttaaatatagatattaatagtaatatttacctcaattggttgttgttgagattaaatgagattattaatgtgatgcacttggcatagtctttggcaaaaaaataagtgtcgaaagttgttaggtttattagtcataatctttattattattaaaaaaaaatggaggggtggaagaaggggtcccattgtgtatcctggaaaaaggatgaggataatgcatatctgaaaaaacatcaaaggacaaggggctcataactcttggaacacaggcaatgggaaatggaaatgtggagaaaacattaagtgctatgatggaagacaatggcatttggttgtctctctctgttccttctcaagttaacatttggaaactagaatttgtggaaaatagactttggcagcagaattaggcatttttaggaacaggataaatcactgtggggaaatattttattgtattactcttgttaatatgaagttattaaactttcaatagtgtgttgaatgcttttatcttaaataataaaatatattcagtgctaaagcagctgtattgtttttgatattattaagtagaaaaatttatctgttaggagctttgttgggttgattttcacctgataccctcttctcccaccaaagatctaactttcataaattctggcaatagaaaaacaagtcatcatgttaagctaggtctgaaccttaagaaacacactgtggctgcatccctttgttattgccattatctgtgatgcagatacagcaagacagagtggcatcctggacgggactccagatggagagtatgagtccagggttatgtctttgtgttgccaagctgcaccttggcttgtcacttcttcccattgtgcctcaggttctgagcagatggaattagtttagcatgtcccaactatattctggggaattcgagtgatatggagagatggtctgaaaattaaaaaaaaataaaaaatagaaggaggtgagattatagcaagtgtatttaggaggtactccgagttatgatttcccctctgcaggacttctctattattcttattgtttattgtgactacttaagttgaagctaccatgcacaactttttcaaatatatttgattatggaacagcttggaaaatcctgcattaaataatgtatgtgtcccttgcaggcataaaaatattctgatttcttttgaattaatctgtcatcatggctgtgacaaattaccataaatttagtgccatgaaacaatacacatttattatcttaaagtgctgtaggttagaaatctgacacaggttgcactggacaaaaatcaaggtgttgacagagctgcatttcttctggaggctctaaaaccacccacactccttagctcatggcccccttcctccagcttcaaggccagcaatattacatctcttagatcattattctatagtcacatcttcctcaaactctgaattctgctgaaaggggttgtcctattttaagggcctgtgtggttacgttgggcccacctggataatctagacttctgtccccctctcaaggttattaacttaatcatatgggcaaagtcccttttgccatgtaaggtaacacattcccaggttccagaaatcagggtgtggaaaccttaggggtgagagatattattctgcactacctatcctagtggcttcttccatttctcaaccctggagggtgtggggtcgtgttctgtagagccaggaagaagttcagcatttgttcatctgcttttgaccctagcaactcatgaaatgtgcaatgactatcttgtaaggggtattaaattcttctggcttttcctcacccagtaagcaataaaatcaaagaggacaagagtaattaaagcaagcctattgatctattttgtgtagcattctttttagcttctcttctgatataggcaagaatatctccctgaaaggaactaaactctgaactgtactttaacaagtaaaattgccatgctggatatcaacaattagtctttagagttaaaatataaacataaatgattaaattagttaatctactctttgtggtatagccattacagggctaatttttttttaaaaaaaaaaagaatactagaaacctctaaatttttcaagacactcatattcatcagactgtaaaaagcaaaagaaactgaaggattgtgttccttatcacagcttggaaaaagctctgatggctgatctatatgaagtggaaacattgcatgagttttcttgtaattgttgatatctcatgtgaatggaatgaggcggaaaacaagttttgcactaaaataagtgtttgaatcttgctatttggagtcatgttgtctacgttttttttttttgtttttggctacatagttaccatatgatccagcaattccacttctagttatatacccaaaatcattgaaaacctacgttcacacaaagtgtgtatgaatattcacagcagctttattcataccagtcaaaatgtggaaagaacccaaatgcccatcaactgaagaatggacaagcaaaatttagtatatctatacagtgaatattatcctgccataagaatgaatgaagtaatgacacatgctacaacgtggatgaactccaaaaacatgctaagtgaaagaaaccagacacaaaaagcccacatattatatgattctacttttatattaaatgtcaaaaacatgcaaaaccatagagacagaaagtagattagtggttcccaggggctggggtgagaggggaatggggagtgactgggtatgggctttccttttggtgtgatgaaaatgttttggaatcagtgatgatggttgtacactatctatgagtatactaaaaagaaacacagaactatacactttaaagtggtaacttttatggcatatgatttttatgtccaagctcttctattattttactataatttatttttgaaaatgtaaatttcaatatgcttcattgctcagagaaagcatgattttctatacatcagagcaaaagtatttacacaggtctgtgaaatactgtgtaatttatcattttaaaagtcgtatattgaggagaaaacatttttgaaaaataaatctgaaaagtggcagctagaaaatcagatgtgaaccagtaagtgcagatggcttgttttcacgtcatacctgcatttggtgtcatacttcatgttggtttctcccttttcaattttcccttttacatgtttgtctcttaatactaaaagtcaggaagcaagattttcttttttttgcatttttactggaagtgattttagctactttaaaataaatgtcctaaatataaatattccctgctggtcttgtttccatgctaatagacagaaatgattttctgtatagacagaattgctactctccttcaaattttctttcaaccagcaaatatacaaaagcacaaaatgttagtgctgtttctattcttccagaacctacagtctagccagggagaaaaggcacaaatatagataatcaaatagctttccaatgtttaaataagagtcaagaaaatagctgagatggggcagggtcggggggagatgagtgtgatggttacataggagggacgtatcggtgacgttagagttttctggaaaaatagctgacatttaaacattcccacccctcctctttcctccctcaatgagacatcacaagtgattgtctagacatctcaagtgtctaggtcatttggaaccttgaaagaagcagattcgccttctttaacaaacataaggtgaatttcctttggtcatgttttggtgttccttataggtccatagtaaacttgtttgtgttttagatggtatgattttcttgttaatgtgatgattcatttgtaatgtccctgtagggggacgacagggcttctcagaggaggtgatgctcagtaagcattacagggtgagtaggaaggcatggggaagccatttgggctgagagcacccctcaccctaaccatgaagtcctctgggctcttccatgtggctgaaattaagggatgtgaagtaagtgaggcttggtgaagcccaagagctaagcagtggccagatcttgagcgatcttgtgttttcacctcagagttgagaacttcatctggaaagctaggagcctcaatgatggctttcaaaagggaagggacaagatgagttttgctttgtagggagagacagcctacaagagtgtggaagtgctggtggacattcccagagaggaagtgttaaaggaaaggacagtttttaatgaggtgggatccacagaaactggtgactttctgagtgtgagtaggagagacataggaagcaatgttaaaaatgattttgcttcagttttcctgggtcactgcagggaacccatactgatgtatttgaaccacagaatcattgcccctaattttattgtgtgtattttcaaataattggtttacttaaagcaagatgcatttgcatacgtaccctttacccactgtgtattatcacatacctattataaatatttgtctatataagatagaaatatgtcacatatataattcatcatataataaatatataatagtcaagagatacatatagatacacatagatgtagagatagttaaatctatttaatatggagacaaatctataatgtttgtagtttttaattacaagtttctcaggccggccatagtggatttgataggcatcactctagtatgaatgtcttttctttcgagaatacttggaagaaatgctgattcctaataagtagctcataccaaatactaaagtccatgctactgatttcactttttctccctgagctttttctcattatgtgcgtaaaagaaaattagacattgagtgatctctgtggacccatctgctcatacatacagagatgtcacaaacatagttttaaaaacatgtggttcctggacacaggaaggggagcaacacacactgggtcctgtccggtggtggggttgggggagggagagcatcaggataaatagctaatacatgctgggcttaatacctaggtgatgggttgataggtacagcaaaccaccatgtcacatgtttacctatgtaacaaacctgcacatcctgcacatgtaccctggaacttaaaattaattaaaaaaagaaacagaaaaaaaatgtggttcctttgctgtttgaaatagtgaaatgctccaccatgaaatgtgaacattgtcatcccctatgtcatatatctggtgatttcttttcagtgggtccagatctggggtcggcaaactttttctgtaaagaatcagatagaaaacattttaggtgttgcggatcatactgtctgtgttgcaactactcaactttgctgttgtatcggaaaagcagccacagacaataggtaaatgagtgggtgtggttgttttccaataaaatttgattacaaaaataggccttaggctgtcctttgctgaccctgctttaagtcaacagttgccacctcaaggtcaaggcatgcctcagtcaatgtgttagaagtaatttattacctataataattaagttacaaactttagaatatttgtaagaaaactaaatgagagagaattagagatgagcctagaaccacctcatacagttattttgatgaattttcttgagtaggagagcaaggtgcagaaaagtagcataggatagtggttaagaccacaaactcaggactaaggtccctgagtttgaatttcagccatgccacttgcaatatgtgtcctgggacaagttacttgactgccctgtgctttgatttcttcatctataaaatgggcatattaataaacctcacattttaagattgtttaatgattaaaaccatgagtacaccataagggactggaataataatgggtacacactatatgtacaagagatgatagtcattccccacatatctaaatcttttggatttagatccaggacatagctctcagcttattttatctgtgctgtgagtcactgatgaataatccttactgtgcaccactaattagtagttgtggtgactacaaatttttatgttgctaatgggttgtaattttgtagtttctgaggttaaaaaaaaaaatctacccatagatggatacttaacaagaaagaagcagcaaaactctgtgtagaaaatgtgaacgtgcacaaatcagtaatgcccatgagtgaaaatgacatgggaacatgttgttagggtacaacagttaaaattaccaaaaggtcaacaaagcgattatgtacttgaacattggacatcatgttctttatgttcatatcactgaattctggaattctgagtctactggttttttttttttacaaatgaaataaaatgtagctatgtttacagcatacccttccttgtccatcctattaatattaactggtggcatggaagtcaagaaaaatgactcattaaaataaaaatttttaataatttttaaaaatcagattaccatataattgatttttttgtaactgttttcaaaatggtcttcatattgccacgttaatttatcaaatacttggaacatgcttttagggatttcatgactttctccttcaaaagttggccccgctatttgctttatttaccaaaaaaaaagggtgaggtttggggaggggtgtagggaaaaagcaatcaaaacctgggtctatcagcgcatgtgacacgttcatttatcataagtgttacatgcatagctctctcctccctacaggactattttatctccactttacagagcaggtaattgaggcttaaaagcgttggatactcacatggctagttatatgctgaacttgaattcaaacacaggcagccagaaggagagtcctccctgtaaccactgtgctataacactgcatcccatttgaatgaaacagtggcaaaatgaacagataagatgaaagctgcttaactgtgctactgttcaaaatattccccatcacatctatggcagagctcatggaaagtgacatctggatcaagcctgtgcacgtgaaaaacaattttaaattatggatgtatgtgcttggagacttaatctcttaattggtagcattgttaagttttctttctgctgtcaatggaagagaaaggaaaaaaagaatctgagctttgagatgagggcacgttatgctctcggtgtgggagaaatctggcagaatcagtcaatgaaggaatatatggagagtgcagtcatcacatgagtatgtggaagggtgcaagaaatgaggagtggaggcaggagggagggaagcaaaggtacatgacaaattcttagtggaatttggagaaaagttatggatcctggaaaaagttcaaggaatttgtcttccctgatagtttcattaagctctggccattacaatggttctcaacctggactgcaccttagaattttggggaaagctttataaatatatcattgtctgagccccaaccccagacagtctaattgacttggtctatacctgtgctgtccaatacagtagccactatccacctgtggtaatttaaatttgaatcaattaacattaaatacaattaccaattcaatattcagtttctctggccatatctcaagtgctcattagccacgggtggctagtagccaccttagcaattagtactgttaacaaaaatgtccattgttatagaaaagtctattggaccatgctgttcttggggagagggacatggtcataaaaatttttgaaaactacagcaagtaattataatgtgcaatgaacttagagaactgttggtccttggagaatacatttgttctaaaatgtatcaccacttgtatctgaggtcattttgctttggaagatgattctgaaaatatcattaatgctagactttttctgcagcctagaaatgtagccgcatatatttttatttaaagcagcttgcttgctcatttactctacaagatttagatgagttaactaccagactgcaactaaaaatgaataacttgcttttccccacttagaatgaagtggtacaacaattcatgtagattttgaattacttattaaaagagtttaataggataaattatcttacagtaaaaccgagaggctcattgtccacagctcacattttaggcaacagattagaagcaacgtctatatatttgatgatatccaaaattaatttattaacttaatatgtttatgaagtcgcatgtaattttgaggaaattgttttcctttctcattagagaagaaccccactgagaagagacttttgcaaagtgccaaagtgcaattgatgaaacacaatgtcaccaaatatagcattgaaatgagaaagtggaaaggaattcactttggcattttttattttgcctagtttgtttggcctaagagttttcaagctcctaaatacgatattcttctatccttaaggcttgttttatatcctgctgatttgtaaatatctgacttgggattgggttcttcagtttgaggtgacagtacttcagcatccctgtatcttttaggtaatcttgctctgaaatccattccatgtttaatgagcagtgaatatacccataacagaataaatgacctgccctacaaagagttcacatgacatcttacctagaatgagtgccctcttatctgagtttccttcttatttcaagaaacctgaagcatccaaccttataactcagcgttcctcactacatgagtagaaggagcagctacaaaataagtaccattctctgcagtgtggtagaaccagcgatatacagatttctccataagaatcaagataaaatgcttttctctaggtcaaccctcctgggcacctaaaatgagatgcaaatttcacactctgtactcaaaggtatttctccagctataatcttgggcttaattttctggggatccatatttattggaaaaagagagggactctcataaagaaagaattcctagagtcagcttgttttattgctgcctagactcgcttcttatcagttcattccacaggtagagcctccgtttaccggttacattgtagactcagtttgcttcctctctttatccccttcctatcagttctgcaccactcggcctcattcatctttcctaaaacatctctttcatggtgttacacccctacctaaaactgagagtggctagttctacttgtaaaggatctggcatccaggaggttttctaacatggctgttccttttttctttaaatgaaatacctgtccctctccttattcctggaggtcattgccccatctattggctttcttttctctgtttcatcctggtgccctgcctctgtttctgcatatttctgtgtctcaattccacagggctttgagccctgagctgtcatctatgtatttaccaaaattctcccagttgcagagaggccttccagtctctgttggatgctctgtgtcatacttactttgtttataggtcttccaaggaagtgaataaagaaaaggttgctggcatgctgtgatattgcctaggggttaaaattattgcatttgaaaacagactgcctgggtttgagtgccaactctttacttgccagttgtgtgacttctggcaagctctttacgctttacgctctctttgtttcaactttcttatctgcaaaatagagataattctagtgcctgcctcctagaggatagcgtattcatggagacaataagtactcagtaaattttagttgttctttattgtggttttgactgtttcagattcatggtcttaaatagctttccagttactagatttgctttgatggtagagtttagatctgaaggatccaaaacattctctccgtgcaaataggtcacagtagcatcagaaggacgctagcaattagaccaaggtcagggtgctaggaatggggaaaggacggacagctacagttaaggaagcaaatggcagcaatgagagaatatacattggcttatcacctagcccctggaagttctgagcaatacaaagatagagtctgatggttaaactgatggtaccacattttcactgagcactgtaaggcagcagatgaactaaaatgtctctcacaatttgcatttttatatatagtcttaaaaaatattaagaccttacatgcgaactctatgctacactcaaaaaaggttaccaggaccaatggaaggtttatcagtaatgaatataatctaaatgaaatttcactgtgccattttatgagtcagtcatgattttgaaagataaaagcattacctatttctaaccattggctatatattattcaaaatctgaaggatgtcattagaaatatatttgtcttcttttatattaaagactttctacatgctcagcaaaacaatatataaagagcaatttttactttaccatccagttgatcaactactctgtttccaagtgagaatgtaggaagggacgaaatgagtcatgatgtcgttcagtggggagaagtataggaggagtttcaagcgcaagggctccagatcaggctgcttagatttattatctgtgttcatatgggaagttcaggaaagtgaggtcagctgctatatcagatacatccccaaatttcacaacataagtctatttgtcattcatactgttagattggccacaattggtgggacagctgtgctccaagcaatgattctgaacctgggctgcttcttcctttcattcagctggaggtagggtgggctggatttaggttgagacattggggcaactaaacctttcacgctggctatattgcctctccacgtggtctcttcaacatagtggctacacctatgtcatgggggctcaagggtcctatgaatgcaaaagcagaagtttccatgccttcttatgtctcaggtccagaatgggcttggcatccccttctgccacattcagttggttaaagtaactcatagagccaggcgggcttgaagggcaggggactacactaggcaaagaacactgaaaaatgtggtccactcctgggactaccacacatggctatgcaggttgcctggatgctgtctccaggtttttatggactggggctagaaatgaagcttgtcacttcctctgacattccattagctagactccagtcatatgaccactattaactgcaagagaggctgggaaatgtagactagctgaatgcccacgaaaaaggggctacgggcttcatgagcagtcagtgttttcctcactgtgcgccatccatttctgtgcctccatcacttcctctataaaatgaaattgttggaggcagtgaatacatggcacacatgaagtgcttagcacctaatacatgctcagtaaacttctactgttatcattcactattatgtagtggctatttgattttattccatctaagtaaaagcacaccgcactggataccaggctaaggaatttggactttgtcctggagctaaggaggagacatcaaagggttttaggcaaaagagtactgtaatcagaaatgtattcactcaaaaagtttgacagtgattctatgatatttttgccttaaatgtgcaaaatatcaccagtgatataaacagaaataatccagaataagagccaagaagaaggtggaatgaatgcttaatggcatagattcttaggctataaattgtttcttggtatgcttagatatggagggttaaatgggaaaaaaatgaccattgtgctctcagcactttttgtgattagcgaaactcttccacagatggaaccttttagttgcttcctgatatttatttccaaggctctttcagtgactctttggtctcttattggttttacttaaagagttgttatttaaatcttaaaaaggattccttatctttatgttttgtttttctggtttgaatgcattttccaaagaataccaaatatacacaccttctccattatttctgcacttcctcttaaggcctgccttgcttccactcttaaaacagactaggaatttcacaagatgttgtctctcgggattatttgagattattcacttagtcaccttcttacgaaacatttattgacctgacagtgtatgtctccatcaaataattgatttaacagaccactctagtgttaggtaaacattcttatttcatcactgtctcttccttattagatacttataacatggctcctactagtactgactctgaactgtggttttgtcttccagttaatttgtaagctcatagtggttgggatgacagccgcattacttatgagctgtgaatctttgagcaagtcacttaactcctctgcgcttctgtttcctcatctgtaatatgaggataataatgtaacctactgctaagaattattttgatggttagataagtcagtgcccataaaatgcctaaaacaatgcctgacacttagtaagtgctcagtcagaactacatgttgctgtcatctatttataaactaaaggatcatttgcctaataataaaaaatgaattacatatttatcaatttcatgtgaaataatatattaagatattagatatattgatattaagatattagatatctttaaatgaggatgtaacttccattgatgagtatccagtatgagccatgttgactgtctactggaataatgcgtattttcaacatcagtttttaggatagtggtggtggaggtatgtgcagtaacaggtagattttactctgaatctctgtttaagtttaatcattctagtaaagaaaaccacctggaatattttactgctttaaaattccttccttagcagcagcagcagcagaggctatgtgtggcttacatgattagtttcacagaatcctagtaaaagcataccgagtccttaattttgaatcagtaagatcttccatgaaatcatttcccggtttgtaaattataatcacagtgattcttttgttggaattcacttgagacccatgagagaactataacttcctattgactgggaaacaaagatgtcttttcgagttgtatttggttcagtgccatgtggaatgcatggagatcaaggtaattcgcgattggaattaatcttcccttttctctctgctcttcatggatgccacccccaacccccaccccaacctgaaccctcttagatatggccatgtgggtatattcactctgacctccacaccctctgttcaggaaatgaacaacttctcaaggactgctgtcccacaaagaggataaaatacagagcatgtgttatgcttcagtgtgaaagagaatgaaaacttttgctttttagtgtgtgtggctagtgttagaaaaatggagtcagtagttttaaaatataatttaagaactgagaatttgtcctaaacaaagaaggcatcctatgtgctttatcttgctctcaggggtttcaccagtggcttccaacattctttggttgattcctaataaggacagtttgcacagttacaatccaattaccgtttgtagatccctgtggaaaagaggattttttttagaggaatccttttctaactcgagtatatttcttcaaaatactctcattctttttgtcccttccctcccctctttcctcctccccaactctctctctctctcaccctctctctctctctctctctctcacacacacacacacacacacacacacacacacacacacaggcacacacgcatacaaacacacgcactcactcatttgtgcacttactcagggacacagcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatgggtaagcaatataaatatctatacttacactactttttcagaaaataattgtgataaagttttgtgattctttcacatccatcttgtgatttaggaagaaaactggaatgatcagtgtctgagatgtgtgacagctaaaaactgtctgtgtcaatatggatttatgagaaccttatttttagattaatgatgtggcagcttgaaatgagcaaactcaagcaggaaaggattgtgtcatgattaacagaacagcataattgagctaatttctgtaaaagattcgggcacaggctgttttgaagtctgaaagggtaaagtggtttatctttccctcttaacttcttgaatatgggtgcaacattttagttgctgtggctgtgataaatatgggtttaggggaacagtttggatattaaataaggctaataatacatcggatgtgcttgtgctgtcttttacaaaagaggaaactttaagcctctgaatttttaaacactgtctggctttcattattataagggtatgtctcataatgaaagggcttggtggtggaaagaggggaacatgaccctgatgtcccagatcccattatgccactgcagctgctttgctcatttgtaaagttagaggtttggattggtttatcatgaaatgttatgaaatacatatagtggttatgagtctaaattctagaacctaaagcctggcttcaaatcctaactctgccacttaattggtgtgtgctcttggcaagttacttaagttctgtgcctcagtttcttcatctgaaatatgggaataatgatggtaacatagtccttaggttgttgtaagaattaaatgagataatataaataaaaggcttagaacagtaactagcagagagcggaccatctataaatgtgagcagtatcttcaaggtctaatctatctccggaggtcgttctaatttcagtgaactaaatttaattagagaaagacaagtagaaccatcagctgctggccctgtcattaagaaatttctaattcatgccagtgtttccagtttttgcaaccctgagatttgtgcaggccatcttaccttcttcctcccatccaagactcgagagaagcttagaactgagaattaaattgatggccattagaaaagtccacaattcaactgggactacacagaaatgaaattgaccttttgctctgacgtttttgcccttgaggacttccagtatgtcccctctatgctaaccactggaaaggttctttccactggaaacaagatgtaagtgacatttgattttttagatggtgttagcccagccctgggtttgacaatgttcatttctacttctttagtttatcggtaacccaggtgaacaggccatttgcagataaccacttctatttcatgctagcatttgcatattttctaatatgctaaattatgttgtttgatttttttttttacaggctctctgggatgtttctcagagacaaaatcttaggagaggaggaaaatggtgatggcaaaaggcagatcctaatcatagatgtgtctttacttttagtccagtccaggggtcagcaaactttttccataaagggccagatggttacctttacggaagggcagcttcatggactgtgcagtctctgttgcaacaactcaactctgcaattgtggcctgtaggctgccacagaaaataacaatgaatgagtgtggctgtggttttcataaatcaataaaacttgatttatgaaaacaatcagtaggcagtacttggctccccggctagtcagcttgtatcagcaaaatccctgtcatcatccccatttcatagatgaggaaaatggggcatggggaatgtaagtagcttgctaaaaagccacatggctggctagtaagtggcaaaactgggactcaaactcaggcagcccagcttgccaccccttgcttttagccaccaggctatgctatacctatgtcaaccagtctctgcctgggctgctgggctcccaaaacctgcctggctcattccctcacctccttaagggttggtgcaaaaatcatgttctctgtaaggctgtcctggtagctcatgcagcactcctattcccctcaccctgtgctacctccttctctatctcttatcaccttgtaaaacttgctgtgtaattcagcacacatttcttaagagtttttggtgtctctaatacttccaagttaagatgctgtgttaggtccttcttgtatcaccataaaaatacctgagactgcgtaatttataaagaaaggaaaagaggtttaattggttcacagttctgcaggctatacaggaagcatggtggtgtcatctgctcagcttctagtaatgcccttgggtaacttgtactcaggatggaaggcaacagggaaccagcctgtcacatggtaagagcagaagcaagagagagagggaagaagtgccatgcccttttaaaaaaccatatctcacatgaactcagagcaagaattcactattgcaaggacagcaccaagatattcatgagggatccaccctcatgacacaaacacctcccaccaggccccacctccaacattagtgattgtatttcaacatgagatttggaggggacaaacatccaaaccacatcagatggtgatgcaaatttagagtggtgatgattaatattaattataacttaaatttccatttattcaggtcttgtgggagcttataagccttccacaagaaattcatttgtattgtctgatattatccctacaaactgagagttaagtcttgttcttttctccatcttaataatgagaaaaccgatgatcagagattttctgaatcttaccaaagaactgccatctatctgaatccaagtcttcaccaccatgccagtgagactcaacttttattatgcaaaaagtaagactcatctggggatgctgctttataatggaggtgcttgggacctattccctgtgactctaattctctaaatctaccttagagccaaaggaacctacgtgtttaacaatgatcattctgcccacgtgattccgatgccttgggtccacaaaccacattttgaacagccctgcctcaccccttgtttggccctggggagtttacagttggatgagattaaagagatgctgcagttagagactagccccaaggatgtaataaaacaatgtggtgtagaacaaaaccaaaattatttcaatcaattttatttcatgggaaaatcaagtctgtaaaggtgcaacttagctcaaaagaatgactttctgaataaagcatagatattagattgtttgggttttagtttgtcttttgcttctttttttctaaacatagagacatatacttctggtgggaaggaaatctctttagttaacacttttggtgagttgttctccagttaatcaagactctattgttttcaaactttttttggtttgcttcttttaattaggtttgtagtgtttgtacttattaatactagcttaaaataagccctatgattctgtttatgtgtataatacgtagaaaaatacatgtaaaatacacatagtaatgcatgatatataaacgaatatatagtacatatttttatgataaacaaaatatataaataattgttaatatttccagcaccatcattttaaggagattatatgtaatctgggcttaacagcagacttatttatgctaaaccaaggtttctcaacttctgcactgtagacaagttgatccagatagttgttgattttgggcagtagtcctgtgcattataaggtgcttagcagcatccctagcctctatcttctagctgccagtatcaaacgctgccccagttataacaaccaaaaatgtcttcagacattgctaaatgctcactgggggcaacattaccccaccaaggaccattatcctatatcattttatcatattgctgccctttattaatgctgtcacatagtaccctagaatagaaagatgtttttacaactgccaaggtctttagtctatccagagacattggatgaatttcaatttcatctacatttataaaatctaaacaaatttgaaatcatccattttcaatccttaaaaaaattccatgatgatcactcaaaagactagattcagaaagccttcaaatgagtcattcatttataagataaacagtcaccaaagaaaaatgctggtctggaccatgcatgtgagccttgagaaaccaccagaaacatattctagactgtgctggtaggctttggtgcccttcctgggtgcttgtttatcactttatggtccatgccatgagagtcaaagggagactatgacctttgtgttcatgtcttactgctcctatgaagtctgatgggtgggtataggtatcacggattaactcttccccgcgtcacctattatcacatttattttctcccctcatgtactggcatgggtttttcttggcttatcaacaggctatttcaaaagactgtctcttaatggtttattcgaatccagaatacagtttcccacatatatacaacattgtatgggttggttaggtttccaatttatttaactcatgatggggctggttcattagtccctagattgacaaatatttattcagtggctgttaagtgccaggtactgccttagataccgagaacatcaaaatgaataagccagacaagggtcttgccctcctgaatctagctgttgtatatggctgataatgcaaggccctaggactgggttgctggaatatggctgtagatgctacacaaatatgtgtagggcactacatgaccctaatctccatatcaggggttggcaaacaacagccagtgggccaaaagcagcctgatgcccgtttttgtatgacttgcaagctaagaattatgtttacatttctaaatagttgaaaaaaatttgaaggaaggatattttgtacacataaaattatatgagccttgacttttcatgtcatagataaaatttttggaatatttgtttatgtagggtctatggctgtttttgccctacaatggcaaaagttgagtaactgtggcagagaccataagacccacagagcgtaaagtatttactatatgtaattttctataattctattttatgggaaaagtgatttcagaattccagtcttgggacctctccagcacaaatcattggtgatggtacctgtagtatgaagcagcaccttagcatcaggtagcagggagataagaatctgatggaaggtcaaaacctacttttttaagtgtctgcgagcatgcccttcaccccaccaacttccttttctaatgctcccccttactcttgaattcatttcctattgctgccataacaaattatcacaaacttacaacacaaacttacataagtctcatgtgggcctcactgggctaaaatcaaaggccatgttccttctggaggctccaggagagaatccttggcttttcctgcactagaagctgtgtgcatttcttgtcttgtggctcctttttccatctgtaaagctagcagccaagctctttcaaatctttctctctcccacctctgcttccattatcacatttttgtctcgcttctgcctctacctctctccttgtgatgacattgcactcgcctggataattcagaataatctccccatctcaataatctgaaattaatagcatctgcaaagtcccttttaccatgtaaaataacatactcacaggttcctgggattcgggtatggacatctttaggggagacattattctaccaaccacaccttccacctgattacgccttactgtacttctctctacctccacagaacaaaatgtgggcagaggggcaactcacaagcttgcaacaaccagccagaatattgtagtggctaagagtggcttctgagagtgtcaggttcaagttaatttttttgttgagtgaaaaaataaggattatgtcatcacttcatttgtttaataaaagaaagcagggtcatgcttactctcagtttcagaaagtaacgtccttactattatgactgtcatagaaatagctttctttcccttggtagatttgtatctttctttgacaatggaggacttcttggattttctagacttactacatagcacttattatagcctaactgaacaatgtggatgcacactcaaactagaatctattcaagccttgagctcagtggttctcaaccctggctgcatgggagaatcattagggaacttcaggaaaaaaaatggacaaagaaaatgtggtacatatacacaatggagtattattcagccataaaaaagaatgagatcctgtcatttgcaacaacatggatgaaactggagattgtcatgctaagtgaagtaagccaggcacagaaagacaaacatcgcatgttcttacctatttgtgggttctaaaaatcaaagcaattgaactcatggatagagagtagaaggacggttaccacaggcttggaagggcagtgtgggggatcaggggaggtggggatagttaatggctacaaaaaataattagaattaatgaataagacctaccatttgatagcacaacagggtgactatagtcaacaataacttaactgtacatttttaaaataacttaaagagtggaattggatggtttgtaattcaaaggataaatgcttgaggggacagataccccattctccatgatgattattatgcattgcctgcctgtatcaaaacatctcatgtaccccataaatatataaacctactatgaacccacagaaatttaaaaagtaaaaataaggaaacaaaaaatacagatattgtcttggtcactgggtctgccataacaaaataacctcagatctctcttttggttaacaattccaaatataacaaagaagtttaaaaatccaagaagttaagaaccgtgggctgcaatatataatggactaaagtaaacttgaagcatcgcactttactttttattatgctaactgtagtcatttgtaaacagtttgaaaaaacatatattatttgattgtgttggaactgttttaattgagagtacaaaatcaaagctcaagaaaaatataaattggccaggttctgttttgccagacttagtaatgttttaattctgttttttcaaaagaaaataccattttcaccatgtccaaaactgggtgatcttccttctccccctgcaaacataattccctctgccattccccatcttggtgattagtgttactgtctgcccagttgctgaagctagaaactcaagagtcatcctagattaccccttctcttcccctcactgcatccagtttattctctagcatctatgtggttctaagtttctcccgtgtctgttcaaattggaatcagcatcccacttagcacggagtcttttctcatctccacatctttgacttgctctcccctttaattccttaggaaacttgtttccagtcatcttccctatatttcaaatctgctcatgttcctctctagctcaaagttcctgaatgactagccatcgtctatggaggaaaatctaatctggtttgcattgccaacagagacagccctacagaatctggccctgacttctgcttggcttcacctcttgcccttttcctccttccagccttgtaattccctgaacaagcctgttttctcaaactcatttgcctttgcacctgctgctaaagttgcattgctactgggcgaaccctgccccctcttactcaactttcaagcctccattgaaacactaccttctctataaagctttccttgatcctccagatagataacaaagccttgtctcctaggcattcattgcatttagtacttacttctagtaccacaatctctgtgttttatggattgtttgtgttcttcctacctgaaggttaactctgaggacgaggactgtgttgtcatcttaatagtcccaagcctaccacagagcttagcatctcatctgtgcttattaaatattgtttgaattaattaaccaggaggacttagtaaataagaacaaaatgtcccttctaggaattactttatttcagtcataagctatagttcacaggttgggaaactctagcccgccagccaaaaccagcctgctgtttttgtaaataaagttttattggcatatggccacactcgctgatttataaattatctgtggctgctttcatcccaccaagccagagttgagtagttgtaacagagatcacatggctcacaaagcctgatatattttctatgtggtctttacagaaaaagattgtcaaacccctactacagataattaagcccattggaggtcacatctttgattgcttttaaagaataggtatgtaattctgttttgacacttcaaataacagtcagctcccgtaggtacctaagcttgatatctaaaatttataaactcatctggggactttctatctgggagaaaataataataaaaaaaattccccaatagtgttccttgtagttctctaagcttagagggtgtgagtgaggggtacacccaaggcctgagtccccaaccataatgtctatatgtcctattttttcttagtctggttataccaaaaacataaaagaaagaaaaaattcaaaatacactggccccagaagaattttcttctgttcactgaatgtgactgcagcctcctcactttgactagatttgctcactcactcctctccccacatcccctcctgcatcaccctccctgagctcctcctgggttcctgctagtcttcatcattatccactggatataattcatacatgtcaaggcaaagaaactaaaagccataacttctttaacacttgctcaaattttgccttctcagtgaggtctttcctggctgctgtctctaaaactgcaaattcctttcttctacttccccttctttgcctttttctccttcctagcagttatcattatttcacacaccattccttttacttaccccgttcattttctgcccctaccagagtataatatattcatgtattaaatgagtgaatgaaatcccagataaagagggaaaatatcaaagaattaacatcatgccattcacttttggaatgaatacactagacaggaatttgtcaccagtgtgaaacaaagtgctatggcactttgttgctgggaccagtctttctgtctcccttctttaaggtgagtgacttcttttttatgtttttaagacagagttttgctcttgttgcccaggctggaatgcagtggtgtgatcttggctcactgcaacctccccctcccaggttcaagcgattctcctgcctcggcctcccaagtagctgggactacaggcatgcgccaccatgcctggctaattttgtatttttagtagagacgggcttttgccatgttggccaggctggtcttgaactcctgacctcaggtgatccacccacctcagcctcccaaagtgctgggattacaggtgtgagccaccacgtccaggcgagtgacttctttaagatggtgaagtcttatgggattctgttaagtgttccatttattgcaatgagtccctgcgtgggccagtacctctccttccctgatagaacttttctttcttgatcattgagcaacagtagctgcctcctcaaatctgttgcagcatgcctgatacatgagattcacaagaagtctttagtaaggagacactgggtttcagaggattgtaaagtactttttctttggacgtcactttcttactgtctgcattgagggtggagccatttaccctcagtggcctgcaagggtgtgcatgtgtacacatgagtacacttttaggattgtggaaatctttgctttgactctttgatgtggagtattttagcatcaaatgtctctataaatactgaacatcttcctgttgatcataactctaagcttattgtgttcacaataactcatgagagtgctacaaatagaacctcagtggttacaatattagcatagagtttaaagccctacattcttagcttgagtccttattccaaatcttataagttttatgatttggggagaattacttaacctcctcaagactcagtttcatcatctatattatattggtatatgttactatactattcatataatatgtcataagtataaactttactattataatatattctcatatattatactagattatattattaaattttacatgagataggtaaaaaatgttaaccacttcataaggttgttggagggattaactaaaaagcccttgactatggttaacagtaatatatgatctcaaatagctagaaggaggatattgaatgttagcaaccaaagaaataataagtgtttgagattagttactaattattagaaatatatatctaataaccatatgtatagaaatatcaccatgtgccccatgaatatgtacgatttttatttgccaattttaaaaaatgcccttggtgcagccgctggcacatggtaggctctccatacacactcatccccctatatctgatgtgtgtgatggcaattagcagcagcacagtgtttcacaaaagttagaagttcccatgtgttcccataaaaaggaggaagtaggaccctcacagtatctttctacatagtttcctcaggcctatatgcataatgagataagatcatgtgacccagcagatacttgagattttgacatttgcaactaactgagaaaatccacagtgaactaaaagaggatttgactttgggaattgagacccaattttggaacacaaaggtggtttgcttgactttattactaagagaggatgagatttgtgagaggtaagtgaactctgtaactcttgattttttttttttttttttttttggcctacagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaaggtaaggcctcttctgcctttctgccggggaacactgcaagtcaaatattggctctgccaaagccgtgagctgtgaactcttctcacacctaatattcacacaggaaggaaactacagcttcttggttgttggctggcattagtgtccatttgaaggacatgttcaagagggacaatttgcatgtcaggtaatacatttatttaaagggaaggtcaacttggagcattacaaaggaaagctgtgtgtatatcaacagtctatatggattctgaacaaccaattaaaaataattttcaggaaggtcatcttaaagggtcagaagaaaagctgtgtctatctcagtttggtttcaaaataacccatttgaaaagaatgccttaacactctgttaaacttgtcgtttgaccctatgccaactcagaatcagggattttaccgaacctaactcctttttagccagtttttcagctggtgtgttgtatgttgcactggagccagtgcacacctgattggctgatgtttgttttttaaacagatcctgattccagtaaagatgagacacatgtacttgaattccttgaatccataaaactttgtctctgtatgtttactgttgtctataaaggcactttttttttttttttgagatggagtctcgctctgttgccaggctggagtgcagtggcacaacctcagctcactgcaacctccacctcctgggttcaagtgattctcctacctcagcctcccaagtagctgggattataggtgcacaccaccacgcccagctaatttttgtgtttatagtagagacaaggtttcaccatgttggccaggatagcctcaatcccttgaccttgtgatctgcctgcctcagcctcccaaagtgctgtgctgggattacaggcgtgagccactgcacctggcctataaaggcactttttaatttgtattagtatgtagcagacagctactttgaggcagaatgaaaaactatgatgttatacacataaagtaaatctgccatgaaaagcaacattgggcagggtgcctgaaacttaaaggaaagcagaagagggataggaagcttctagaaactagaacatttccacggaggattttggtatctgcaaaacttctcttctactttgttttcttttggaggaggtcgaggggatgcttcatgaatatttattcataaatagttcatatatatatacacaacatatgtgcatatatatgtatacacatatacacacaaataggtggttctcaagcagggttgattttgctccccatgccctggggacatctggcaatgtctggatatacttttggtttttgcagcttaggggatggatgctcctagcatctagtgggtaaaggctgaggatgctgaccaacaccctataataaataggacagccccctgcaacaaaaattatcaggccccatgtgctgaagttgacctaccttgctgtacacacatacattcacattctgtcacccacagtgccagtggtgcagttctcttggctcagctgtggctaacagaaagaatgctggcttggaggtctaaagactaggacttgtgaactcatcctgtcactcctcacacctgtgagcttgggcgacttgcctctgcggtaggaggctcagttctttgaccagaaagagtagcacaaaaacactgaccagagtttttctttggatagtgagtcttagggccacgttttttcttgaagcagaacctgagactccattggaggttatgacagagttcagaagagagagatagacaaggccaatgggctgacaagacatgcatatttcactggcatatgccttgcacctttggctttcttgtcacggtttgttcactaccacaaccacagcatgttgtttccaagaggaaatccccaccctgttttattttttcatgctaatctcacacatagagaccctcagctcaaataagaagaaaatcacttaggcaattgtgaaaaatgaatactagtgactgtcaggccgtgtcgctcttatccttgagaaacgccctcctgccttacctggtattggtttggttgtagggtggagatgaggcctgttctccctccaacataactcacaaagtggcccatgtggggcccgggccaagagttttgtctccctttaataagcacagacattcttttcattcctaaggaaaaaaaaatggcaatattgttagcaaacttaatttgtagtgaagagaatgatgactttgaaaagtttttgaaacttggtttgaatgcacatcagataagatatcagggaacagatactctctgtggctttgtttttaaatccagttgatttttttctttgttcctgcttgttaaagagtccactaaacaaataacctttaccaaaaacaattttataaaacttgtctactagaggctctgtctccattaattatttctgaggctgtgtggttatccgcacatccagagaaagatttgtgctatcgaaatgtttgaagatattcccaggccacagcagttattttcatattttctgtcaaaataggaactaatgatttacaaataattttctcatttatagaggagagagggaattgtgtggctggtgaaagaaacaggcatcgcatgagggtttctgaagctactgaattgggcatatgaatatagacatcaaatatttactgagatccttggaatgtgtggctggtggcaagctctatgacagtagctttggtctaaatgtggccacttgatccccatgcaaaccttcaaatggaggttctcaacagggtcagattcactgtgtgaataattttcacaggaaaataaatactgtagccaggacctaaagcctaaagaaatgatgccaaacctaataggatataatgaaaatcatgatacaatgaaaatggacacatagtcaagctcacatttctgttctctgtcacattaggatgatcatagggatttatttgtggttatctatttgtagaaccctctcctgtgagtctggtgcttccagggttcaaatgaatgctattataacatgatcatcagctgccagaatttaccatagagaggaaagaattgaggatgggggagttgggaaattactgggtgatttcctagagtagaccacaagggtgggatccagagcacaagtggagggtttgaccttcttttacactataatgatagatgggcattagttatatggacactgatgcaagtgagttagaagatggtgggagggcacgtgggattttactccagattgcgtctcagcgtccaacaaaataggaagcaatttaatccactaggcgtgaggatggcgaagaggtcctggaggtttgaggaaagaggagaggagtggaagagagggcagctaacgggccagcaatgtcacaggattgcaggacaggccaaaaggtccgtttgaggttagtagctgggaattttaaatgaaaaataaacatcctggtatctaaacactgttaagctaaatacaccatatcggacttttaattccccagccttagttaatccaaatatcctcttttgagttaggacttttctagttcaattcaatgaaggtgaagagggacatggcagttgagaatatatctgtagtaggcaaaataatggacccccaatgatggccacatccacatccctggaacttgtgaatataatacctcacaggccaaaaggaactttgcaaacgtgatgagttaaggtccttgagatagggagattatcctggattgtctaggtgggctcaaactaatcacatgggtactttaaagtgcagaaattctcccagctgtaatcagggagatatgtgactatggaagcatggtcagagagatgcaatgttgccggcttcaaagatggagaaaggggccatgagccaaggaatgcagatggcctctacaagctagaaaagtcaaagggacaaattcttcccaaggggcctccagaaaggaacaaagctctgctgacacctcaattttagcccagcgagacccatttcagatttctggcctccagaactgtaagatgataaatttgagttgtttaagacactaagtctcttgtcattagttatagcagcactaggaagctaatacagtatccaaaggaatgattctaatcccacaacacagagtctcaactggataagaaaggaaattaggaagtaattcaataatataaagctgtaaattttgtcattaattatctataagctgaatgtgattccaaaataaagtaccaacagaatttttctttttgatgattttactaaattaatctaaacatcatctgggaaaataattaagtgaaggtagtcaggggaaatctgataaagagataaaatggagattaaccctgtccatttattaaaatgtgtcacaaaactgaagaattaaaaatgaaccaaaatacatatgaaaatttattacgtgataaatacggtatttttgtaaagggaaaaagatgggttattattgtatttgagataatgagacaatcatcattaagaaaataataaattgatatggaagaaagatttaaagattaaaaaatgaaactataaatgatgcaccagcagaaaacataggtagatatatatttttttacactagggaaggcctacccagaaaacataaacaaagagaggaacaagtttcactacattttaaaaaaatagaattatctctgacagataagcaaataactaaactttatagcacatttgacaaactaaaggctaacttctctattgcataaaactttattacaaattaatataaaaagaaaatctaaaatatagacaaattacaggtggctcacagaaaaatacaagtggtataaatagatttgaaaagatgctctccctcacattcattaaagaaatgcaacctaaacaccaaggagattttttttttctctcagagtggcatggctccaaaagttggatgatacacttcgtggggaaacaaacactctcatacactgttggtagaggtgtaaattgttgcaacagggtgcaaggcaatttggcaacatttgtctaaattgtatttatttatttattatttccatggttttttaggaacaggtggtatttggttacacgaataagttctttagtggtgatctgtgagattttggtgcagccatcacccaagcagtatacactgaacacaattcatagttttttatccctcacccctttcccaccctttctccctgagtccctgaagtctattgtgtcattcttatgcctttgcatcctcatagcttagctcccacctattagtgagaacatacaatgtctagttttccattcctgagttacttcacttagaataatagtctccaatcccatccaggtcgctgttaatgccattaattcattccttcttatggctgagtagtattccatcatacttatatatataccacagtttctttatccactcattgagtgatgggcatttgggttggttccacatttttgcagttgcgaattgtgtggctgtaaacatgtgtgtgcaagtatcttttctgtataatgacttcttttcctctgagtaaatgcccagtagcgagattactgggtcaaatggaagttctacttttagttctttaaggactctccaccctgttttctatagcagctgtactagtttacattcccaccagcagtgtagaagtgttccctgttcaccgcatccacaccaacatctattattttttgattttttgattatggccattcttgcaggagtaaggtggtatcacattgtgattttgatttgcatttccctgatcattagtgatgttgagcattttttatatgtttgttgtccatttgtatatctgcttttgagaattttctattcgtgtccttagcccactttttgatgggattgtttgtttttttcttgctaatgtgtttgagtttgttgtagattctgtatattcgtactttgtcaattgtatagattgtgaagattttgtcccactctgtgggttgtctgtttattctgctgacttttccttttggtgtgcaaaagctctttggtttaattaagtcccagctatttatctttctttttattgcatttgcttttgggttcttgcatttttctaaattttaaatggcccaaccattctacttctaagactgtatctcacagatacatacttgtatttgttggggtaggctaaccactcagtgccttaacaccactacaaaagtatatttcttactgaagcactatctaatgcaggttggcaatggggtgagaagggcaaactctcttccaggccgttattcagggacccaggcttcttgcatcttgtggctcctccctcctgtatatccatttagcctggagatgtacacactgaataactaataagataaaatagctgatgagcttaatttgttaccccttctaaacttaacatggttcaaaaagagacttttgaaaatgcttttgagaatctggagacatttttagtggttgaaatcaggaaccaatcattttccctgtgagcccaaaattactccatggaggcaagcatggactatctgattattcaaatggctactcttggcataggctcttggatcagactatctagtttgtaaatggccaactcttagtcacagaaccaggaaacaaatgtaaaaaatagtcaagaaattaagcaaaacctaatggtctacacaaacttttcacttatttaaaacacatccaaagagcactttttgtatatcaagtagtatgttaggtccaattaatattattttggtaacattttaatacaaatggtcaaaatcaggggttagcaactgaaccatggccaaaccaagcttaccatctgtctttgtaaataaagtcttactgaaacacagccatgctcattcatttacaattcgtctatgcctgttttcactcaatgtcagagttgagtagttgtgacattgtctcagaagtttactatctggccctttacaggaaaaatttgctgatgcctgatctaaggtaaaatgaaagaaaataacttattcctgccacaatcactatagcacgttagtgtaggcattatggcttaaccttattatattgtaaaccaatatttacagttgaatggttctataagacagaaatgcatatttgtgttttctttagagctgttttcttcttgtatcagttcatttctgatatcacaattgagaaaggctttgtttatgcattttgaaaacagtatcatggaatgaggaatagctgatggtttaagaaaatatggagaagagtctcataaaagagtaccccaatgcctcaaaattgctcaattatatggcttccttataaaatgatccctcgccattatcccttaggcaatgtcaaatccaagtacacaactcaatgaaataaggaaaattacattcttgctaggccaacactgcagctgtcttcagtttgtgatttaaatgttgatttagaaaataaaagtaacctggtaggcaaggaaattgagattgggtgtttatataacaacccttgacagaaaaatttaactgtcctatttctgttattctttctggcaatgcccagttgaagaggtgatgtgctagaactgtctgccaaagccttttgtgtaagtaaaaataaggttgaaacctggtgcagaatccacaaaatccactgtaggtagaaatgccaatgggaagcaaacaccaccaaatagggatgatcacggaataatgagaccactgtgcccagaggccctcaacaaaggtctctattctgtgaactgtggagctgattgtaccttctgtgtgtccacaatcaccttttctgtgatcttcacacaaaggatggtgacttcccatggagtagggctacgtcttattggtctttgatctggaacatcatctgtactgcctaatacacaagtggccctcagcaaatctttgagatgtgaatggatgcgtgcaggcatattatttaataataagcttttaaattaagctctttctctcactcttccccatatctctaaagagcatcgatcacctttctcccactgtccccagtgtctccagtaatgattttaaaacaacctcaacacttccttactccttcacttcatgctcagtttccagctttcattgatggtctcatagggttgatgtgagatttaaatgaaataataaccataatgagcttaaatcacttcctgacatcttatatactctccataaaacttatccatcaccatcatcatcatcatcattgtcatttttgccatcaccatatcactttgtcctgtatctcccctcaaccctatgtcactgcatcattatgcttgattttaattatagtcatagaacccctacctactttcctcaattcagggcttctcctctattctatctaccacacgtaaaatcaccagagtgaaacttcaaccacagtggctactcctttgttggaaaaacaaaaagcaaacaaaaatcccaaggctccctattgtctactgatcttactatcaaagccattttatatgagatactatctatttcatataaaagaagaaatccatttagtttgcagcctgttctcagaatgcaccacagacttttatttgtttacttgtcttagaacagcaggttgcagattttttgtccacaacctatctgcagtgagaagtacattttacatctcagcccaggaaatgcatgaagccaaacagcttatctttatcagagatacatttggatattctttataatattctctcctatcctcttctatctgattctctttcattttcaaaatatgttttcatgatccactgaattttcttgatttattaataggttataaaccactattcaataacacagtcttggaaggtatatggaatagagaacagggaatcacaaaggaagcaacaaaaatatcagtatggaaaaattagttgatctttgctgtggctctcagggccttgataaggtggacgggaacttctttttccatagggccatggtgatgaacctaaggctagagccatacctgagtatcttatgccttctctctctagagccaaactgagggagtgacacccagagggcttcctacaaggcctcacagctctttcctcataataccaagggttatgcaacctgaaggagatacatatgtggggctttaaggtctagctgcgatagaggattcaacactatgtcaaaaggagttcctatcatcgagtagttcctagtcaatagacagagaaaacacagatgcatcaattatattaaaagatagagcagtggagatgatctgtccaagttgactttggtgaccctttagatagaagctgcctcatccacccactctggtaaaagccaagaatgacaaagacattatcctgcaggttattttgtaattttcttcttggatgctcttcctagcaccccagggtttttaccatgtaaagttctcaagtgtctgctgccactatatgatgctatgttggtgccaagcaggtgtgggattctttaagccatgtgctttgtaccatggtattcacaaattacttcctttatgttctcagacaatatcgttttctatccaaggtcttgtctcaactggtcatatttatacatattcgtatgtcttgttggagcagcaaccactattgcacaagactttggcatcttgaccaaaacttctgtcactgcagtttctgaaatattctggcacctttcaaagatttcaagactgcactatattctcttttgggatcatagcccaaaataaacttgataattatgaagaatatcccatccttcaaacatgaacattttgccttttttcttggtttccccatgggcaaaataaaagcaaatacgtatacgttgaaatttaatgctgagtgtattttttaaccaatcagcctttttaggtcatttggaatcaagccctcaagattacttaaaaattcaactagtgggtgttactagagctttacatatggaaagctctggaagagtagtttaacaggttttcacttaagatagatgtgggcaaactaagctcatgggccatagccagtccattgcctgtttttatatttttattaaaacccagccatgtccatttctttctgtattgcctgtgactgctttagtgctacagtggcagagttgagtagttttgacagagaccttatggcccacaagatcaaaagtatttattctctggatctttacagaaaaaaagcttgccaacccctaatttgaaattaatattatagtaattcattgttattttttatgcagttgttcaactatactattcctgttcatttcaatttcttcattattttaatttcatgatgtagtaattgtgtgctttttaaggatcagacctttgttattcttagatgttttagtgcttatattacagtcatgcattgcttaatgacagattcatactgagaaatgcatcattagatgattttgacagtgtgcaaaacttaatagagtatacttacacaaacctagatggcatagcctactacacacctaggcgatatggtagagcctactgctcctaggctataaacctatacagcatgttcctgtactgaacactgtaggtaattggaatgcaatggtaggtatctatgtatctaaacatagaaaaggcatagtagaaatattgcataaaagataaaaaatagtatagctgtatgaagcacctccattataatcttttcagaccactgtcttatatatggcctgttgaccaaagcattgttatgtggcacatgactgcatatgtgaccaaatattttttcaaggtgagatgagttcctttggtggcattaagcaaaaaataaaagtcaatatttttatgactggtttaaacaactgatgccaccatgcagtctatagacacatgagttatgcattaaatgggtaactttaataagtcaatcttcattacaagttattactttcactattactatcttgtttgatgactgagaagttagcaatattcccttctcatgtcctagaattgcaacacctgccagtgcccaaatcaatactgggaagtagaaataaatcactgggattggcttgaactaagggttcatttcccgagtttggggtgataactcatcccaggatgagttgcatggaggatgagcaactgacaaaatggagcaaggaagaattgcagtgagtaggtggaggggagcaggatagagatggatttagattaaaaactactggtatacggaagaacattgtcatcttctgccattgcagacaagtgatagagaggaaaccattcttattttatttgctttagcgtctagcacagtgccttatacatacctacagcacaataaatatttgaaaaattaaatgagatacattaaaaattcaatcatagcacatttatgtatatagtgtttccatagcatatggaattgttttgaatggctcaaaggataatcaaaaacatggaatggataagaaaaggataggtagtataatagtttcatttaattgcatcatcttttcaggtactgaatcagagagagctgttttcatgggagcaactggcaggaaattctaggcatttccaagactttaacaagtaatgataagactcccaaaatttgggttttaattttcttgagttaaccacctagaatatttattagggaaaaatgatttttgtatttttgttctcctgcctacttcctttcatttacactccaggaatgaaatgtagcttaaaaaaatgacttggcaaaagccattttccctgccccgatatttggaaactcctgtctctacaaatacagtgcctacctagactaaactaaaagtattgtcctccatttaaggactgttcaatgaaagatacaaattcaggagcctggaaggacatactagctcctagatcatgaaaagtcagcagcagagctgcccctttgagacatgtgctgaaagctttgaaaaaaaaatcttctttaaaaaaaatcatataacttgactgtggaaaaatgaaagcaagtaaaagatccttctagggcataatttgatcattagcagttcttacagcaagcagtgattacaaagaacacctagttaaggaaaaaccatagttgagcctttaaagctatggcatctaaaccatgagatcagcttccctacctcatgttttgacggaacaaggagacgtgttcaacaaatcaaatatcttaatgatttttctgtaatagaaaaccacttgctttgaggttcgaggatccagaagttttttttctcctcttgaagatgatatagaaaaattttagaactaatcaccctgccagaataatttacacaaaacagaataggtttcttcttagtgtttaactgaaggcatggtgacctccaagagtcgactttctctacagcagtgagagactcacagaatgttcttattttctgaccacacctttgataatttcaccaccacttcaacatgtaaactgtggggattagtacatttcacaagtactttggggagcctcagccctaaggagaggcatcgctattgcttaagaataccataaaacattttcttctccagggaaacatagacactttggaaagagattttggaaatcctagcccacaaagtgctagcaggaaaaagaaagtgtttaattcactgggacttataccaacaaaagtgaaccaatcaccctgttcctatctgcctttgtctatttcaattaaagttagtggaagaactgttaagtataagttaataagcaaaaactttgataacatgagtttggttaaataaccaacaatctagggtatgaaagatttcttgaagatgacacacgcgcacacacacacacacacacacacacacacacacacacacacacgtatccagcattgcctgaatgatgggaccagtttgggcttgaatacgttttccattattttccatatagattgttttcttccacaattattattttcccctctcttgaaccctggttcccacttaagaaactagcaatccactcctgaatttgcaattttctcatctttttcaccaatagaatgcttagttggtaaagggttggattataaggaatcaaacattaaaagggatagggtaatcagaaaggaaggatgtcctaaactaagctggtggaaacccccaccaaaattcaaagaccccagagagggataacttcatcccttaaggttgaactcaaacattagcctttgcaagcagaactggaagcagtcttctctcttttgtcctggcacctagtaaatgtcttctcctcactgaagcatttcttcatattgcttttttttttttttttgtcgcccaggctggagtgcagtgacactactctgtcgctccggctggagtgcagtgacacgatcatagctcactgcagcctcaacctcccaaggctcaggcgatccccctgcctcagccccccaccccaccccaccccacccagtagctgggactacaggcacgtgccaccatgcccagctaatttttgtatttttagtacagacaggatttcagcacgttgcccaggatggtctcaaacttcttagctcaagggatccacctgcctcggtgtcccaaagtgctgggattacagatacgagccaccatgcccggcctcattttgctttaattaggtttccacatgtctatctctagcactgaattttgaatttttcaaaggcagagatagcattcattcatctgggttcatagcacctagctcagaatctcacctattgatcaatcaaagggtggatgggtggatggatagatcagtgtatggaagatgacatttaaacagataactattatattgtaaataatattcccaagccaagaatagtcatcatgttctatggtacaacatccctgggcagagaatacttgcttaagaatagggaagagatccctgttttggctcccttcctaaatctctgggattcatcccaggttaactcttaaaccagagcattgcattggtcccactgttttccctttcctggtcccactggtttcgctttcctagattactattcctcttttctatcagagctgctatccattccatttcttgggatagactttgaatatgaagcaggcaactcaaagtagaaggagcaattttgaattcattccactcggggtggcaatggcagtaagtggatcctttgtccagcctgacttgtcctcaggtaacacctgttttcctatgtaaacttactgggccaatttaacttatgttgctgggattaatcattagaaagcaccaaacatggagtacaggcacaatgaatggctcccaagtgccaggggtcattaataatattgttacttctttaacaaacctcctgttccaaactggaaataaaatatctggttcagtctttctcttgccttattttttgggaggtctgtggcttgaaagccacaaagaaaagccctcaaagtgagaaataatgagatgaaataatgaattttagttttaataaaggacaaaatatggtattactaaacctttttacaggatatccacagatcatataactcaattcacatttatatgtacatatatatgtaaagagatgttatattttattttaaaaacaatattttggtttacagaataggcattggagcttaaaaatagatttctgtactaatcaaataatcggtgttcatgaatgcaaatgaaaaatactgtctggataacttaagcagaaaaaggatttagagaacctaagatttagaatcttacaacaacctaataagccacctatgaaaaaatcaccagccccataaaaacaaatctggtccatcttgttagctgtccactccctttccagcaaacaggctccaccagaatggcaaacataatagatgtttcatgtcagcttaggcacatgttttctttcagatcaaggagatgcaaataggagattatttcactagtttcagcctggcttgtgagtcacctcccttcttgtcactaaactgagctttcagttctgtggagcacttcagtgagcaatacaggcctccattttctcacatgcttgataagtgagtttccaacctttgcttgaatacatctggtgcctgggagaaaggacttatttttttttaattttggaataattttagaattacagagagttatgaagatagtatagagttcccttatgccccttacccagtttgccctgttaacataataacataacctcaatgctattatggtaacattaataccataaatgtattaccttggtacatttatcacagctaagaaaccaacattggtgcattgctatcaacaaaactatagacttcactcagatttcaccagtttccacactaatgttatttgtctcttccagaatcctattcaggataccacattgcatttaactgggcatcttttcttatctttttatttttatttttcaaataacaaacatttatcttgtaaaacagcttctgtgaatagcttagcttgggtgttctggttcaggggctcctgtgaagttgcagccaagcaaagatggggctgcagtcatcttagggcttgattggggctggaggagcagttcccaggctcactagtatagctttcagctggagacttaccccttagctttttgcatagggctgctcctgacctggtttctcacaaagtggaggggtgcaagacagaatacaaccaaatggaagccacaatgaatgatgctttgttttgaggcagctcattccactggttccatttgctggctagactgtcttcctatgatatcttcctgaattttcattctggcccatggagggctggccagtaagtctcttcatccaccatgtttagtcctctaaataaaaggaaagaaccacaatgtctcctgagtcttctctaaatgctaaacatccattcatacaactgttgactatcagagggtgttccatacctgatcctgccccacccaaggagaaaaaaacagttcatataaagaaatacaaggctatttcctcaagaaacttggcttattcccccatctgtagtcctagaaatttggtagaaagataattatatgcagactcccatttcttcgtaaattaaagaaaattgctattgtgtcccaaagtcagtgtgatacataaaggcttcataatttgtaaacacttttacattgttctgtttaaaacagaaactgagataaagtataacttgagcattgtgacaagtgggaaaatgtgaatgttttgttcacatttacatgatttgggttcatagctgctctctaagttgagttatacatagaccagtggttctcaactggagtaagtttagtccctggaggacatttggtgatgtccagagacatcgtgtgtggtcacaacagtggtggggtgctctggcatctagtagataaaggccagggaatgctgctaaacatcctacgaagcacaggactattctccactgaaaagttatctggccccaaatatcgctagtgcctaggctgagaaatcctggcacagattatatgcagtttctaaagggccacttccctactctgccacccaagtgtatctttttaaatcattttcccctcactttttcattgagctctcctcattgcctatgaatttcattggtttgctttctccgagagtcaattttattggtccaaatacatagtaaggcagctgtggctaatgaaacaggagatggtgccaaaaagcattccttcagtcttttctcagcaggatttttttcaaagctttgaataagctaggaccttccttttaggctagggtaggttcacaaactctgaggcataccaggtaatgtaagtgggtacagtggcccagggttgggtgcctatgctgccttggggcacatgtgaggaatgtgggacccagtgttgccagctcttccactttcctcaagaggctggaactctagatatgtatgtgaactttccaagattttgcattaggacttaactttttataaaactttgtgtgggctaaaaaccacctgaatagtaggggactggatatggccattttgcacccatgaggctggaaatttgcctgtgtgtgtagcagcaccagaggaggtctttgtccccagcagacatttagattcttttccaccctcatgtcatatttcagtgcaggtgatttcctttcctttccagtaatgtaatctttattgagctctgcaagtgaagaaatttaaaagggcttaaacattgatgccatatcccacattcaggtgcacctgtgaattgaggctgtttacactcattccccatgattgcctggatgagaaatgagccttagcgcttcttgcccatcatccagacttctgggagggcagagtctaaatgcattgcacaaatggatgtccgctgttttacaaacacctcctggataggagagccctgaaccatctctcatgttgcaaaggcaaagtgaccttaaagaaggacttccagcttctcctcataggcatctgggttctgctcttagccacacctctcaagacagaactgcgcttattggaaagaacttgaatttggcattgaatgtcagccctgccacctaccagttctgtgattttgagagaatttgcgttaattctctgattttcagttctctcaattgtaaaatgaataaatcaaaatgctatcccaatggatcgtgtgttgacacgtattaggtatatgatataaatatttcatatcattaaaaaaaagtacttcttccagtgccagtgcatatttagagcttggaaattgttagtttttcattcccctccctctctaactctatgttaccttgggcatgccagttcatgtatctggctcttactgtcacatccctgaaataggcaccacatttcctccactacagcgtaaggtagaggttagagcatgatatggtttggctgtgtccttacccaaatctcatcttgaattgtagttatgggaatataatacccatgtgtggtgggagggacccagtgggaggtaattgaatcatggggactgttacccccatgctgttctcgtaatagtgagttcgcacacgagctgatggttttataaggggcatcccccacttcgctctgcaattctccttgctgctgccatgtgaagaatgacatgtttgcttccccttccacaatgattgtaagtttcctgaggcctccccagccctgcgaaactgagtcaattaaacctctttcatttataaattacccagtctcagttatgtccttatagcagggtgagaatgcactaatacaataaattgataccagtagagttgggtgctgctataaggatacccgaaaatgcggaagcaactttggaactgagtaataggcaaaggttggagccatttggagggctcagaagaagacaggaaaatctgggaaagtttggaacttcctagagacagagggctcagaaactttgaaacttagaaagtttgaaagtttgaaacttcctagagacttgttgaatggctttgaccaaaatgctgataatgatatggacagtgaagttaggctgaggtggtcttagatggagatgaggaatttgttgggaactgaaataaagttgactcttgctgtgctttagcaaacagactggtagcattttgcccctgccctagagatctgtgggactttgaacttgagaaagatgatttagggtatctggtggaagaaacttctaagcagcaaaaccttcaagaggaagcaaagcataagagtttcgaaaatttgcagcctgatgatgcaatagaaaagaaaaacccattttctggggagaaattcaagctggctgcagaaatttgcataagtaacaaggagccaaatgctaaccaccaagacaatggggaaaatgtctccagggcatgtcagagacctgcacggcagcccctcccatcacaggcccaaaggcctaggagggaaaaatggtttcctgggcctggcccagggccccccggctctatgcagccttaggacatggtgccctgagttccagctgcttcagctccagctgtggctacaaggggccaaggtatagctcaggctgttgcttggtgcaagccccaagccttggcagcttacatgtggtgttggtcccgtgggtacacagaagtcaagaattgcagtttgggaacctccacctagattttagagaatgtatggaaacacctggatgtccaggcagaagtctgctgcaggggcatagccctcatggaaacctctgctagggcagtgtggaagggaaatgtggggttgaagtccccacagagagtccccactggggcactgtctagaggagctgtgagaagagggccacagtcctccagaccccagatgtcatctatatagcaggaatcatacaggctgcagcctcttcagattggcttctttcacttagcaatatgtatttcaagttcctcttgatcattttgtggcttgctagatcatttcttataatttctgaatagtattccattgtatgaatgtaccataatttatttatgcactcacccattgaaggatatattagttgcttccaaatttttgcaatgatagataaagctggttaaacactggcatacaagtttttgtgtggacgtaagttttcagttcatttgggtagttaccaaggagtgcaactgttagattgtatggctcagctatgtttagttttgtaagactatgcttagtttttgcaacatttggcaaccctattctcaatgagttgcacctcttttgaagaggtaaagaacaagcatatacttcaatgagaaaagccataaaggacatctgaaagtcatgttcattcattcatacattcattcattcacttgatatttgagcacagtcatgtgctagaccctggaaatacaaacaaacattggcaatggaaaaaatgcatgctgtaaaacaaagcaaagcagcataacaagggcagtaggaaaggctccaaatatgcaagtgacagaacaaagatggagaaattttccctgcagcagtttcaagagaggctcagagaggtatgaactagtgaagtaacacattttttacccttctcctacactgggtctgaggacacagctatcgtgaaacaggtgaccccacgcaggatcctacagaaaaacaactaaatcacgtttgtgaaactcagaactacaagctcttcctcatgatttggacaatagatgctttcaaagagtggttatttttcctatattttccttcccttctcttaatggagaattccttcttccaccctgaaaaggaaatacgaccatcagtttcccaaataaaaagagggaaatacatatgtgtataaacggtggtgaccacctagtagaattttaagcctttgtttaaggatattttccccctaaggactgcaatttcctaagttgagtcaacattcagaacttcagttaccattgtcctatgtgagatttgtgtgtcttgtatccaatgtactagttaggtatttctttataggctttttaagatttacaggtgtacctgatcaaaaatagctggaaagatctgagatggtttttactggataatttattccatgtgtacccaacagccaagcacttggcaaatgaccaaaaaatatgattttaaaagccagaatagctcatgcaagaaataagtagctgagagataaagaaaaaatggcaacgttatgctttaatggcaatgtaaactatctagaagggacatttatcagttcaacaagaattaattttcttcactctcaactcctatgaacaagccttctccttctaaaaggtaggaatgtctgccccagtaattaattgtttatgggtaactagtacatcacgaaaatctctataagacatctttctctggcacatattttatctttatactagatggaagataacaaccaagtgagctgtttgttgaatagggcacacttcaaagccaggtatggatatctgatttaatgcgcattagcaggacatcagtgcaattgttgtgtgagtactgaggcaagtaggcaaatggcggggtgaacttcactccttaaaatagtgagctaaacagacgtgaactacctaagttgtttgaatttgttccacatgctcttttaaaatgatataagacaaaagagatttaactggttaattagtgaaaatctagtaacaaaaaatgtctggttaattcatggaaaatgggaactttgaataaatttcaagataacgtttgaattaggccaataaagttaattcttgtgtttgcataaacacaaagattggagaattgctgtgtattcaccatttactctttcaaatgaccattactttatttagtacgtgtgtattgtgcacctcctgtatggctgggaacataccagtttccaaaaataaaattaggactatgataaagtttttacactctagggtaacagttcagtaaataacagccacaatacagggtttgagaggtacagaaccactaaaagagaggaaagggggcacaattttgtttgagaactaacagggtccagaaaaggtgaagaactaggtggtctttgacacaagtcttaaaagagtaagtaggcacttgccacacatagaggaaagaaagtgtagcagacaaatagaccagtcatgattattaactatcaactagttcatcttttttattttttatttttttgttcctttttgagatggagtctccctctgtcgcccaggctggagtgcagtggcatgatcttggctcactgtaacctctacctcctgggttcaagcgattctcctgcctcagcctccctgagtcactgggactacaggcacacgccaccaagcccagctaattttttttttttgtgtgtatttttagtagagatgaggtttcaccatgttggccaggctggtctcgaactcttggcctcaggtgatctgccggcctcagcctcccaaagtgctgggattacaggtgtaagccaccacacccggcctgtctttaccatttacttgcttttcattcctggacaacactgatctcagggaggtagtgagtagaacggtggttaccagagggtggaaacagtagcagggttgacggggataaagaaatgctggacaatggatacaaacatacagttagagagaagaaataagttctagggttcaatagcacactcgaataactgtagttatcatgtatttcaaaatacctagaagacatttgcgatgttctcaacacaaaaaattgataaaagtttgaggtgatgaatatcccaactactctgatttgatctttacatattcatgaatcaaaatatcacatttactccatacatatttacaactattatatatcaataaaaatcatgaagatattggtaactaatagctaacatttattcaacatgtaccatatgtctaaccttctcaccatcattgtttcctgtgacacagtaaccctctgacacagataccatcatcactgttttacaaataaataagaaaaattatttcaatgtgctttgggtgagcagcactgagagagccctgattcacctggataagaatgcaatgtgcggcctggctcaatttgacatctcagagcttttgtactctgagtgcaataaatcaggtgtatgcacagaaatcagggcagacttaagctcctcctaaggagtgagtcaagtattttgtgatttgactggatcaccttaatttagatatcttcacaaagatataagcctaggactccaagatgaaattttaacatcagggaaatgagatggtcctttccctctgctatcaggagaaaccctctccaagaggcagggaggcaaaagactgtttctcttcagtttcagttgctgaaataaaggacttgccactggtctgtgggcaaaatttcttgggcactgtctttgcatatgacctctgaattttgttcagtacatcactgctctaaggatatatttagtgcttttactttgcattttaacattcagctgctgagtgagacaatattaggagacatgatgctcttgatatcagccattcttcaaagcgggtgtttattatggaataaaagaaaatacgtgcttcagtctagaatttaaaagcactaactgcaatttttcaagcatatgtatgtaaattaaagttacctgtcttaccattttcttgagaaaagtgtatctttacgtttgttttagtgcgacttgtttctgatatcctaacctaaaatttcatggtcacaaatatataaattaaacgttatcttaatgaaaaaataaaacaggggctatagcacaagagatgtgaggaaaatagtcacacacacacaaaaagtaaccaagagtgaaccctgaagtaatctatggacttggggtgataatgatgtgtcaatgtaatttcatggagtgcaacaaaggcaccactctggtggggtacatggatagtggggaatgctatggtggcagaacagggggtaaatgagaaatctctagaccttcagatcaatttgttgtgaactaaaaacaattctaaaaaacaaagtcatatatatgtgtgtgtgtgtgcatatattcacatatacgtatatgcatatatatatgcatattatctatatacatacatgtatatgcatatatacatacacacacacacatatatacgtatatacacacatttatacacacacacacacacacacacacacacactcctaataacttttaaggtcaaaaactttcttcccttcagaatatctgccagagtgacttcaagtacacagttactcatttgaggtactaaggggtgacataaatatcaacttttggccgggcgcggtggctcatgcctgtaatcccagcactttgggacgccaaggcaggcagatcacgaggtcaagagattgagaccatcctggccaacatgctgaaaccccgtctctactaaaaatacaaaaattagctgggtgtggtggcgtgtgcctgtagtcccagctactcgggaggctgagggaggagaatcgcttgaactcgggagacagaggttgcagtgagccaagatcatgccactgcactccagcctggtgacagagtgagaaagactccttctcaaaaagaataaaaataaaaataaatcaactgttccatcactaaataccttgtggtgtctttctcatccttccactgtagaatagtcagatagcccagtatgtataatagaactctcacatggacctctgcagtgcttattttgcctctgtaactactgaaagagatctcaaataaggatcttcttagaaacttgaagtagtacttagacttacacatcaacacatgctttgggtaaaaggaaaatcctttatgaaaatgcaagctttaagaattaaatgctccccataaggattcacttattcctgtataagtgactgtaggcagaaaaacagaatctgaatgaactttttttttctttaacttggaaaaccttgaaaagataagagtggtatataggggccaattaaaatgaaaagaacaagggaaaatgagagtaagtctctcctctcctcccaatgagggtattgtgttctgaacaattcatgaatggaatttcagaaactcagcaaaagaatacatttaactgacttattccaaatatattctgaatttcatatttactaaagtgtttccaaatgaacattttgtatgttatgtgcaaaaactgcacattaaaaaggaaaggtaagagagttcatcatacaagattttagatgcatgcatacttaaactaacttccacatactccacaaatactaaacttaaaaaacaaagcaccctacataatttaccttgccatagatgtgaagtaattgttaagcatacataaatgttaataaaatactttgaatcaatgctgaggggtggtatcattgaatggtggaccaaaacaaactaaatggcattttgatgtctttggaaatgacatacccacaagccaatggctcagcactgacatttatatatcctgctcagttgtctcaatcatttatagtagtttaatttttttcaagaacacagatgttaaggtaagtttaataattttgaaaggccatagagtatatctattttttgaagtcatactttcattggaattgtctctttaacctaatgaataaatacaaagaatgcacagataaaataagttttgtcttcttttattagagaaaaatgtactgttccatgcctgtgctttctacagttttggaacggatacagatccacagaggccaaacctaaaactaaattatctttaatgttaaaatttaactgaccatgtatataactgtgcaattgctgctttctcacagaactgtctagggttcattcaacagatcacagtaacgaggtctggcatttaacaaacaaactaatgatagaggagatacactaatttatacgagaattaactaaatactgtcatgtggtttagtgtagctcaagttatgcttgtatcatataacataggttcaagttttttcatcagccatcagaataacagtggttaaagagacatctgaataagtgccaactcttactgcagttgtctcaaaaaaagaaatttaagtaattgcaatatacatttctacaaataaaatattccagtgcttacatcaatcctgagtttttaagattaaatatgcagtacttatggtctccgacacaattttattttggaacacggtgatgtattttttaagttgactttcttcaccactttcttcaccaaaaagagggctttcattatactcttccaagtcctcaatactctaaaacaaaaagtctagttcactgacaaaccatcactttacatctcaggttttaaacagggtaaattagatgtcaaaggaaacagcttttaatattcaaaggatgctggttatttatttcaaatttaaaaactgtaatcaatacatggagctccaaatacttaaattttttaattccagatttcagtgaaatattattatagcaggtccaacagtcatgtagtttgcttgaataaaatggcttgatgaacatgttacagacaagatggaccaaagacagaaaaagactgtcagtcttatatcatggaataccatattttttcaccaggtagtgaccatttgttatcactaatagtccacataacgtggttttcattgaagggataaaatggtctgtgatatgacctaatcaagttggggaaaacataactacgtatgaaacatatactagtccctcaacaaatagttcagcagttcatagtccctaaaatgttgtatgttaatactgaggaagacgtaaaaaatgagtacacaatctcttccgtattcctgtgacatgagcaaatgcacgaataaaaaaaaaagtaatacaaaacttgtgttactgctatggaagagcaactcactcggacatgtagccaaaaatggagactgatgtcgacttagttggcacaagatttcaatcagtcaaaaaaaaaaaaagaaaaaagaaaaagaaagattttaaaagcatttggagggaagggcatgagcaaagcatgggagtaacggtgagttccttcagggaaggctgtcaatctggagagttgggaggaaagacagagggtggcaaaacaagcctaagagggggtcatgtaaaggggagagtctctgaatatctaagaactgagacatgggcaccactgacaggctgggaagagggaagggctaggaagcattttagaaaggggagagtgttaggaagatagtattgcccatcagtgaaggatggctcagaagagaagagataactcagaaaagagcttaataatacaagcaaggaagaatgaggtcttgaactagggcagcctcagtagggatttaaagaaagaaattaaaggaccattacagcggtaaacgtgcctcgcaataactgcatgggaaggataatggactcagaggagtccaagatgataccaaagtttctaccctaaggggtaacatgtagcattaacattgacaggataacttttctagtttaatgttcataccaattaataaatagtttctgaggaacattatagcaacatgttctcttctcgtgacttctatgtaaataactgtttgtgtacagatcatccttaagttgcttgaaaattttattttcaaacgcttttcctagtttatttaacacatctcagttagtgtagaggagtgacatatgagcatgtcttttcacaaggttattaaaaagaatacctcccaaaagaaaattacattgtttcctaaataatatacatctacatgaagaagaggtcattgtccaataacgattagctaatatgctatatgacagcagataattcacaattcacaaagtgttaataatctgctggctttcacattctgttatacatctgaaccatctcttatgattacaaattttcatgtaaaaccattactagtcactaatagttttgaaagggaatatgccataaaacactcctacattccagcaggaaataaaagagatactcagtagtcaacacttgcctacttcctatttaactaaaactgtttaaacaagacaagtaaaaaagacatccagtaaggatttatggacttcctgcattccactaaagatctgtcgctgatctcctaaaaactgaatatgaaatcttcattaatgtattcataaagtatcaattttatacacaagatttatatttccaggtaaaatttccaatttaccttttcctgttttaaataactcccacaaaactattcatgaatcctaaaaatacacttaccaattatgttaaatctggaacaatacaaagtgaaaatggtaagtaatttataatgtataaccaaaaggtctgtccacttggaaccaacccaaatgtccaccaatgatagactggattaagaaaatgtggcatatatacaccatggaataccatgcagccaaaaaaaaggatgagttcatgtcctttgtagggacatggatgaagctggaaaccatcattctcagcaaactatcgcaaggacgaaaaccaaacaccgcatgttctcactcataggtgggaattgaacaatgagatcacatggacacaggaaggggaacatcacactctggggactgttgtggggtcgggggagggatagcattgggagatatacctaatgtaaatgacgagttaacgggtgcagcacactaacatggcacatgtatacaatgtaacaaacctgcactttgtgcatatataccctagaacttaaaggataattaaaaaaaaaaagaaactctcggggccaactgaattttataaaaatgaatttgttgtttggtgaaaaaagtaaaaactataaatcctagaagtcagttaaaggatacctgtaaagctctgtggaacaaatattaataaagtcaaactgatcaaaaaaaaaggtctttccatacattcagaaacaagcagactgtcttctatttttgttcatgagttgtattttataagaacgtattgtgttaccaaatagaacagacctttgtgaattgctcatgtggcggctcaatctctttcagttcctttcccatcttgttgccgtctcttttgttgctcttgaaatattctctagaagcacaaaactaaaaagtgattaaaatcggataaattttaatacttacaaaacataattctgcattagctttaaatggatactctttaaatcaatacttctgaacactattagacaacatttatgaccaattttaaacagttgtgttcaccactcatatgctaaaacaacataatctttctcatcagtcatggagtaaagaatattctttcttatatatattcaacatgtatgtcctaattcttggtttcaaatgaagagtatttgatgacccttcctacaatttgttgaccacagatagttaatttctaatacagatctttcttacctaagaaacattcttttttactaagattttaaacacttggtcatttcagtatgcacatagatgaaccttccaacaatgattgcctttctgcaccttgacctaatctccaacaacagtgttctcctctcctctatgtggcactcactcacacagtcatcccctagattttgtcattcccaatggctgcaacatctcccgtaataataataatagcaatgatagcaacgataaagagcaaccatgggtgagatcgcatcctgaaaattttaaataaacccattacataagaaccctttaatccttcaaacaactctgaggtaggtactcttaccatgtctcctttcatagataaggcaactgaggcacagagataaataatttgcccatatttccaagctagcaatggtcaaactggagttggatcccaagcaatgtggctgcagagtcccagcccctgaccactccactcagctatttctccatcttcccaacatacacagccactacctccctgtcactgtaggtcactcacttcagtactacagctcaggaatctgtagggacccaacacccaatggatggagcacttttcactgcccaatgcccacccccatgtgctccggtaactcagtcccagctgaaattccacagccagtcatcataaccgccccccctccaccaacatatatgccctgcccaactctccctctatcaatgtgctcagctacaccccaacccaggaaattccaaccctaaagttactcttgcacaaatatgccatctgggctgactttaacttcttaatccctatgacactgacctcagttggacccctaatgctgcatggcaattatattcccctagtccatgagtccactaatgggccccgctctctgggttcatgctctcttccttctttgctggatttctgcatgaaccattactacctgagacattgatacaataggttaattgtaaagctaagcctgataccaacaattagttcttctccttcttctctcttcttcatctttctgctcacctgtgatgtattcttcaagggtattcggctccttcttctttcttcttcatctttctgctcacctgtgatgtattcttcaagggcattcagctccttcttctttcttcttcatctttctgctcacctgtgattcaaggacagtcagcaacttcagagaacgtccataactacatttctgcctgtaacacataataagtaacacggtcatatgtcatagagagatgaaaaattaatcctattcaaaccaaaactgacttcacataatttatactataaagtagcaagggagtaatggcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatgtgggttctcataagtaggttcaagaatatcatagccattcatcccgtaagatttcccaaaagaaatacttcacttaactctctctccactttggtacaacaatgattttctaaaaggaatagtgaaaacaatttaactaaaatagataacctatttacgacataaggttgtccctttctacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatacctcaattctgttaaacttaggttataaaacaaagaaacttacctgcttaaggaacaatcaagtaaacatattgttcactacagacaccaatatgtacaagatagtttttgaaattatttgcaccaatgaatacaaagaaatgatagaaatatccttattcaaaaaagccaacaatcatgcatttttagttgtattgttctcaaaatacgtttaattttgttgtttgtttcgttgcaagcttttgcaacgctttcaatcctttttctctttgcagcaagaccctttttaatgtcagctagacagtaaatgaaaatgcattaaaaattaatgttgaaaagtagtttatttgcagatattgaaatcaatatgggacatgatggttcagcaatatcagaaggatatttaaaatgcaaaatggaaagatcgtttcaaaaaagtaagatttaatccttttctgtaaaacctttcaggtattaataatagttttccaattccaattggtataacagcaaatcacttaattgacagatgatgaaaaaaagcaaataattaaaatagtttctattttttaaatgtgcagaaagggtaacaaacacagactttaatttctacatcataaaatgtccaacagttcaaacgacatgtttccatgaaatactgtcacaactcattaagtaaagcacataaaagtaagaccatcaaaagggtagacataacataatacacaataaagtatttttaagcaatctagtgattgatgctattaactgtattttaataaaagaagcaatgtccatgggtataaaaatttaggtttaagtagataaagaaatacacttaaaaacacgtttgaaatattttctgggagctttttatatgacatttttatccacaatgctgtttctgaaaactgtattactgcaaggaatgctttcctaaacatagtttcacatcagagatccaccatcaattgctaagaatagttttctgcagtcataaaagatctgcaccataatacaaatattttttacatacagtatccatctatagtggtcgatgtattaggcagctcacaaaaccagcactttgtcaccaccaagcagagcaaagctttccaaatatactgcttatatgaattattgctatagaagaactgaaaactaaagtaagctttttaaaaataagagtgttgtctccatcgtctctacagaaattttctcaaacttttttgaataaatggtcctataacagtcagtacaactaatatttcacatggcaatataaagtttatgagtttttggatccaattaattacatgtttctcactgggtagaaaagttgtctttacttttctactacacagtttattactggaataataatagaaaataatcattttagagaattcaattttttctcatactttaaagaaaacaaaatcagaaagctgtgacaatagaatagctaaattaggaacatgaaaaactcatattaaaaattctgagtacatatggacaggaagaggggaacaacagacaactgggcctacttaagggtggagggtaggaggggagggtgaggatcgaaaaccacccatcaggtactatgctataacctaggtaacaaaatacaaaataacaaaataacaaaagtatctgtataccaaaccactgtgacacgcaatttatctatataacaaacctgcacatgtaaccccaaacctaaaataaaagctaaaaaaactgatatgtgacttaatgtgtgtacactaaaaggaacgaatagagctgtttctcctccagtgtcctctaatatcccccaaacattaaatttccacgtgtatgaaagaaaagccatccctctcacttgcccattattagaagcattctcacattccacatcaacaataaaaaaggaagtaatacagatttatcaaacagactatgttaaatgctatatatgagaagaaggcatttaagacagtcttgtccactaattcgtacagcctattgtaacagttgtatgattgaaaacaattttcataaactacaaatagctcctaaaacatacctgcaatatcttctagcttctggatatcaaccctgtaaaaaaaaagttacatcagggaaatttatagcactaaatgcacacaggagaaagcaggaaagatctaaaatcaataccctaacctcacaattaaaagaactgcagaaccaaaggcaaacaaatgcaaaaactagcagaagacaagaaataactaagatcagagcagaactgaaggagaaggagacatgaaaaactcttcaaaaagcaatgaatccaggagttggttttttgaaaagattaacaaaatatatatttaggatagttagctcttcttgttgaattgatccctttaccattatgtaatgtccttctttgtctcttttgatctttgttggtttaaagtctgttttatcagagactaggattgcaacacctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagtcgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttggctgtaaagtattttatttctccttcacttatgaagcttagtttggctggatatgcaattctgggttgaaaattcttttctttaagaatgttgaatattggcccccactctcttctggcttgtagggtttctgccgagagatccgctgttagtctgatgggcttccctttgagggtaacccgacctttctttctggctgcctttaacattttttccttcatttcaactttggtgaatctgacaattatgtgtcttggagttgctcttctcgaggagtatctttgtggtgtaaaacagcatggtactggtaccaaaacagagatatagaccaatggaacagaacagagccctcagaaataaggccgcatatctacaactatctgatctttgacaaacctgagaaaaacaagcaatggggaaaggcttccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaagtaccatttgacccagccatcccattactgggtatatacccaaaggactataaatcatgctgttataaagacacatgcacacgtatgtttattgtggcattattcacaatagcaaagacttggaaccaacccaaatgtccaacaatgatagactggattaagaaaatgtggtacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagacgacgagttagtgggtgcagcgcaccagcatggcacatgtatacatatgtaactaacctgcacaatgtgcacatgtaccctaaaacttaaagtataataaaaaaaaaaacaaaatagactgctagccagactattaaacaagaaaagagacaagaatcaaatagacacaataaaaaatgatcaaggggatatcactactgatgccacagaaatacaaactgctatcagagaatactataaacacctccacacaaataaattagaaaatctagaagaaatggataaattcctggacacatacaccctcccaagactaaactaggaagaagtctaatccctgaatagaccaataacaagttctgaatttgaggcagtaattaatagcctacccaccaaaaaaatcccaggatcaggcggattcacatctgaattctaccagaggtacaaagaggagctggtaccattccttctgaaactattccgaacaacagaaaaaaagagactcctccctaactcattttatgagtacagcatcatcctgataccaaaacctggcagagacacaagaaaaaaagaaaatttcaggccaatatccctgattaacattaatgtgaaggaaataagagaggacacaaatggaaaaacattccatgctcatggttacgaagaatcaatattgtgaaaatggccatactgcccaaagtaatttacagattcaatgctatccccatcaagctaccattgactttcttcacggaattagaaaaaactactttgaatttcatatggaaccataaaagagcctgtatagccaagataatcctaagcaaaaagaaaaaagctggaggcatcacgctacctgacttcaaactatattacaaggctacagtaaccaaaacagcatggtactagtaccaaaacagatatatagaccaatagaacagaacagaggcctcagaacaatgccacacatgtacaaccatctgatctttgacaaacctgataaaaacaagcaacggggaaaagattccccatttaataaatggtgttggggaaactggctagccatatgcagaaaactgaaactggatgccttccttacaccttgtacaaaaattaactcaagatgacctaaagacttaaacgtaagacctaaaaccttaaaaaccctagaagaaaacctaggcaataccattcaggacataggcatgggcaaagacttcatgactaaaacaccaaaagcaatggcaacaaaagccataattgaccactgggatctaattaaactaaagagcttctgcacagcaaaataaactatcatcagagtgaacaggtaacctacagaatgggagaaaatttttgcaatctatccatctaacaaaaggctaatatccagaatctacaaggaactgaaacaaatttacatgaaaaatgacaaccccatcaaaaagtgagtgaaggttatgaacagacacttctgaaaagaagaaatttatgcagccaacaaacatatgaaaaaaagcttgtcattgctggtcattagagaaatgcaaatcaaaaccacaatgagataccatttcatgccagttagaatactgatcattaaaaagtcaggaaacaacagatgctggagaggatgtggagaaataggaatgcttttacactgttggtggaagtgtaaattagttcaaccattgtggaagacagtgtggtgattcctcaaggatccagaatcagaataccgtttgacccagcaatcccattactggatatatacccaaaggattataaatcattttactataaagacacatgcacacatatgtttattgcagcactattcacaatagcaaagacttgcaaccaacccaaatgcccatcaatgatagactggataaagaaaatgtggcatatatacatcatggaatactatgcagccattaaaaaggttgagttcatgtcctttgcagggacatggatgaagctggaaaccatcattctcagcaaactaacacaggaagagaaaaccaaacactgcatgttctcactcataagtgggagttgaacaacgagagcacatggacacagggaggggaacataacacactggggcctgtcgggggtggagggctaggggagggatagcattaggagaaatacctaatgtagatgatgggttgatgggtgcagcaaaccaccatgacacatgtatacctatgtaacaaacctgcacgttctgcacatgtatcccatataacttaaagtataataaaaaaagaaaaaagttacatcaaaattttaacataatgctacacaaaatgccatgtttgtttaagaagaagaaatgtcttatgtgaaatggtgaaatgttctgcatagaacagtgattatatgatccaaagctgacttctctgcctcccagattcaagcaattctcatgcctcagcctcctgaatagttgggattacaggcacatgccaccacgcctggctaatatttgtatttttggtgagacagggtttcaccattttcgccaggctggtctcaaactcctgacctcaagtgatttacccacctcggcctcccagaatgctaggattacaggcgtgagccaccatgcttggctccaaagctgatttttcttagaagacgttatctgacaggcaaaactgacttaaacactttaccccttgtcttccgcatcgatttcagcaaaatggtctcttttccgctgcttatcaattgctggagtctttcctgcattaaaataaaaaagacacaccttttttttttttttaagaggaagacgctgttgtggacatttttttgtggagaaatgtactatttgtggacccttttggctctctgcccattaaagctttaaagcagcgctatacatggaatcactgggaccctgaccattttacagaggcatttttgcaagctctttgcggtttaagtcccagtaaacaaggcactacgtgtcagatcccttggacgtcaggaccgcatccatcgagaagagctgctctaagagtatctgtaaccctggtatgagggagaacctcccatgggaaacctaaggctcttgagcctgctttgaaaagcttgggcatcttagcacgtgcaaggtgaactccaaagcaacataggggctgggggcctcgggctgactgtctgctgcctgtgtgccccccgcgcagagagcagacaaaccgtccccttgggcgtgcaccttcttccggctcccctggactgtttttaactccatgctccatttcctggttggccgtaacctgagcctccactgggtgaggccttcgcaggcttctccatgagcttcctgcccacgggctccatggctggttgtcctcggatgttagaggtgactcctgaaccttgtgagtgcaaagatacagtaaggaaacagggtgtgtgaaaggagagctatcgggatggtgggttcaagaagcgtggggctggcccgccccgagtctcctgtgggagcaggagggatcgcggagaatatgtcagcatcccctcctgtcctggcctgtacagcctgtccctggggctggccgcagagctcgcagctgccgcgcacacctgaactccgcggcctctgggggatcctcgcggagccattgagacagagctcggccctgctcctgggtcccccagcgaccccgtgtggccggaagagctgtgggatgacagaggatctccccagctatctcagtgggagtcacccggtgtgcacctgtttcggacaatcaagggtgggcactgctactcgcccgcctggatgcccaggggacctccggtgaccccaagtgtcctgtcctgctgggcagccaggcaggagggacccacaccgactccccaacccctgcacatatgcacaggcccctggggctgctcctgggccctgggaaccacctgggcagctccagctctcagccctggcccaccccggcctgccctcagggccttgccctgattcaggccccagacaacgacactggggccatttcctcacaggtcagcctggggcagcccggtgcttcacacggtcatccccaaagggcctcatgccggctttccccgcctccccaccatgggcacaacacctgagggaccccccacattgctccctcagtggacctgcagacgctggcaccacaaggctcctctgagggcctgggtcctcggttctcttgagagcagccagcctgcctgcccgcactcctcgctgattggtcgactcagtgcacatgtgggtggtgggccgctggggccacgccccctgcaggcatgccctccccctcagggaccacccatggtagctgtggactcagggagagggtggctttctgaggtctctgtccccacgatattccagctcctcatcctggcaaaggaagcaaggacccaggagtggggagtgccaggggaccctgccctaaggaatggaggccaagtgaacggggcctaggaccttgcccccaggctcgttccagccacccctacccctttggatgcaatggccatcaccctgagggtggagcccaggctccctcccatgccctgtgtgcttccaacatgcccaactgcattctttttatcaatggattgtgcttttatgttttatctaacaaaattgaagttgcctttggagggtaaaaatatatatatgtatgtgcacacacacacgtgtgtgtgtgtgtgtgtgtgtgtgtgtgcttaagcaaaggttttccttttatattcatagattacattgcagaggtataatggcatactttttatattcatagatattttatatccttttatattcctttgtatttccttttatattcatagataaattgcagaggtataatggcataaaatgggcatatttaagcctttgggtacttcagttagagaatattcctaaggcaagaattaagatgtattcatgcatcatttctctttataattctgttgtcaagtattatagaaatgtttgtcggtttcatttttatcaccaggaatgattttaaccaaaagctttcaaaaaccctttaattttgacccagcaaaatcaaacatttattcatgtatttatttatataagtttaagggctacgagggcaattttggtacatggatctattgtgtagtggtgaagtctgggcttttagtgttcccatcacctgaataatgtacattgtatcctttaagtaatttctcaacactctcccacccttctgagtttccagtgtctatctttccactctctatgttcctgtgtacacattgctccgttcccttataagtgagaacatgcaatatttgtctgtgttttacttgtttcacttaaaataatggtctatagttccattcgtggtgctgcaaaagacatgatttcattctttttcatagctgaatactattccattttacatataaaccacattttctttatccagttatccgttgttgggcacctgagtgttgattccatatctttgctattgtgagtggtgctgtgataaacatatgagttctggtgtcttcttgatgtaatgatttattttcctttgggtagatacccagtggtgggattggtggattgaatagagtgacatatgctggggagaaacatttagtctatagcagggagtcaacaattttcttagataaaacataaaagcacaatccattgataaaaaggatgcagctgggcgtgttggaagcacacagggcatgggagggagcctgggccccacccacggggtgatggccattgcacccaaaggggcaagggtggctggaacgagcccgggggtgaggtcctagggcccatccacttggccttcattcctcaggacaggattccgagcactccccattcccggctccttgcttcctttgccaggatgaggagctggaatattgtgggaacagaggcctcagagagccacccttgccccctaggtcctcagctaccatgggcatgcctgcagggggcgtggccccacacggccccactacctgcatgcacactgagccgaccaatcagcgaggagcacgggcaggcgggctggctgctcttgcaagaacccgggactcaggccctcagaggagcctcgtggtgtcggcatctacaggtcctatatatatttttttatttaatctttattttatatatatatattttctcaaagtatgtaattttgtggctgaatttaattttatctttgtgcatagaaatctatagacaatcataatgcagggacactttattagcatgacctaacctttgaaatcttgtctaggtgagtcacgaatttagttcattatcagtcagttctctcctagctgggaaacgttcatgcagacacacatggaactcaattagactgggtcagtgtgatatctgcaggggctctagtgatgtgtgaaacacacagggagacggagatctaattttatgatcttcactgtcaataggagagaagaaaaggacttctgaataacatcaccgtcaactgcctcacaaaatctctgaaagcagtgctctaggagttacagtgattgcatcaggagctgcagttttgggggcaattgagaaggaactcctttctctgtataggctgcagagttcctgaaacttctccccaattagaaacatagaaaattattagccttacttaccagtgccatatgacctgggactactcagaggaaagggctgattagttaaagaaaatatgtctagaaagaaaccaaagaacattactcccaaaaggcaccttcaggaatccaactataacatttttgggtagattaatatataatacatatatagtctaatattctaataatatagtaaaacggatgaggtttagaacaaattaggagacacattctgtgtcagatgccaactgcatctgcaattttgggcaaggtaattaactacctggagtttctgctaaattgaggttggcaggggcactgggttgattaatttgatcttgaaagtgccatgaggtcatggactatcttcttatctttattagggagctatttcttacatttataagactcctttactaagttaaaggtgttttccttcctctaccatatacaatttttaaaaactgttcccagctgggcgaggtggcgcacacctgtaatcccagcactttgggaggccaaggtgggtggatcacgggtcaggagttcgagatcagcctggccaatatggtgaaacctgctatctactaaaaatacaaaaattagccaggtgtggtggcgggtgcctgtagttccagctactcgtgaggctgaggcagaagaatagcttgaacccaggaggcagaggttgcagtgagctgagattgcgccactgcactccagcctgggcgacagagagagattctgtctcaaaacaacaacaacaacaaaactgttctcataggccaggcgcagtggcccacgcctgtaatcccagcactttgggaggccaaggagggcggatcacgaggtcaggagattgagaacatcctggctaatacggtgaaaccccgtctctactaaaaatacaaaaaattagccaggcgggctaattagtgtggcgggcgcctgtagtcacagctactcgggaggctgaggcaggagaatggcgtgaacccaggaggcggagcttgcagtgagccgagatcgcgccagtgcactccagcctgggcgacagaggaaactccatctcaaaaaaaaaaaaaaaaaacagcagttctcgtaatttatctctatttctgttttgtatttgaatgaatgacacttaattcatcgagattttttaaagagcattgcagaactctcataagatgaggctggttgtatcatttataaaatatttacagcatctcagagagctctgaataataaatgacttccattcaaataatagacttttaacattttcaaactcggcttttcagtagatatcaacactctcaatctcattccatttgtgagtctactttaaaatacctttaatcaaatgtgtaacttaatagttctattgatagaaatataatttttctctatatgttttgttttgtttttcataataatagtagcaaaagatacaaaccaaaatcaattttctagattaatgttggaatctcctggtttcacttttgagaaaccactcctagtctaaaatgcattattacattgtttgtaatgatatttaaaagctggaggaacataaactccgcaataactgcttcatttttaaatttgacccatcttcggtttgtggaacgtgtctgaaattgcacagctgtttttatttatagtctaactggggaatttcacttgtgaaagatgctgtaacaaaataaatgtccctgtgtccgttgcattctgtggcattctaagccaacaaaatgtcaagaaataccattcaaatcctttcagctacaatgaggctgaattatcattcttttcaagttcttgtttttgagggactgttatagcagaaattcacatgcaaaagaattgctttaatttatgtaccatgctactatttttaacttagaaaaaaaagtcagactcctctttggacctcaatactgacaactttcatcagtaataataggctgtactgttattctgtactacctttattcagcaggaataacaggctgtactgatggatgtactacagtgatgcaaggactccagtaaactggcaggcagtgaagaggtatgcttcaggagtgtcacaaaagtggtgatgactttgcagagaacagagccacccgtttatcggcctgcctctgcttaatgcatgttgctcaaatgcctctatgaaaatactgccccaaatacaaaactatactattggactgcccttcctttataactttgagggatggtcattgccacttgctaattgccaagctctcttacaaagtacatattcaatttatttccctgcctgcaactgtatgatgtatagttgtttccaagaaatgatgactaagaggtactgagagatttttgtcattttttcttcaaaaaaagtcaactggtttcctgctcattctttccatttaagttggccatagaaatcccagtggtgaccctcaggttgtcaaaggcctttcttcttgttgctgtgaggttggcctgctgatagtaacagatacaccccactcacaattatttcaggatcaagtagatccattggccatggagtgatggtcttttcaagtaaggctattttgagaggtaataaaatattcatacacttaatttttcttttgtacttgcttgttttaaaatacagttctgtacataaatatttttgacaagatgagcaatagatctattttttcacattataaaacaaaattattataaagataagtcaaaaatgactaagtagaacattctatttggttattaattttcactggactttcaaaacacttttctgtataacatattcatatattttgaattcagcagtgcagtcagatgtttcatgtaagtggctgggcacagtggctcacacctgtaatcccagccatttgggaggctgagacaggcagatcatttgaggccaggagtttgagaccagcctggccaacatggcgaaaccccatctctcccaaaaacgcagaaaaaattagccaggcatggtggcacacatctgtaatcccagatactcgggtggctgaggcacaagaatcacttgaacccaggaggcagaggttgcagtgagcctcgattacgccgctgcactccagcctgggcaacagagtgagactctgtctcaaataaaataaaatatgtaagtgtaacatgtaagagtaaacataatcttacgtagtgattatctgaattattttttctttacttttattctacatgggtattataaagagttgtgtgttcataataaaggctcccttttctacatagttggtcttcccttcttccctcaacattttaaaaaaattctacagaatttacacaatcaacattcttccttttaagctacattattaatttctccccaaaagaattacagtttttcagcagctgggaaatggaaccaaatgatgtttaattctcccagcagtgaggtgaggaaacatgcacagagcattgctgcccagggagctcccccaaccctggcatccagtatggttttggggcgtgtagtcatggcagactgtctgcatgactgaactcagttgccagcccctccagaggtcaagactgatacaggtggcccaaagcttccactataaatcacattgttagcattaactatctagcataactcaaagctccaggtaaacaaagacattattatcaggcaggatattccaagggcttagaggttatctcctggaaggctgtcaaagagcagatgttctttggaaagtgcagggtttggacaacacagatctgctgagctaacctactactgcactcttattcagctcttattctgaattctctctctctcttcctaaaatgtgcagatccttacggatggatgggaaaatctgggaaacacagcactcactgtaaacacaccatgcctagaatttggctcctcttcaacaacccgggcttttgaactgggtcgaagtcactatgccaggatgacatttttttacgttagaatgaattcccccctggtggctcctcatcctccaggtatacaaggctcctggatgacccatggcctccacggggcacaccacagtctgaatcacagctgattttctggattgcccttggactcagcaggatgattccacatcttccaaattctagatatcctgatatcgcaatattttttatccctgtttcttaatgaaagggtaaatggaggtagaggtgtttctcaacaacctgcaacaacacatgtttctttcaattattcagtacttaattggaaatcaaagcccctttctaatgtatcgataacattgggaattgatgactattgtgtagttgtacttaatctacaccatgctaattcctaacatgggctatggaggcagcagagcggcaggtgacaacatatgcacttctctccctctctgcccaaagctcctggtaactgtcaaatgagcagaggacggggagacaataggaatattttaaaactgtggttttcaggttgggaatatattaatatcatacaacctaattatttccttactttgtctatattgttgtatattacccaagcttcagagctgtcagagcaaacctcaaagatgaggagccagctggcaggtaaaaagcaaaacaaaaacagcccgttgctcaatgactaggatttttagttcaattacatttccttgccatctaaatagccagatgcaatgacccatagatagagccagtgtagaacagatgcagtgacccatagatagagccagtgtagaacctaacataataatgtctaaaggggttagtaattgttctactcaatttgtttcagccattctattggaattcctattaattggaattgatggtaagtatatggaatgtcatgtagtgaaacaaacaaacaatttagagcacaccaagtttcatggacaacaaataacaaatcactttttaaaaatcaataccaaccaggccaggtgtgatgactcacacctgtaatcctaacactttggaggctgaggtgggaggattgcttgaggccaggagttcaagaccaacctggccaacatagtgagacccccatatctaaaaaaaaaaagaagaagaaaaaaatgaataacaacgagtacagtgagatcaaagaacactagctaccatctacccttggtttaatactcttgagaaggctggcatatgtggagtctctccaggaagacatttgaggcagaaaaccagaataggggcaggaaatgtattatttcatcatctgaaatggggactttattaactctcctgagtataaagtcaagaaagaaggtatttttcaggactgtttaattaaatgtcattctgtttatcaaaacagagaaacctggcaggcatttctaaccatatgggatttttggaaatacatgagaaacatgtgattacgtgtttagctgaatattatttaaaatgtatgcaaaatcctgagagggcttttgaactaagttcctaaaatcatcctctgatgcatcctatttgatatgctgctgtgtgcctaaaattattccagtagaaataaagcagagcctcaataaaaccagccccttttaatgagctgcttcttgtaattataattatccataatcatttattttgactgtaagtaatataacaaggcaaaacctataattttctaaagtaatataatcaatataaaaacaaaggtgtttcatactactaacggaagataaatgtatcctgcaagctgaatgttggcagatcagcttgtgctcttctaaatcatctaaatatcatcagtgcctttgattacagcctcgtgcccagtgctttaaaaatcaaagtttgcttttaagaaatgtaatttaaaaactgctgatcatctaaatcttgggaggtcaagggcactcttatttcctttatacttacaagtttaatttgatgttttccaaaatagacttgggtataaatttcacatcaatatgctaagcagagccccatgcagaatatttctgagtgggatttattgaatataaggttatttttatgactgggacattacagttgcaatcatcaatgaataaaaaataaatttaaacaactgtctctagcatcaagttgaaactcaagtctcaatagagcaagtttcaggaagaggtgggatttcaggtaacatggagaacagcagctcagatccttttcttaaaggacgattcccccttgacatgaagccagcaactcactctgcatgcagaacatgcaacacatttccatgccggggagagaagcatgtgacgtcattcattcactcattcagtcattagtcattcccttattcgtctatctaatagctgtcaatactcctagtatgtgttgggcattgtactacatgctaaatatatagaatctcttttctaaactcaaaaagttataagtagatggtagtagtggtcagggtaaaatacatttgtgaaaggaagaaattacagtgacaagtcctataatagatggcaagtgatgtaggatccataaggaagaaggacaaattatttatagtatagatagggaagactttacaacaggagaaattatctgagattagtttggaaggataagaacaaaaaggtactccagtagaaaattgggacaaaaagtagaaaaatggggcactttagtctgggagtcataaaaggtggggtatacttggaaagaataaactttttgtagaactataagagatttcagggtctgtgtgagttatagtttcaggagattaagttgaagatatttgggtacaatatattgaggtatatcataagccaagagagaatataggttttatttttgcaggtcagttgttctcaactgggggcaactttgtgccccctccctgggatatttggcaaggtctatattttgctgttacaactggagaagggggcaggctactggcatctggtaggtggagaccagggatccactaagcatcctacactgtacaggacagtccccacggcaaagactctgccccaaatgttgacagtgctagggtgagcaaccttgctctagataatggagagtaactgaaagattttacatatgggaaagaagtaaagaggtactttctaggaaggtgatgcaacacctcctaggaggtttgccacatcacggtggtcatcaaaacactgggtgtcaataagagaaaaaatattcgcctgcagggagaaagatcaactaacttcttgagcatctactctgtgctggacattcaacgtattataccaatctccccatgatattggcaactgctactttctgcagcaatggggactaccagatgaaacaggatgagactagaggctgggagaccattatagatcaatgttcactctcacatggaaacagtggaggtctggactgtagcagtgtccatggagatggagatgtgagagcaaagaggaaggtcaaatcaaaaggagttttttaccaattaaatgtgagaagggtttaaccaccaaatggaaggtttacagaacgactttgaggtggctggttcagaagactaagtaggtagctggagagactgcaaaaggaagtctcagaggacaggtacagggctacccatacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaacaatatttgcctgcagggagaaagatcaactaatttattgagcatctactctgtgctggacagtcattatgttatcgtctcagtctccccatgatattggcaaggagactgaatgcagacaggcccagggaggtgctcaaagtcaggcagccagtcagaggcagagccaagcttggaatagtgtctcaccaaaaccaatccccatccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatagtttcagttctcaattgtaaaaagattcagagtcagaccagaggatgcttctgccataaattgctatccaaatgatatcaagtcatgcacacacacacagagtttatatcagagttagaatgtgtacactgcattagacactgagcatcatcagggtcttgctggagggcaaggagcaaaaaacagaccataattggtagaaaagtacttagagtttgaggaagtagagccaggaagaacagaaggaaggtagggtggttgctaaagggaagatattttacagatgaagattcagacttgagcgtagatgtaggctgaaggacttgagtggaaacaccaaagtttgagtatgtaggagtgagggtctaaatgagagaatgaaggagtttggccttggtgtggagaagggtccactgtttgtttaaaatagtggtcttcaatcttgttgggccagtagactctcttgagaaccttgtgaaagttttagatgtcgccccagaaaaacatctgtaaacatttacaaaactgggtatgatcttagggagttcttgctaaaatctcctaagcataaaatttaacaggctctccttgagagtgaagaggtgctattaatgttattacagaggacaacagcctccatctaagcttcaagcaatcccagattggtgaattggaagtggctggagaatgtgatgaactggatttcctctgtgccggcattgattattgtggcgtgactgaatcacagtaagagttcccctgaaaagagcagtttgagtttgttagaaaaatggcactctggaaattgatttctttcaaacaattcaaccctgtgaaatccttgcaatatccttgtgtaaagccagggttatgtggatgacctctgaaagccattgatgtggaaattcctaatttagaaaagttatcagaaatgtttctggaaatgtttacacctagaagagcaatttggtatatcccgggggaagtatccagagcgaggaaatcaacaggagcccaaagttttgcattctatttattgagtaaaaatatattgattgctagccacatgacaagacctgttccaagtgctttatgaatgaattcattaaatcttcatcacaagcctactaggtaggtacagttattatcctccatttcacagagagggtaatggaggcacagtgagatagcagggttgatcttggtttgggtcagggagtagatttggaacaaggctgtctgtttccagagtctgacctcccacttttactctatattgagaaagtttacatattataatatgttcacacatttactcagtcagttcttttttttttttttttttttttttttttttgagacggagtcttgctctgtcacccaggctggagtgcagtggaacaatcttggctcactgcaacctctgcttcctgtgattctcctgcctcagtctcctgagtagctgggattaaaggcgcccacaatcacacccagcaaatttttgtatttttcatagagatgggatttcaccaggttggccaggctagtctcgaactcctgacctcaaataacctgcccgcctgggcctcccaaagtgctgggattacaggtgtgaaccaccatgcccacccaattcttataagctttcaaatatcatatttgtttaaacacctgtattctttagtgttgtaaaggtaactatccatcctctgacagggactgtagatgagaggaaatgcatccaggaatctaatttatcacaccagggtcctatggatagatttagggttatgggaacagtacctcatcaccggttatagattttgagagccttcaatgagccacctctgaagcctttttaaagatggctggacatgcttaggcagaaggtctctgatttgtgtgctaaagctccttcaaatgaagaagtttcaagtgaacagaaattctcaggtgttaaatgctgctacaactccggaaagactgccaactcctgccaggtgaccagaaactcagtcaacttctctgctaactgacctccaagcaactttacccataatagctaagaataccagccaatacttgctgagtatttcctgtggaccaggctacacacacacacacacacacacacacacacacacacacacacacacacacacacacacagatccagatgctcagtttgcacacagtggtacagtagtggagggtcataaaaataagcatgcaagttgaaaccacctgatatggttgggttatattccccacccactctcatcttgtattgtagttcccataatccccatgtgtggtgggagggacccagtgggaattaattgaattatgggggcagttacctccaagctggtattctcgtgatagtgagttctcacaagatctgttggtcttataaggggcttttcccccacttcactctgcacttctcctcgctgatgccatgtgaagaaggtagtgtttgcttccccttctgccatgattgtaagtttcctgaggcctccccagccatgtggaactgtgagtcaattgaacttctttcttttataaatcaccgagtccgggtatgttcttatggcagaataagaatggagtaatacagaggacctgctttgacattggatagtcctgtgagcaagttctgaatttatcatctcacagctcctgcccatgtacaagttacttactctgtcctaatctcagtctccttatctgtaaaatggaaagaataataatattggcttcatagaattgctgtgaggatgtaataggattttggatactaagcacttagcttatagtacttactcaataaacactatttattactactgtgtgctgtatcacagggaagttgtggtggtcagatgagatcattggcattcagatatttagaaaagttaaacacttcagaactttcttctgaaggactttgttgctgagttttcagccccattcagtgaatgtaactaactctcatattagtgcgtttctgcaaaaatgatgaggtcttttgttattactttcattgaggaataacatatatagtaatgtacataaatatgaatgtgcacaaatacagctcgataggtttttaatatgtgaatggcatgttactaccaaccagatcaagatgtagaacatgctcagcaccccggaagagtccctcataccctctttcaggtaatatttattcctcaaaggtaacccttactcttccttctgtcacctaaacaaatctttccttggacaatatttctattattatctctagaattaattgtaatatggaaaatactgttttataagcctcattctctgaatctgatcactttaaaattaggaggtatgcacttcattgctcagacccaacccaagagttccatctgacttcctggctttggacagtgctgacaagtcctcagggcatgccccatgctgggctattcacttggaaggagacaaatgcctaggaggcctggtttcaccctcagagagctagtctaactagagaaagaagccttaaaatggaataccatccctaacagcaaatgaatccataaaaatcatgtctcagggagcaatctcatgttttcttgttttcgaccgtcctgaagacactgtttggtattggtctttcccaagaggatgcccagattaaccacctcccacacagttgggtcctttgctttggggtcactaggatgtggaaagcttgctgccttgccatctgctattgtgtcacaggtgtctgtgaggtctctcatgtaggacatggtttcctcttgacacattagtgaggacttccacaaaagagggcaaagggaggccaatccctatgtgcttattccaagatgtattctatcaggacatgttaccccagttgttcctgcaggtcactgttgtctgtaagacagtgcacacactgggagcagttagcaagcatgcactcatcaccatatgcaccatgaaaacacttctgtgcagtattggtagttgtggagcttgcatttctttaaaagacagaatggcatttaaccacacttattgccatccaaggagctggtggaacataaactgttctgtatggttgcaagcacataagcctcttgagcaagttttctatgctttatgagaacaaaagatgagacattttattcttcaaaaatgggggactccaagacaaaccacagattaatcacaaaggagaagaggaataagcagttgcattgtgcatctctggtcattttgctgaggattttaaaagagaaaatggtgtgctaaagcaatgcttcatttcacattattgcacgtcatccatcattttgtatagttacctattcgtaacattcaccgctatctaattaagtgaaaaaattttgttgtaagtaattaagtgttttttaataggccagcattctcaaagatcatactttgcctgtaaggagacttcaagatgttgtctggagttttggagtttaaagtatatattatccttgtgagattatgtaaactctcatatttgtgggaatacaaatgagcaaaactattttgaaaagcttgattttaccaaataaagtctgagattgcatatacacagatccagcaatgcaacttttacatatacaccctggagtggtggttccagactttaatgtgaaccagactttaatgtgcaccataatcccctgaagggtgtgttcaaacacacattgctgggtgacaccccagagttccagatttagcatatctggagtgggaccatagagagtttgtacctctagcaggttcccaggcgatactgatgctgctggtcccagaactacattttaagaaccaccgtctcagggagacttgtgtacatacacgctcataagaagacatgagcaaaatctttcaaaaacattgttcctaataaccccaagctagaaacaactcaaataccatcaacagttcaatgaggaaatgaactgtggtatattcataccaaaaacccctactatatagcaatcaaaaggaatgatctacagctacctgcttcaacaggatgaatctcatgaagtgttggtgaacaaaataaacaaggcaagaaacagtatccataatgtgattccatctgtatgcatcccaaaacaggaaaaacaaaatcatattctttacaaatgcatgaacagatggtaaaactatgaataaaatctgataattgatcattgcaaaagtcagactagtaattatctggggctaggaggagggaagcatacaggtagtttctcaggtactagcaatagtctacgtcttaacttggcttaacttggctattagatatgttggagttggacttacgattattacttagacagaacatttgtatttatacacatctacatagaatacataagttttaagtatttaagaatcattttatcttttaaaaataatgtcctctatctggtatgtattctgacttttggcaacttgtttgaattttaggatctgcccattggttatgaaaaatcaaatcttttaagctttaatagatggtttagttattctgctgggtcaactattgaaatgaaagaatttttgttactgccaaatacatttgagatatgaactagctatgaacaaagtgttacagagtaaaagacctgtaaggcctaattggagaacagattagaatcttgtacagttagcatgtttatggtctgtgtaataagtcatgacaggccctagtagatcatcttttagatgttgttcatatctatgaacacatacataatgggagagattgacggctgttgccatcaattacattacattaaaactgatttacataatttccccaatacaaattgcgtgactacaagagtgaagattcttatgaactattttcttttggtggcaggagagtcatttttgaaatctttgaaaagaaggaaggattgaatgtgcctgttgattatattgtgatgttctttttccttccaaaaatgaggagtgggggacatctgtaactctgtgaggataccaggaatgctcatttctgtttcataatgcttactctgttttatcctgatattatagtcttgcttttaaatgtattgggctgaatctctttctttacatttttagtgtgtcctgtacaaacaattcttaatcatttttttcaccatatgtttccttgtggcatggtctgcatgtcccctatttgatcacagtgtggattctgaatttgcacctcccacatgctaagttgacagctgcataacctcaaaacgcattctggcaatgatgaatgccaatattttatgatgacagcccaagaatttgattgcagctgcccactgatataagtggtatctttattatttggtgagttaagcagacacattaagtacatttgttgcaaatactagactgtaaaagaatgtatttctgacttattatagtaaacagtaagaaacaaccaaaatgttcatcaatggaggaatggttaactaaattgcagtatagctataccatggaactccccacaaagaaagtagcctgaactgtgttagactccctatgaagagctttatatgtgttgtttcatttaattctcacaacaaccttgtgatattcccattttataaatgaggacacaaagacttgtccaaagtcacatagtaaattgtgcagcaatagttagacctaagttctatggacctccaaatccattttcttatccagttatactctcctagctcgtaaatgtcaaagctatacatgctgttgattctcttctcatggagattaggttcaagatgaacattaagttatgtaaccacagagaagaggaagagacttagataatagtaaaattaaacctatctaaatgtcaaagctaaattacttccaaatgaggtaagtttcctatcattccatgactgaaaggaaattcaagaatatacaccaaaattctggtaatatgtggtatccaagtcaggattttcatgtattctcagagctgttactctgcttaaaatgtcaaattataagtgaagtaagagaaaagccatgcttttgctcaaatgtaattatcgatactgtaaaatatcacttatatgtttatctttataacttctccttttaatatttacagatggacaaaagagaaagaaatctttaagaaagaaactggattcactaggaaaggagaaaaacaaagacaaaggtaaagggtaaagtacccaatgtaaatgcatcttccatggagcataatggttaaatttggtggggttattgaattgcatagatatacgtggttcaactctgttatgaaaactggatttctacagtggaatgtcattaagggctgttttggtctactcttctgtgtttgagcagccctgtactgaactgatgaattcagctggtttgaggagagtgtgacctcggccaagtttgtggttccaattattattttgaccaatcagctatacataaagaggacctgggttgagaagctatggagagcatctctaatgctaaccagctgtctggcaaatccagacaggcagggttagtttaatgagagtttgaattcacctaccaccactactggaaagaaacagtctcatcctcatgggttactgaagataggccattctcagcattttttttttcacccagttgaaaaatatttatttgcaactaacctgaatgcttacattttactttgttacattgcctcagccaagataggttaaagcaaatgcccttaatattttgggggtcacagagccctttaagaatcattgacaatgatgatgctctatcaaaggcctgaaactcacccaatgcccaccctaccaccccctaaattaagaattcccagattagatattcacttgagttaacaagtattttcctttttaaagatccaggaactttagggaatagtcagtggctattagtttttttgttttgttttgttttgttttgttttgttttgttttgttttttgagacagagtctcgctctgtcacccaggctggagtgcagtggcacgatcttggctcactgcaacgtccaccttccaggttcatgccattctcctgcctcagcctcccgagtagctgggactacaggcgcccaccaccacaaccggcttttttttttttttttttttttttttttgtatttttagtagagacagggtttcaccacgttagccaggatggtctcaatctcctgaccttgtgttccacccgcctcagcctcccaaagtgctgggattacaggcatgatccatcgcgcccggcctagtatttttttttaactcttgttttaggttcaagggtacatgtgcatgtttcttatataggtaaattgtgtgttgcaagagtttgttgtacagattatttcatcacccaggtaagcaccatagtacccaataagtggtttttcaattctcactttcctcccaccctccaccctcaagtaggctccagtgtgtcttgttcccttctttgtgtccatatgaacatgtttagctcccacttgtaagtgaattctcagcatttttatgttagatcacagtatactcatcttttgcttcatatgttttgggaattgtttactctcatcttactgttttgtgtccccttgtgcatatatttaggaaactaaaactttagccactctctgaggtatttatggtcatttaaaactgatattcaagctcacataatggacacctgagccccattgacgcagtccaattttttgtgccttttttttttttcaagacagggtcttgccctgtcgcccaggctggagtgcagtggtgcaatctcggctcactgcaacctctgcctcccaggttcaagcaattctcttgcctcagcctcccaagtagctgggattacaggcacgcaccaccatgctcagctaatttttgtattcttagtagagacgggctttcaccatgttggccaggctggtcttgaactcttgacctcgtgctcctcccgcctcagcctcccaaagtgctgggattacaagcatgagccaccgcactttttgctgcttatttttatagtctgttatgaagtggttgctgaatggtatggttgtatgcatttattttcactttatgtgacacagtcaacgagtcttgaatgagaacagccatacacatctcatcttggagtccttttatataatgatagaatttctgctttaaaagtaatggaaggcgatgaaaccaagggtattaaaacatgcattgggatcagtattggacaagagctattccataccattgatctcagtctctacacctatatcttgaacagtcatgacatttggttctttagactaaaaaaaggtgaagaattctaaagaatggaaaaccattgttttacttcctttggagtgaggttactcaaccttgctactgttgtcattttagactggataattatctggggtaggggctgtcctgtgtattgtgagatgtttagcagcatccctggcctctactcattagatgccagtgacaccaccctcaacccaaatatcttcagacatttcaaatgtttatctcaaattggaaaaaagaaggtgaaagtgtcagtgatccgcacccctgactacacaatagaatcacttgtggaacctttaagaagtccaagacccacaccccagggagtctgagttcgtgttcttcagggatacctcaggcatgggtgtttttaagagcgtctaaagtgcaacttctagataagaattttgatccatattaactaggatactcaccaggccacattctgtcacagcagaatctgctgctggaataatgagggctaagggttgtccagctagctattatagtctgataaattgtgttatatttaattgttgatatgtttgtgcccttatttttgtaatgacctaaatattaatagccagcattgctcttttaaactagagtttttgctcattctattcctgcagtagagcacttttatgtctccagattagagcaattttccatatgtatagagcatattaaagggatcactcaggttggtattagtaatgtattctcttttaaacttggtttattctaggatgatgatattgatattgggattcaaatacatctaatgtggactttaggtgatttttcagaaagtgtccatttggctagactaagcagaatgagcatttttgcaggaggttccctcaacagaatgatgagatgttccctcaacagaaggagatgtatgtttgcttgcatgtattatatatacaaagcagcaggaagcaagaatttgaattaacatggaaggaagggctagggaagtaatcgaacaatacatactgggccattatagattttttaaactaaatcatatttacataggctcagtgaaaactctgaaatgttctatagtgcctcgaaggtagctaagtgggaaaaggaaggcagatcctggtggttccaaagaaaagacatatcacccacccaactaaggggagaaatatcaggcttcatggcaaaacaaaacaaaaaaattttaagtagctttaatgtttaaaaacaaactaacctaggcttaagtgaaggttaattacatggcatcttttcagaacataaagccctgtccatgtcaacactgagagtcattacatggatatcctgggaaccagggtgtgaggaggacggggtgccggtctggcacagatgtaatctattcacattatttccttccagttgcgtattagcatttggatttgtaacagctgcacatgtgaaaaacgatcatttgaatccaagagtaaaagaaggaaaacaggaaactctaaatgatctcttgagttaggtcatctaaaaataaatagaagcagccttttagaatcgaattgctctcccaatagtgattcataaatggttgatatgctaccatattaattgatttcatcagaatgaatcatatcctgtatgttatttaattgccttgatatacagcagatcttgtgacactcctatgttcctcatgccacttaggcagtgcccatgtgacttttgatttacatatgggaactaattcaagattgacactgatcagaaaacatattttcatacagaataattccaagtccttaatttctcttagttatatttcttggcaaccaaaagtgtttttaaaactttcagaacttcagaaaatttctgtgtcaaaagtaattttaaaattaagtaattttaaaaatagctactttgttttattaatgtgcttcctaaactgagcacatggggaataggttttactatgatgtaactctgggagattgtaccccccacaacccctgccaggacattttcagattatgccatatatgtatctacatacaatctggaaagagttcaattctggcactgttctttttggtgaaagcatattgtatcatgttttcttttcctcactgtctaggtatgtaactgtatgtgagctgtgaagtaacactatatacaaatagctcatacaacttttaattttgctccacattaaatagcagaataatcaagttatcagttatcactatgtagaaattctcaaagaacatatattgaatgttgtcattgagtgctagtacttctaggataagaagagaagaaagaaccagggagtgtgtggtttctgagaaggttaggaaggggccagctcacacagtactgggccacagcatgacttctgatttggaagttcaggagaaagataatggtaccttaggctagggtgggagtgatcgtggaagtggagagaagtaaatggaaaaaagagataatgtgaaagtgacatgataaagatttgatgacggagtgaaaatgagatgtaagaaggaatgaagtatcaaggatgactctcagatttctggttctcccacatgaagaacaggcaaacttttggaaatctgagtaagacctgataagggaagatgaagaataagaaatgcctttgggacatccagatatgaaggtggaagaagtggttggtgctcaaggaaggggtctgagctagaggtagcaatgaggtgtgaaatatctatggatggaagtttaagttacgggcatcgtgctgtcacttacagagagagaccagagtgatgaggatggttaagattgagctctgaggaccttccacattgaaaacccaggtagaagatgataagccagaaaaaggggcaagaatgtagccagagaggtagagaaaaacccagttagtatatccaggatgcaaaggacagggagcatttcaggaaatggcgatcagggttaaaggctgacagaagggcaaatgaaacagagctgtcaaaaacactgaatttaatgaccctgaagacagcaatgatttagagggagctgctttagaatctaatggaggtaccagctagacgggatgaagtgaggaaagagtggtaggtgagaaagttataagctagaaagtaaagggaacactttagacaattttaactgtggcaaaaggagagggggtaaaccatggagaaaagaaaagagtgggtcgaaggttgtttatttttttaagaaatagctgcttgaataaatttagtacaaaatatctagtagaaaaaaagaggttgaagatacaggcacaagaagatgtaatttatagcaggggtggcccaccagccgtctttgtaaataaagctttactagaacacagccatgcctattcatttacttactgtctgtggctgctttcctgctaaactggcaggtcgagtagctgctacaaagactgcaacctgccaacagtgcggaggctggagtgagacaaattgagcccctaggctacagaattgaaagaaatgccaagtctgcatgctgactctgcacttgccccacgctgaatgcgagcaccttatcattttgcatcctagccattctaagccccagccgtatccacaaagcctaaaatatttactatctggccctttacagaaaattgctgaacgctatttatacctaagagtattaggataatttttttgagctcttgagtgcagtacaccattatccatggtttaaagttatccatagttgaatggcaggtgggaaagcatgggaaccagggagaggcagaaaggctggcaggatgccaagtcacacctacatctcatgcaaaggagggtggtggagggcacaggtacagcaggtgtgaagagttggagcctttgcacctgctggttgctcttctcctgaaacaggaggcagaattatttgctggtggggaagatctgccccagaggtataagaagtctctaaacgagtctggttggttttccttagatggaaaaaaatgactgggaaagggctcagtagtccctatcttatagtaaatccctgccatgcatatgcccacctgagcagacatgtcacttgctacatttatcaatgttcttttcactcttattatcccctctgtttctgttatttcatgtagctgtcagccttaccatccacatgtttccagactcttccaaccttttaaaagtaatatttgatcatttctacagacaagattatatgtatgtgtgtgtgtgtatgtatgtgtatatatagagatatatctatatagatatatgtatatatatatatatatatatctcctcagggtacataacaggaggtctggtactatcccctttggtttctaattttgctagtagtagacacagcctattatcaatagtgagaattacacctcactacactgtctaaattgatcactcaaaggagaagtacctaattattttttattaccatatatcacctagcttgttgctaaagaatggcaagcatcctctgaaaatcccgaaatactaaagttttgacttttttacttcaaaacaaattgcatgctttgatagaaccagaggtgcaggcttttcaagtagcatttctgcttttaatgtagacttggtcattagcccagtgatgtttgaaatattgccatggatcaaggaggaaaaccttttaaagtctctttctacctgatttaatgttagctttttctttcaaagaacaaccaaccttagaattattttcccttgatcattttagtttcattcatagggcttataaaaacaatggagaggttagattccaacttactgctgctaggagacctaatttggagtctaaaaagaataatacatttgattacattatttagtgcctttcagcatgaatctaaaatattgccaataaaactcctggccctaaggatccaaggtacatgtatacaaacagatttacgacagaaattcagaaaggaactctatgtatgtctccaaataaagccattgatttctgcactatgcccctttccccaaattctccttactaaaggatttaacaaattgtttcctgggcctcccaccagatatttagtggctgagtccactctgcatgtggccagtagaatggcttgagtgtagatcacgagagtgacagccccaacatagctggctggaaatagaatgtagggatgaggaacacaacgaaaacagagtggacttcttcccaaccagttcccaagctgctcctctgcctgtcaggttatcatttcacatgctaactcttactgggaacctcaaagtgtattcagttaactaaatttcagccttagtttcatgcatctctctaacacctgatactcactctgttatcatgatttgcatttctgattatccactccttcaccccaacccacactctgaacacctcaggagaaaggactgtaccttttataagctttgcgcctcccattgcctagcttgttgtggcatgtagtaggcattcaataaatgcctgttgaatgaatggatagacttgaaacatggagaaaaactagagacctaaatgtctaagatgtgtgtttataaatactagttttctttattgaaatggaaacttgggccattctgattaacacaaatgtcacctttttgattgatgagtcaattcttcagaaaacattcctttgaatatgtctgttcttacttaggtctgaaacataaatgagagtgttcactggaccagtcagtctctgaaagtgaatgtctgttttttgattccagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggagggtgaggtggccagtatttgctctgacaccagtgctaggaaaactgaagatgtacagttattctttgcgtttttgttcatgtgaaaactggatatgtagttggtgttcaggtatctgtcaacaatgccattaatgaagaatgtgcactgggcacgtggcaccttgcatagcctcagaccttgtcctgactcctcttgaagctgttgggtgtccctcctttgtcacatctttgctccatgctctcctaaacattcggcaatatcaccattaattctggtctcttgtaatctgtcagtcttgccatacttgcccactagactgtgaggctcgagggcagggcctggtgttttagctattaatactttcttcatcaccagtctgagaacatgcctggccaaatgaattggcggtgggtcttcataaacaatgagctttttctttatcaatggagcatttctttttctcaaacagaaccatagaatcctctatatatcctctttcaaatactctaactatatggtaccaattgttaagtactatgttctaggtactgtgctattatttgaattgttcatgcaaactggttggtgattggctgagtcagttgataagcatctctaaagcttccaggtcactggaagatcttctctcccttttgtaaaacaaatctgcattttatttttatcttttattttttgactcagggtcttgctctgttgcccaggctggagtgcagtggcatgatcactgctcactgcagcttcaatctcccgggctcaagtgatcctcctgcctcaacctccccggtagctgggactacagatgcgcaccaccacgcctagctgttattattattatttttagtagagatgtggtctcattgtgttgcccagactggtcttgaaccttcgaattcaagtgatccaaagtgctgggatcacaggcgtgagccgccacgcctgaccctctctccctttttcctctgtcacgtggagacctgaaatttttgccacctccagctgttgaagactgccctagttaaaaccccagacacttcccacttaaaaccaacatttttcaatcagcccctaacatttagggcttgtccaaggtagagggggacctgatccattgctgtttttgcagtattgactatgtttaaaaatgaagaaattacaaaattatggaattcctgaagttgcatgatggaattgttcttctaattctgtcattgtgtctcagactgtgtattgtcgtacaacaataacactaaaactctaaattttagctttctgggaatgtaggactcaggcaatggttttcccaaatgccctctcgtctgtccaggcctggctagccaactgctttctcagtgcttcatcaagtatgggtgcggcaaatgcgactggtgccctgctccctttccctgaccctttaccattcctagcatgccagctcatcttccatctgccaacaccttatttatttgctgagggctttctctgatgccagaggcacccagcctatccaaatggcaggctgtaagtacttaggagataatattatctctctgcccccaccagaggctacccttaagcagtgattcctgaggcctggtgtataaataccccagctctctcacttgatagggatagctctaaggtgcatgatctacagctgtctcctagagctccccagaaagattgagctccagttgcccacaatgataataggcttgataatgctcccttcatcagctgcctttccttccttgtctcatttcccccctcccctacaggtgtttcccaggaccacttctctaataaagcactttgtgttgtttctcgggaaaactaagctaaggctgttttgtggaatcattctattttaaaaatatacttcctagagccatagttgagttttttatttacaagacttctctgactacctcattgattgagtatgtaatttttttcttgtttcaagaaatgaagtggttgggccaaaatactttaattatatgtttcccatcgcttgttcttccatttggaaaatgttgtctattgttgaaattgtaactgccattagcttgaggaaatcttgtagaggttttctaactttttcaaaaggcatcttttttcttttaatttacaaacagaacaattaaagaaatcaagcagtagtatttcaagtgtgataaagagtcatgagcaaaagtatgtattggttagcatctgggggcagctgggttttttggctatctgtactttatgttcacggctctgtgtcacttgcagggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggtaagtagacttgtctgtctaaagtactaaggactttcatttattcaagcatcattcactgaagtacccaatgtcaattctgcttgatcaaatgatcaagctctgaactgaaatttactgtgtgaaagtgtacagatgtgagtgtttgcttaagagattgtggggctaaacaagattggagaagagggtgaatcaacttgatgatattcagactgcttagctcccagtagtcctcagaagttaccttggaggccaagcagtttagggaatgatcagatctgttgggctgggtttgtcaccaggacctctttcaaacagaccagagccacttttattgtttatacataaaagtagcctaggaggttactcacaaagtttcctttaaaaagtaagagtccaacttaaaaaaaaaattggggaatcattgcttaagtgaatagaaaatacatcatttttgacaacaggtttacatattgctatttgcatttttgtggaagctgtccacttaaaatttctccaagccaccctttgcaactcaattctagttactaagttgacttaagaatgatatacagttcttcaaaaatgtttctgaaatttagacttctggcttattaactgccattttcataaactaagtttgtatgctatagtgtttgttagcacgtgttttatatacatgggaaaagcttaattactttttttaactgtaaaaataatatgctcattgtaataaaaaagtaaacgtgaaagcaaagaaaattctgaggctaccatatagatataactactgttaacattctcatctatttccttctaataaaaatggaactttattttaaaatcattaaggatatatttaaatttcttaattcattacaatggaaatcataggataacatatggatgacctaataaaactaatgtagcaaaatcttatttgtttatacaaaattttaagtgtaggttcttttaatttttttcaccttatctttcacttgcctgtgtatcacctatgtatcttgaatatacatctctttctctatacacacacatacacacacacacacacacacacacacacacacacacagtcatgcaccacataatgacattcccctcattgactgactgcataggcaatggtgattgcataaggttataatactgtatttttactgtacctttactatatttagatacacaaatacttaagattttgttacagttacctacagtattcagcacagtcgcatgctgtacaggtttgtaatgtaggagcactaggctctaccatatggcctaggtgtatagtaggctataccatctagggtggtgtatgtacactctatggtgtttgcacaataatgaaattgcctaatttattgcttctatcactttggaagcttgaaaaccggataatcacactatttagaataaaatacaggattatatttcttcatctgcaaaatgaacgtaagtacccacctcaaaagttgtgcaatgattcaattaattaatgtgcatacagtacttagaatagtacctggcatatattattatatagagagaaatagactctgagtgaactgaatgaatcttctatgtacgaaatagaaaacttcaatagtaggtcacagtaattttaattttggctgcatttatttttttattttcacatggtttctgaataattaaaatttctacagaagcaagatatcacataaggacattttctacacaggtgggactattctctttctaccaagagatagaaaacacaactaaaacaaattgagatgtttactttgtttctggatgtaaagaaataatgttataaagatttaaggctgggcaccgtggctcacgcctgtcatcccaacactttgggaggccaaggcaagaagatcccttgagcctgggagtttgagaccagccagggcaatatagcaagaccccaattctatatttaaaaaaatacaattctttctgatttaattatatattgtactagtcataaatttttcagtggcaagagaaaggaactcagaaaaaactagattaagcaaagtgacctcccccaaataacaacaacaatctttatatactgggagcgtgatctagatttaggcacggctggatccaggattcaaacgatgtcatgagtgtcctctgtttgctggctttattctcagacagttctcttcatgtggcttcaaatggcggttagcagctccaatatcccatcactctcataactgattgtctcaaatgaagagaaaatgagccaccaatgaaagaattaatatacatgatgctcatcaatggcaatgatcaatgactggcatagaaaaaggagagccattcagacgtttcatgctcccaaaggaagtacacaatactttttgtgaagtattcttgccctataaaatcacaccgcaatcagagtaatgtctggctctagctatctctttacagaaaataaaagagggagaagaacatacaaatgacactatggagtgtccaaatccaaacaatatgaagatctacagtaggaaatcactgagatttcttcaccaaaacaattataaggaaaaaggagacagagggaggaaacacagattaagagactaaaaggcacatcgaccatatgacagtgtgtgacctttatgtggatgttgactggaaatttaatgctattaaggaactattgttgaaatttctaatatgtgatagtgaaattacttgtgtttttaagagacctaattttttagaaatgagtttctcaacctcagcactgacactatattttcacatctaggacatgatcctaggaaaagcaatcagaaatgtgaacaaaaacgtgtgcacagaattgttcacaatagggtcatttatagtagaaaaataagcatgtatattttggggacctgtgcaccattcagaggggaatatggagtaaattatggcccattcatacaatagaatattttgcatcttttttatatctccatagattttgggggaacaggtggtatttggttacatgagtaagttctttagtggtggtttgtgagattttggtgcacccatcacccgagcagtatacactacacccaatttgtagtcttttgtcccttttaagtgacatttataaggaattgttactagcatgagtgaaaattcatgcgacacgatagtgagggaaggcagtaacattctctctgtcaatagatattatatatatgcagtgtgatctcaactatgtaaaaatacctacattcatgtagaaaaggctggattttaaaaaatgaaagattagctaggcacagtggctcacacctgtaatctcagcaattttggaggttgaggcaggtggatcgcttgagcctgggaacatggcaaaaccctgtctctccagaaaatacaaaaattagtcaggcatggaggcatgtgctggcagtaccagctaccctggacgctaaggtgggagaatcactgcagcccagaaggtcaagactgcagtgagccgtaatcacgtcactgtactccagcctggacaacaaagtgagaatctatctcaaaaaaaaaaaaaaaaaagaaaaaaggaaaaaaaagaaagaaagaaaagaaaagaaaatgaagagtgattatttctgcatcaggtatttctaaaagtatattatttttacatttttccgcattttctagattttctttaagaagcacactttaattatgatcagacgaacaagaaatatcttttagaaattaataaagagttagaatccctataaaatgtgtgtttaggtaataattctggataatggacaaaagctcattttctctgataaggagaagattagaaatataaaatatcacaagaaaaatatttgatcagaaacatttaacgtaaaattctggtgcttaaagggctgacctttaagtatctggataatagaaatagtgtgagatgaaagaagcattactgtatgctgtcaagttactattgctctacatgttacggcactgtgctggcattctgctctgtattttgatttcctccagggtctcaagccatgaaacaagactgttcattttgtttgcttatttgcaggcctccagacagtggggatattccgagttggaagctcaaaaaagagagtgagacaagtaagtgaaaagtaaagattatattttgtttcacatgactttcaattgaattaccttttgcaaagttcaagtttatgcaaattccattttgattatctttttttttttttttaccctccaagctattataatataattgaattccaggaggtaaaaggcaacaactcagaaatgttgttacagttaggatcaaacacttgaaagcaaaatgtctggatgtatctgtgccacgtgcagccaaacaaaactaatttataaacatcttattgaaaattgcaaaagcaggaaattcagagtgactgatcaataaatgatataaagttgtatgtagcacccgcttttactaaaatgtgatatgaaaaatgccattaacattcccttcacataagatgctatgtttatagctttactttatcaaaaataaataattcttatgaagtttccatagaaccattgacccccagtttgcttttcacatagagactgtgctcctttgtttccttcagccctgtgcaacattcctgcaactgaagtttgatattagaccttcaacaataggttcctgtgatgaggcaggtatttgtgttcatgatggcttcataaaaggcaaaccatcctttgagaaaagagttcatttgttggtgaaggaaaattaaagcattattttcttcctgttgttttcaatggaaggagataaggaactcagcaactcaaaaatgaattcaaatgaaaataaattttagttggaagaagctgaagaaatgatatttgttcatattattgaaagtaattgaaataaatacctcatttatcttttttgtcaagacaaaaaaggctttcaacagaaatatgttttctgattggttggttggtttttattcttaatagttacacaagaaacattaaatggatcaacatttaatgtttcacaacagaacttgcaggaagaaagatagtacagtaacatttctgtgcagaattgcagaatatttttacaaatattatctcactgaatctgccaaccggctgtgagtgtagcccctttgacccacttctgtcaaggcttatagagattaagaaacataattcaagatcacacagtttaaccagtcaccattaacttcataggccaaactctttgcatgttccattctttctgcatgtacgtatactcagaaaagaagcatggtgtgtttgaatgatcacaagttggaggagtgccagtggaagtcttctttgttttggctgcctgacacacgctgatggcgtgctgtctggaatcaatgagtagttcaggacagtgatgggtattcattctcatcaggtggacaggtagcgagtgccagaaattactcatcagttatatcgggatccattaaaggggaaacctttgcatggagttgtatttaaggattacccaataaaaatataattagtgtttacttagaagtagatttcaagtatgaaatatgccctaactcactcatcattttactttgttatataaccccttagcaccctgcactttttccttagatcactagccacaatgttaagagtgaattatttgtgggattacctgcttatcacattgtttctctagagggactttgcctctttactcactagtgtattttgtgagcctgtaacagggtctgacacaggaaatgcgtagtaatctttgttgaatgaatggatggatgaaagattgaaaacaaatgaactcttagagaagttttttgcatagtgtaggtttatgaagttacataattatttctacagcagagaacaatgcatacgaaaagttgagctgctagagataaaagtagggtgtggagttattactcccttgctactgtgttttcttgctgctgcaagtgataatagacctagtataatgattaaggcagggaatccttctggtaattgttaataagactactttgacaaatctaagacagcttttatttagttattgtcatcttttaagtcttagtcataaatgtgttatcagggctcttaatttcatttttgcagaaaaaaaaaatctctttgctttcttatagagtgactcagtaaaatatcaacatccaaacatggcaggattggtgacacacagaaatgctgtgtaatagattaattcctccctcccacatttatagctgacctaaattgtcttctacctcttaggtgttcctcctaacctggttgtcattaccaagcccttctgcatacatcattaacaataaatccacagatagttttatttaataatgcttatatatatatatatatatgtatacatatacatatatatgtatatacatatacaatacatatatatacaatacatatattgtatatatgtatacatatatacatgtgtatactcatatatatacatatatatgtatacacacacacacacacatattcatagctggactgtgtcaactcggcagatcaaggtgaggatgttgtttgcttccccttcttggggtctgtgcagtcttaattccagatgctacgtgtcacagcacttctcctgctgggcactgctcattgaggtatggtgttatgtgactgccactcgaaccattgttcttccagttacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctctgtgcgtaatacagccatatgtgggaaagtggccctggaatactaagatgtccaactcattcatcataactttatgcatatgtttcctgataactttttgtccttatttatcaatctctaaagagtgagctatttgagggaatttctcagatttaccctgggaataattagcaagaagaaagttacaataaaacaaatggaaatagccaagaagaatttgagatgctttcaaataacccaagaacagtaaaaagtactatgagttagtgcttagagtaccaacaagagttcacattgagtctgtgcctaaaaatgagtttgtgtttctggtacgaagaaggagggaaccacgagaacccagagtgagaaaggagggcagcaacattccaggagaagcaagatgccatagcccagtgccagggctttcaacatagctgcttctgggctgtagctacagatcccatgaagaagaaaaaaaggaggaggtagaggagagataggccaaacctgggtcaacctccatacatttcttcctccaatgctgccattcaaataggatcacaacggagagagaagacattggctttgctgtatcttggttattgccaacaaaatatctgtcccttgtgaattgctcaacagaaaagagccttaaatccattataaactcaaatttcagaatgttcaccaattttcagccattgttaataaatatttaccaaaaatggaagactgaaatccttaaactaggtgatgagtaatgccagggaaggggggagaagaaagtaagggaaattgagttaccttttttttttttttacctggattacagttatttttctaggtattacacttctcgaggtctaatttggctttatatctttcatagaatcttgctggtaaattgctaaagcaatgggcaaatgagtgaaggcatgaaatgggaattgccttgataatccctttcttaagacaattgagaggaggcctttcctctgtgcctgaatagtatgggctccccttttatttgagtacctctttttgccttgcttagtgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtaagatgcctttgctgccatagatgccgtgactcttcctctcccctattttaaaagggcataccaccaaaatggccattttgcctggaggtaatgatgtctccccttctccaacctagctgtctctgtaggaagagactaatgcagggccttctctggaggcacagttcctaaaagtgcatgggccatgagcctccttatatgtttcaagtatgcttccaaatgaggctgtcattttccatggtgaggctttactcaagactctgaacttccgtttgtaaagaagaaaaacagtgaactacagaagtgcttgcaaccatgtaaaagtggaatgatgggggtgggaggagattgttatccttataattgattttacctgcttctataacttggagcccaaatatgatgtcacctctttattcttccagtttatccctggagctcccatctgcactatgagcaagaagtctagtgtctccctttcaagggatcctttcctttcttaaactctccccccaaaacagggacttgctcgatgcaagggagggtcagtcctgcttccaaaccaggtgtggaggaaactgggtctgatctgctgaccattgccattgtgtcttgatgtcacatggtatcaactgctcaaagcaggttgtacatagtcccacagactctttagaaatgttcttgttggatctgatccccactcaggccccagtgtgccccccccccgcccaccaaatctaagatcttgggttctggttctctttggttacactcatatatttcaagatttttttttttgtttcacccttggacaaatgagatgctggcttgaattttaagttgcttacttatgggcaacgtatttaatcttcaccttaacaagagacacccccttccctctttgataccatgcagttatacctctccctgacctcggattcctcaggaggttttagactccttaataagctaacatgcactgtaaatcaataagaaggggccagaggcattccaaacttacttaaccacagaaacttttttgtaaattcttgttaaacaaagctcagctgcactgcagcttcagttctgtgtttgtcaaatttctttcccaaagaacgtggttatgtataatttttttcactctaatccagaaaggcaattctgcatttcttctcgtcctcctccttacgggtgtgagaatggaactctcctgacttagccatttatctctatagcagttataattagtgaagccccagatggcttcaggtttcataatgtggcactgacaccttatttcagcatacacagctctttgatgggcatactataattctcataattgttaagtagttttattactcatttggatgccaacctctatcaactacagttataacagaagctgtagcatgatctgcctaattgctgggggaaagcagagctctgtgtttaaaggtactccagttacttctctgacatttcttaagtactgtgtgagaaggagaaaattgggtctcaggtaattaggaaggcattgaggaaagcaaaagttccaatcgaactcattgttgcccttttagaatcattttcagacattctttccattcaattgctgaacaagtctccattgcctatgccaaaaagaagaaaatattcttggacaggtgtaaatgaaacagcatgctggaatattagctaccatttatgtctctccttccatgagctggctttgtgctaggggagatatatatatatatatatatatatatatatatatatatatatatatatatgcatgcaaatacatataaatatataaatatatgcaaatatatatatatatatatatatatatatatatgcaaatcctcttaacaggcaaaagagatatcactgtctccatgtttcagaagtgaaaacttagggccaggggagctaagtaacttacctagcaacccacagagagcttccacttaaggttgtacgagtggcatattagtgcatttcacaactctaggggaggtgccatggaccccatagtcactggagatttgcagagttattaggacagtatcccagtggatgatagaaaaagatcttgaagaaggacaatgtcgttatactggttaatgggttgggttggtccccttactagcaaagtccaagctgtgcatagaacctgagccagtctaagagaaaagacgtacagaataggaattagaagaaaaaaaaaatgtactggggtctaggtcatggtttctcagcctctgcacaattgatatttggagctaggaattctttgtcatggggccgtcctgtgcattgtaggatgtttagcagcatccccggcctcttcccactagatgccagtagcagtacatctcctctcccaccaagttgtgacaaccaaaaatatctccaaacatttccaggtctcccctgaggagaagggttcaaaatcacccctggttgagagcgcttgatagctctttaattcactgaccatgtgttgttagaaaaatctattaaccttcctatacctgggtctcctcatctgaacttgaggaatgaaaattcttcaaccagccttgaagagtggttgagagacctagtttactgtaaggaatatggaattatcctggtgacagtgaagttgtaaaaggaagccagggtttacgagggtttctagacactcttgacctgaacattgcatcaaaatgaaagactaatagccaaagattaaagcagcaggagaaatataaggaaagcattgcttccgtgaaatcgttagcagtgacaggagagcaggcagctctcacagccattgtgaactgtagtaaaggctacggagcagtgaagtactgagggagacaatgggaaattgggccatgttcataaattgctgaatgcctctgtgcagggcaggtggttgattcttttaagctgtgaatccttggaaggattcaactaatgggtgatatgatccacgttgtagattggctagagacaaagggagagtgagttaggaggcttttgtatcaatagtaatatggacaacagcaattcctattataaacatttccatgtaagaatggccttggcgggccaggcgcggtggctcacgcctgtaatcccagcactttgggaggccgaggtgggcggatcacgaggtcaggagatcgagaccatcctggctaacatggtgaaaccctgtctctactaaaaaaatacaaaaaaaattagccgggcgtggtggtgggtgcctgtagtcccagctactcaggaggctgaggcaggagaatggtgtgaacctgggaggcggagcttgcagtgctccgagatcacgccactgcactccagcctgggtgacagagcgagactccatctcaaaaataaataaatgaatgaaagaaagaaagaaagaaagaaagaaagaaagaaagaaagaaagaaagaaagaaagaaagaaaagaaagaaagaaagaaagaaagaaaaagaaaaagaaagaaagaaagaaaggaaggaaggaaggaaggaaggaaggaaggaaggaaggaaggaaggaaggaaggaaagaaagaaagaatggccttgggatttgaatcatgcatgtcctgagcatctaccctaggttcctgtaaaccaacgactattgctcagaaattttctaatgactggcctcaggatacaatggcatctaagaggtggaggaggtgaggacacaaggcaaatatagaattagggaatgcactgcagagtcattgcagacattcggagaagtgatgagcatgggccagaaaagttaggaatggcttcatggaggaggttgaatttaagatgcacatcaaagggtgtgtagggattgagtacatggaccacataagcacagcattgggatgggagttagccaaaccccttctgttagaagtcaagggtagagggagaggatcaagagaggagttatttattattttttagttgatttggcatgagcaggtagagaatatggaatgggcagactggagtaaaactaaataccaaattgtaaaatatggtcaaaaaccaatatttttcaacttcttctcttccctatttttttagtatgtattatctatttgttagggtgttgtttggggggattgcaacatagatgaaacctgaagcagattgtcaagaagcttgaaagctcacacaggttctgccagcaccttgctgcataacttgtctttatgaaagagaggaagaggaaggaaaacagagttgggatggggggtggtcttagcttcctcatctacaaaatgaacataatattttctctttgatatgtgcttaaaattcaatgcatcattcactggtgagaccttaaagatgtctaaaagaagggcatgagaaaaattgttgaccaatcagtgcttttttgggaaaaaatagcagtattttattgaattgtggtgttttgctatcttgtgtttgttttgttttcttctattttgtttagtttgctatttgctttgctccttagggaaaagagaaattcccaagtgtaagaaacattgcatttcttcaagaaagaatatagcaggaacaaaattgaaacctcctgagcagtggtttttcagagttcaagaaccccctggcactgcctggaaaatgtggtgtgaatatgcacttgtttggtgagagtccgtagctggcattgagttctcaaagggtctatgaggcaaaaaaagaagttacaaatcaccagtgtagggccatgattactaatctctgaggaggtacatgcctctaggaaatggtggttggctttggaacttagcaagacctgtgtctcccctcaccctcattcagccctgttttaaagctcgttttcccgtttccccatgccatggctgggtctgcccagcaagaggaaacaggaagagatgtagcaatgggatgaagagagtagggctgcctagagtggggccaccagcttcgcttctttctataccatctcctggctctgagctttggacatcacttccctcgtctataaaatagggacaacagcagcagctgtttcttaagcttatagtgagaaagaattgaaatggccagtggaaagcccctagcctggtacctgtacatattagacttttaacagatatgagctattcatatgaagcttagaaatgatctaggatgttcatttagtgaagataaaagttttcttgaattgctagctaattaaaaaatgaagtaatggcctggctcgagtgtacgttgtattacctagacacagccgtatagtatatatataaatatatgctgaaacacatggagaaaaggtggatgttgcctgggagcaactcttctttccctgttaaaaaacaataaaacaaaagaaaccccaaaagtgttaacaaaccccagcagcttggtctgcagctggaatctgtgtgcagttttacagatgggttgtattccattcccagaatagcaacaggagaaggaaagagcggaaacagagctctagattgttctcgtatgaaacattcttttaaaagaaaacaaaatcttccatttgttaatgttttttttaaaaaatgagaaaaccctaatatgactttacaggggtaaggggaaacactccaaatacctctgagttctaaagggaggaatttgaaaatgacacgtatttgattttcaccttaaccatgaatttccaggaaaagaaaaattaaatgaaaacttgtcaatgaaataaaaaacttaccaatgaaataaaacaaagaaaaatgattggacgatcctacataaagggcactttctttgaaattgtcagtgtttatcacatgaaatgatatcccttggaggccaatcattcacctgaaaacagccttgccttctaaaaataatacaactcgtgtaccaagctgggattgcagggcagggcagccaccagctcatgacgccacaggatgagagtggggttcagagggctttgtttcagctgttcattgggactcctgaattctatgctgggcacccaggtgtttctcaaaatctatgtagatcttcccaggcaaaagatccccaccaagcagacgcagttcccatacttatcctgactctcaactgatattgacaagagaaataaaaattcacatagaccagtggttctcaaccaggagcaattttaccccacaggggacctgcgaccatgtctagagataattctggttgtcacaactgtgggttgagggcaggggtgctcctggcatctagtgggctgaggccaggggtgctgttccacatcctgtaatgcacaggacagcccccacagcaaagaatgatctggtattacatgtcactagtgtcgaggtagagaaaccctagcctagagaaacttactcagactctcccgttcacctgaaagaaagacaagtagaaaaaattcccaaacctttgaaaacgttcatattccttattacaacaattcaacttgtaggaatttactcctaaaaagtgctcacccgagctcacaaaatatcttttcaaggatattttttgtaccattgcttataataacagaaaattcaagacgacatcaatgcctattagttgactgtggttaaaaaacatcatggtttattcgtgcagtgggattctaggggccaatgaagcctgaagacaggattttttttttttttgtagtggaaagattattgtagcatgttgttaagagatagtaagcaagttacaaaataatatatggatgtgatcccagttttaaagaagaaaatatcaggtgtacatgtatatatgtgcacaggaaggcataggaatggctgattcttggcagtggtgaaattatgggcatttttttttcttttggcttacctgtgctttctaattattaatatattgaatgtgaataattttttatgcttcaagcaaaaaatagttcccttccttcaccccgtactcccctttagctcctcctacatttcttcttcctccttctctgtgatatcttttgaagaaagtgtctacattcactgtttccacttctgcaactgtggctcattcctgccacaccactgacatgactcttagctgggacatcagaaccatcagagagtccattctggagggaagggtcacatctcgatgaccctctgccacagttgataactcacttgaaactcccctgtcatttcttcttggacacaggtttcttttatggtaacttctcacccattattggcctccttcatcagctgctccttaagggtgctggagtctccaggaaccccttttcagcccttcatgttcctcacttaactgtccttccattttttcatttgttaaaacacaagatccttaccctctgcattatcctcttcaccccctccgtaactttggaagctgctcttcatccctacttcttccttcctagttcagatgctagctgctgtggcctagactgttgtggtatgtcccaggtagtcctacttccttgcatcccccatcccctgttccatagattgctcttcctgaaatgcagattccatttccattctgctctgttcagaatcctcttgcccttagatcacagtttgaattccttggtctgacacatgaagatcatctcacctggcccttgcctgcctttcctgcagaactccctaccacactgagcttcctggggctccatgacgtattttagatgtttctgtctttgcatgtgtggtgctttctccattgtaaaattaccccctagcccagatcctttgcttttcagcctagcaaactctattcttcttttgagagtttgtgcaaatgcttccgcctctgtggtagtgaccctggggcctttggagttgagagctttatactttgtactcattacctgtaagtgataggtttatttcctccctagaatgagagacctttaaaataaggactatgttgtaatcattggaaaaattttaaaataattacaatatatgaaaaatgcccagcctatgataggtgctgagtggatggatcagtggtgagattatgggttgatgaatgaagggatggatggagaaatggatagatggatggatgggtgtcaatatttcttaagtgcaaacaggatagaaattttatgtagtacccattttacaataaacaacttagagttgcaaatttttattcaatatgctattgagatgatcactgaactgtgagcttcaatccaagatattaaagcaaaaggaaaataatgatgccctccatggattctgacagagaggatggcatccttgcaggattaaaaaaaaaaaaggagagtaaaaggtttcattgattgttgaatcacccagtatcttgaaaggcaaacataacaacagtccttgtgttctgttctcttataggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggtaggtggcccttctgtggcaggacatcacagcaaactgcctattggtttcctctggaggcaggatgaaattctagtagaccaccctctggggtgcagtgctgctcactgaattcattggaagtcaggcagtttcagcaggagtagaaatttgcacaactatgatgtcattttgagtttgtgactccatgtttaaacaaacatgccaaattataattttcattttgttgtcctctaaaccatggtcacattttggagtcacttaattataaagcagtgtccttgctcaagacattaataaaacccttctttatggaattgtgtccctcatgaattcatgtattcataagcatcctcagtggtttcacctcctccaaggtcaatcttgacattttacctcctacatgaagcttcacctctccttcctttgtccttcccatgccacttctctgtcccctgaactccattactgttcttactgatgtttatcttgcccaacattgtgtatagtaatttatgaccatttcccctagtagagtataaatgcatttaaaacaaggactgcaccattgttatctcctctccatatcctctgtacacttttggaaagccctccatctggcaggcactcaataaatatttttttgatttgtattgaattaccagttcctgttttccttcatcaaactgcattgcttgctacaacttcccttgaaacattaaaacaaatgccaactctcttctatttctgttcaccactaatattgcatgtcaaaatttacaggaaccttcttcatgttttttctcccatttctcttgtcaatttgcaaacgctataaagcctgcctattccactagagccttttgtggctccttccttcaaccgagaattctagttacctcttttaaatttctttagtagtttgtctacacttatcaagtgctttgcattagatttatgtccatgcttgtcttatactaattactttttgtaaatttgagacccagcagtttagagtatttgccctctgtgtcttacctatgtgattgtgaccaagtaattcaatactcattatgcatcaattctagctttagaaatgggaaaaacaaaatgatgatgtaattctcagggtggtgaccagaatcatttgatacgtgaaagtattgtgcaaactgtagcagtttatgcaactgttaattagtaattatattagttgggtaacacgtgctgcctcaaaagtcagtactttaacacaaacataaatatcactctgacataaagtttaatcaggtgttaagtggacagccttccaggtggtgatttaggaatcccagctccttgtattttgaggctctgacattttttagagttttacgggcaaccccagaaaggtcatccatcttgtccactcaaatctcattggccagaacttatgcacaagccacacttaacttcaagcgaggcttgaaaatgtatcctggttggatccccaggaggaagagcaaatgaaaagttcactgaggtagaatggcatcttgttcctgtttgtgtctctgaagcactgtccctgggttgcacatgctaagctctcaaaaaatgttgaattaataattgactctatataaaatttacacatcagcctaaatcctcataattaactacatatttggatgaatcaaatgtctgaacttttcaacattttcatcaagtttaagtcacatatcatcttgccaagtagtcttggcattacttcatgttctctggatttttttaacaaaataatacttctcatcaaacttaattctattatctaagcaaagttctcctttatatgaaaccacatatcatcgagcatttcttttcaactcagataccaacaaaagttttcctggcttctttgaaaatatagctgctgccattttaattgtgccatccctcttctttccatttcctgccacctgaattactaagaacagtataaaaacatcagtattctaccttttccagcttttcccaaatctgatctttgtttgccattctctgtagggattgatgtcggcattctctcatatttttggtctccagttatagtctttacttctcatagaggcctttcctggccaccttgtctaaaatgcacctccaccctccatcacacacacacacacatcatcactccctatttcctttccctgctttttccccttagcactcaccactgttaacattgggtcttacaaatttctcgtttatgttcgccactccctagaaatgtaaactacatgacaggatgatttttttggtccatttctatctatagtactttctttactgcattacccctgtgcctgggacatggtaggaacacaataaatattggttgaattaatgaatgactcaatggttgttctgtgacatatgatttccatattaccaagccttactccttatacgtatgaaaagatttgggcatggagaaattaaggatacctttcttggagtaagttaaccattaatgtaatcattcttgacctctttagaaggattctggtaatcatatattcagaaaaataacagtggagtgggaggaagagggagacaaatatctcaagtcttggtctatgaaaagaaactgactctggaaccagaaaatttactatcgtcctgtccctgttatatattggctacatgacctcatcttcttctatttctttagttatcaaatactagatttgaatgaatgatagccaagaccccttctagttgtaaaatctgcatggtgctatgccctagcactgacttcccttccttcctttttataaagcacaggagaaaattaatctcatcacattttagattatcttggcatatttggcagttgagaaactagtcggctataccaaggctggtggtttgtcagcaaagctgatctgcatgggtggacaaaaatgtaatcttgtatgtcgctatgttgttttgttttgtttggctttttaaagaagctttcagaattattataattccaaacaaagaaggatgaagctagtcagggcctgatggttaaaagtagttagtaattgtgcagtttcacagtccttgggtttaagagctcggaaagggaggtgtcacttctattagcattagaaaggaagacttgttaggaaaggtagctgtgagcttgtcctggaaggcagaacagacctggaggcagtgattccataaaataactggtggaagggatgtagaagctcacagaggcctggcagggacccaaaatttgttctgggtgttctaacatccttcatttcctgatgctgagactgcctctcccaagtggccactctctgagttaatgggaaagggcggaaaagaacctggcttcgtcctgtaatacagaagaggaacctagatgcagaggttgacacacaatttaagagtctggctaggacagtcttttgcattggttgtttgcttttcaggtactggtttggaaatccttgagctggaaatagatcataatagcagatatcatgaccacagatatcaaaatacgaaggcagtagattataatggtggttctcaaacttgagtgtgcagcagagttgcaaggaaacttagacattcagattcctaggatgcactcccgagaatcagattgagtagcactgggatggggcccagaaataatctgcactttctagtgaagacctccacagagttctggtagtttcctaaccacacctttggaaaccatatcttgggaaacactggtatggtagaaagaccatgtgcattggaatgagctaccaaaattcaaatccctgctcagccacttatttgctatgtaatcttgggccccacagttaacttccctagccaaaagatgaaacaatgtgacctaatttacaggactgttataagaattagaaatgacattttaaggcacctagaacagaattaacatatattaggcattaaaggaagatttctgctattattacattaaagggataaggtgcctgctctatcaaagcgtgtttgggtgttttcttggaaatcaagcccactctgcccactgtgtataatgctgtgacctgatcccacacatatatactcctaggcccttactctgctctttttattccatagcatttattaccttttaacccactatataatttacttatttttatgcttattgaaacctaacagaatacaaaccttataaaggcagagatttttgtttgttctgttcactgacattcataccacctagaaagtatatggcaaaagatgggtgctcagtaattatttgttgaataaatattgcaattctgtattactagaaaaaaaatgtatttttgtttcgattttgtccagtgtccatactgcttatattcccttacctttaaatcatgaccctccacttctgatatcaacacctgttgaaaaactggctaacataaaatgatactctgtgggagcactggaaatcaaggataagaatcattaatatctacacaaagtcattggtattatcctaaccagaaagttctcactgactaagtcattgatacatgaattgttctgaaagttgttacttctgtaactaatattgggaattccagagaaaactcatcattgctcttgggattagtaagaacttcagagcagaatggagaaaactgtcagcttcttctaagggctgatattaaacgattcttactaggacttcttcttaggagaggggcaagaaagagaagacaccacccttgtaagctgatgaaaagtccggagtgcagtggagacgtgggaaagccagtgtgttcccaccccactgagttgtcagcctgaactggggaccagcttagtgcacgtgggaaatttcaaatgagcactactgggagcaagggtcagaggctgtgatgaggattccgagtcagaagccaagctttgctttgtgttctcttcattccctgatgaaaatcgcattttcttaaagccactttgcacaccaagtcaaagagtcaagcattcatccaggtcatcaagcaagaaaccacccctcccagtatatccacataattatatatgatttccatttccttttctatatatcacaaataccactgtctacgtgccagggttgggctactcattacgtacattattggcttgtttaaatctcactaccatttcatgaggagtaagccaagtttgtttgcccaagtgatgcagtgactaaatgaattatttctacagcatgatgcctccttacacaaaagaagaggcattttgatgtggtatctcagatatggagtccatttgtggggaaagaacaagaaaatatgttttagccaatctggaaatgaggaatgaagacctttaacagcagtaatactgctggactaatcatagcacccctgatgttcaggccagcagatggcttccagagccagcaaatgttctgctatagtctgctcacttggccctgtctgtaaagacagaacatgtgtactgtttgtgtcccacaaaggtggaaggaagcagaagcaaattatgcctgaacctttcccactccctttaacctgttgccatggagcaaagactgctgatttctttcatctttgcttgagttatcctccaacatcgttccatgagccctggacccttccactgtatttgttcactaatgtacctgaattgccaaaacatgctgcctgacatgtatcaagcacttgagaaatatttgccgaatttaatgcatcttgaccctcccgtgcacccagaccccttaaattattaaaccacctgtcacaacagagccacgccaaaggttctaagctgggcctgtccttgtttgagcttttgctcccataaacagccaaagtgatttcttttagtgtgtttgttaactacaaaatgccatcatgatttccagtgctatttacttttgctgggttttaaatgctaaagcatccttcttggtcaagtgcaaagtggtggattggtgtggaacatccagtgacaagtgcagtagggctgggtcctgggaatagctcttcaaaaagcccttaatggtttattgtggtgacttagtaaatggagaaaactcaactcataccacttttctctctcagtggtttatggaataaactacctcatagcagttataccccaggcaataattcaaggtttcatttttaatttgatcgggtagattttaattgtgacagttttattctttcatatgtgcagtgtttacatttttttctctgaagcaggaggggccaaagttcttttgatttttggaacagcattatgctttgaaggaactcattaaaatctaaggagttgagtctccagataaacaagaccataaatggtacccttagaaaatatctagaattgttacaaggttgactaaagcccagtagagattttgatgtgaaacaatgaattgtaaatgaagaatcactttgggctgggtttcgtttcttctttttaacatgcagaattgcttgattttttaaaaaatgtaatatgtctttcactacccttctccttagttcccattttgctatatacaaaaatcccagaagcagaaaatgaaaacgttgtttaattattgagctatctttttcaaaaagttttgaagtttttgtattgataagaaaaatagcttaagaacttagaaaaaatctgatgataatcagttgggaaagaaaatgtattttcccactctagaaatgaacagcaagaagactgtgctgcagcatgacataggtaccactgataagtagagagaaacatctagacaagggcaacgtaacacatgcagtccataatcctgggtgattttagattattattatttttagccatttcagcaacattcactgcacatccactgggtagaaatcaccaccctagcttgtattctgaaagagcataaaattgagcaagagagtgtgtaagtgaatgacggggtgagggtcatagaagtgcaggtaagaccttccagagaggaaagagtaggaaggcaaagttagaggaggaaaatgagacatcatttaggaaacatttgactggcaaggagaacaataatcaactgcaaatggctttcgacatcagcatttattatgtgacacagtaaatatgggggggggggcacagtttcagtagctgggtagcactttgctctctctctctctgctctgccatcttcagctgcaaaatggctacagttgataacagcatctcttccagccatcattgcatcaattaatgaagagatgatgtttcttttcatgtacccattttcaatagggaagataaccttttccagaagctcctacatgccccacttcaggtaccagcatgtgcatacgtgatcttgccctagctttgagggaggctagctgaaagaaaactacaaatttctgagcctgtttcagttctgggtaaacaaatcagataatccctgccttcaggaaatttaccttctaatgacttgaatggtgggaagattcaaggtctagccaaaggaactggaagggtgaggctacacagagtctgacttcaagaccattgcagttgaagggccaagaggtcataggctgtaactccagaaattcagagggggattagaagcagaggcatagcaagagaaaatcccataactgagttacccaaaagaagtgttaagcaaaagagaagagagtgcttcttctctgaaagcgaatggatgactgttaataaaaactaataactgcagaataaatattgtccatctccatgttatctgcttttattttttcaagtgtttaacttacttatttcatctatttctaataaaacattttattactagatctctttgcaattggtaatctattttcatttttttttagcgcttttgattcccgtaacaccccccattaagtaaaatgaatatgcatatgttttcagatgtgggaacagaatcctaaagaaggtgattgatgtgtccaagtttatattaattataaacagcagagccaaaactggatttcaggggctgttgcctcagtcagatttttttttacagcatcctaattcctgaaaaggtatgcttaagtcagtggtctacctagatatttctttcttacttatttcaagctgctgtttcctatcagtttatttacttgacttttatttctccattaagtacctaaattaatagagaaataagtgttcatccaatataactgagccagtagtttgaaatttttattaaatgttaggaaacgaaatgtgcagttatagccaaagattagaagaattataggaaaacagtactgggtgctgttgtatgaacattaaaaaatcagtttcaggcatcatttcaaattttttacctcattttcccactgactccaattttctgaatcattcctttattttttagaatgtggtttaatcacatacattttgaagctgccttaaatcactctgtaacaaaatggattataaataaactaatgaattatatacaactgtagttagttttgcataatacataggaaaatattatttgccttcctgtaatacatggatctacaattttaaactatgtcttttttatgcatttgtaaatagtgtctccaagccaaaatggtaccatgggccttttaaaaggaaactgtagatagatttataactgtgacccttcctatttgcatttgttaccaagtaagagtcacatatgctacataaaatagacctcagtaattatgattgctcgcctagttgaatgaggaaaacctctgaattgcagactagcttgacaaaaatttatggaaagttattttttaagtaatgatacttctgaaacctattctaataatgcatccaagttgataatttatcttagacatactacatactctcaaagaattaatattgtcatgcttgcaccactctgaagggcttgcactctaactgtttattctttaattaaatccaagaatggattagtgcttggagcgaaattttttttttttttttgagacagagtctcgctctgtcacccaggctggagtgcagtggcatgatctcggctcactgcaagctccgtctcccggattcacgccattcttctgcctcagcctcccaagtagctgggactacaggggctcaccaccacgcccgactaattttttttttttttgtatttttagtagagacggggtttcaccatgttagccaggatggtctcgatctcctgacctcgtgatctgcccacctcggcctcccaaagtgctaggattacaggcgtgagccaccgcacccagccacgaaattttttattacatgtcaaagcctagcaagttttaaattaaactaactggatgaaaatgcaagtacttttcctaatttgtttatggaattttcttctaaaaaagagatcgggacatacatttttgtcctatattattttttgctctgctgttcattaaaaaaatatgagttctctttcctctcattttcaccctttaggtgttacgtttttaaaaactgttataatagcacatggctgttgggtgatgatctttggaaaaaatacagtaaaaatgatgtctttctgtttaatttatacagtaagagaataatctcacccttgacctaaatatcctgccctttcccttctccccattttcatacccaggccactgcagctggtcacagggttttaaataccatctatatgtgcctcttaaatgtctatgttcaacccagacctctcctatgaactctgaatccttattgccaactatctacaagatacctccttcatttggatgtcttgcaaacctctaaacattatcatatcaaaaccacactccaaaacttgacccccaaccttctcctcctgcagcttctccaaaccagtcaacagcaactccatctttctagttgcctaggccccaagcattgaggtcatcctttcttctccctctccctctcttctctctctctccatccaataaattaatgctattacctctatcctcactatgtccactgtggaaatatttctcatcacctcactgccctggttcaggacccatcatcttatctgggtagatcagcaggccctctctgctctccttgctttatctctggctccatgcattctactctcaactcagcagccagagtgatgctgcttcatgttagtcatctgttcaaaatctccagtggatccccacccactgcaagtaagtgcagaagtccttattatgacccataagactccatgacacctggtcctggccctatgaccccttcctaccacccgcctcctttcctactctcttccagcctcacagacctcctcatcactcttgactcaagacctttatcattggctttcttttccttccttctacctggaatgattttctccaactccttcatcagtttgagttttctgctaaaatgtcagcttctctgggactgacaatcctattgaaaactgcgtcttcccaagcatttctcattgcccttctttgccttgtgtttctctatgtttttcttgtatgtttgtttaatgcccgtctttccatatttgttaccagcttcatgaagacaaggattattgtctgtttggtttgtaactgaattcccagcatccaatacctggcactcaggaagcattcactcaacatttatgcaatgaatgaaaggaagggagggaagagaagacctgagggagaagcacagtggtgctgaagtagagcttgtgtggaatgactgctaggggagaagatgggaaagacagattgaggacagtatgcaagtggatggcttcagccatgggaataaaaagagtttccagtaaatgagtgtcttgaccatggcattctgacaaccacatagagaagaaatgtgctgcacatgttaaggaaatagcagacaaatttgaaagctgttgtatcaaaggttcatcaagtacgtatttttctttgcaatgcaaaactcaaactagcttaagtaatttgaaggctcacatagctgaacaatccacaagcaaatatggcttcagacatagcttgtcccgggactcagatgatatcaagacatcccttttatctctatttcttggtattgtttgctcaattgtcagcgcaatcatcaggcctcatatggatacaggccctgtatcctctcttagaagtctcagggaaaacctccagggttttcattgcctctgatggagtcacatgcccattgctcaggcaactatgatgatctgggaatggaatgctcaatagactttgactacgatacacacttcacccttgagctaaggcttgggtagcagttggtttaccagagggaacgtggggtataactattataagaggagggaaatggagacttttaatgatgaacagatgaccactacaaaaggctaatgagggcttgaacttgagtctctgcagttggaatggaaaagggagaaaagaagtaacagagatgaagtctagtaggcctcctggctctgaatggagagaggatgcagagaagctttagtacaattctgagatcttgagcttgcgtgattagaagttggcaatgtcattaatgaaggttcacgataaagtaggaggaacagatttgtaagagacagaacacatttccttgctttctcatccctgtttttattaataaaattgtttccagattctcagagctcaagaactgtagagttctgcaagaggcaagaagcaaattcttccaccaaccacttattttcagaagacttaaccctgcagttttaaaaagtcttctctctgagctcatgtgtgagagaatcagactgaaattttattttctctcaatagttttgagtttcctttggttgagctatcagcttctatggaataagaaaccacaagtcagagctgggttcaatcatctcttatagaacatttccacacagatgacttagggttgtgaggccatcttctaatgtactgtggatggattaggcttagagaaatatatgatgctcatctatagaactctactggatgcctaacaaattacaaagtgagaaacttttcatcactgatggaccaggtgcaagaaaggagtaaaggcaggcaccgaataataaagtgacatatgcaaatgtagtagccagcaattttttgagtatttaccattgaccaagtactgttttaaagtctcaacatataataagtcatttaatcaccatagcaatgcttcgtggtgagtactgttgttatccccattttacacgtgagcaaactgagatctaggaagatccttgtcgatgtacgttgtcaagggtcccacagctagtgactggcgtggctaagattcaaacccaagcagtctggctcaagggcctgccttcttaataaactgatcatatattccagaactgcccaatacagtcatcatttctgcctgctgccttggcataattataaatgtgaactctagaaagtgcccccattgggcaataaattatggacactatttctctgaaccatgatattttccttattcaaaaccaagaaaatctaacctgagcaataaaggcatccaagtggttcagttgtatctccaggcatatgaggggtgacattttggattgaatatgactattggtaatcatccagttggtcctaagaattaaagcagctgcatgggttggcgtaggtttggttttaaccagcaaatcattctgctgtcttgcagcttttagggctctgttttgtgctacagtaaaattgtcagtgaccatatgttgcctgtttctggaatggttttatttatgcctcaacatttggctccttcaggttcccccagatctccagaacgaagtgctgatcagcctgttagagaccgatcctgatgtcgtggactatttactcagaagaaaggcttcccaatcatcgtgagtattccagtgttccatcttctaaagccgcattggagatttctatttccatttctgagaaattggaaaggtttacataagtacatgcagggtgacctgaagtggaattttggcaactctttggcaattctgatcagtccatctaaccagaaaatgcttcgggtcccatcaatccacttaccaaattagaaaccacattacaagatttttctgttttattttcagctttctctagcctctcagggtccttttgacttcatttacagggaaaaagcacaaattactggcaagggactataatacacgtcaatgattctacttctagaattctgataagcgtgcataggggcccttaaggctgcgcctggatgcatcttgcttgtgcagctttaccagtgggattaacccattatcaaaccacaagacagaccttagctgaggcctaggtgcccatttgaaattagaggtgtgcaccttcttggctctcccactttttatagctagtattattttgataaaaatgcacatgggtttctacatgcactcatgtttgcaattagtaaaatgcaagccatgctgcaggctatggcttgctgccatttttgctcccaaaagaggagcacagagtttttgcattagtcagattttatggttacttccaatctttgctgcagaggcagagggtgtggggatgctgagcatttggcataaccagttaagggcataatatagcatcattaaccaggagtagtatcatcaccaggacaccaaacaataaatttgtgacaggaaaagttgttgctatgctcttacaaaattatcacttttgttatacttttaacctactaaatttcagcaattctaagatacgtttctcccatgacctatgatctctgaaattgagactaatcttataaccaatgataagctcctaacgtaatcccgtacctgtaaccccagcactttgggatgccgaggcgggcagatcacctgaggtcaggagttcgagaccaacctggccaacatggctaaaccccctctctactaaaaatacaaaaattagccaggcgtagtgacaggtgcctgtaatcccagctactcgtgaggctgagatgggagaatcgcttgaactggggaggtggaagttgcagtgagccgagactgcaccactgcactccagcctgggtgacagagtgagactctgtctcataataataaataaataaacaaataaataaaataatggcatgtcttaatcgatggtgtcttataaacagtaacacatgttaagttattcctgtatattggtgttgaacttgataaattaattttcactcatgattattgcagatacttaaaaagttatattatttagaaaaatttggtgaaaaggaattccatgttgttcaacctccttctttcccaggtcattacgttgatagcacagctaaattcagcttcactccatttccagcttagcagggaagaccttttaattggattatcctttcagatctactttaaaaaatctgtgtctgggccattcattatcaggccaaattctgattcaaataggaccaaattctgttgaaagtaaggcctggattcaagccccaagagccatgagtgaataaaattatattcaaattgtatagatgagctagtattttatggtcttgcttttcatatcagagaattaggcttacatttaaatttttcctagatttctaaccctcatcaaggtataagtcctaatttatattaacaaatggcttttcttttcagcagatcatgcaccaccataattttgataaactcatttatttccctcccttgtacagaaaagagacatgctggcatttccatttatgagcccctcatttaaactgcacttataacatatggttggtactgtgtgggaaagctacaaaacacacacttttgaggaaaaccactgatttttgcctggccaaatttctgcttttgtgtggcattatgagatagataaatactatactttaaagaacagttgatagaagtttttttacatggttttcaaatacactctttgcatataaatgctgtggtaaaaagcgaacctttctttctcttctattaggaaaaggaagaagcacacatattaagcccattccaagctgtacaattgtccagccccttctgttccctatccgtaagagtaagaagtagaattttaaagtgtaggtgagcagaccctagaccaagatcttaggtgagtgtcagggcttccaagaaaatagcaaagacttggaaccaacccaaatgtccaacaacgatagactggattaagaaaatgtggcacatatacatcatggaatactatgcagccataaaaaatgaagagttcatgtcctttgtagggacatggatgaagctggaaaccatcattctcagcaaactatcgcaaggacagaaacaccaaacaccgcatgttctcactcataggtgggaattgaacaatgagaacacatggacacaggaaggggaacatcacactccggggtctgttgtgggatggggggaggggggaggaatagcattaggagatatacctaatgctaaatgacgagttaatgggtgcagcacaccaacatggcacatgcatgcatatgtaacaaacctgcacattgtgcacatgtaccctaaaacttaaagtataataataataaaataaaaagaagaatgagcccataggagctctgtgtatgtcagagactagcattatcagtgaacagaaaacactgggggaagacttacttaggagaagaaagtgtttggtttttgtttgtgttcctctaggtacaggccaaggaacagcccagaaggcagagaatgatgtcatgaagtaaaaatgcatatgttaataaatgagtgtttacttttagtggtcttttgaggcttgagctccagagtgctacccctctagctgtagttgcctttttttttttttttttttttttttgagatcgagtctcgctctgtcacccaggctggagtacagtggcacaatctcggctcactgcaatccccacctcccgggttcaaacgattctcctgcctcagcctcccaagtagctgagattacaggtgcatgccaccacacctggctaatttatgtatttttagtagagacggggtttcactatgttggccagactggtctcgaactcctgaccttgtgatccatccgcctcagcctcccaaagtaggtggtctttttgtgttttaaactcactcactcatgcttctcaaactttactatgcatgggtatcaccagatcttgttaaaatgctctttctgaatcagtaggactcggggaggtagtctatgaatctgaatttctaacaagctcccaagtgatcctgatactactggtccatgatccacactttgagtttaaaaagcttaaaatatcaaagtatattcttgcttttaggagctttcagacttgttggaggaggcctccaagggtagaatgccaaacaataggtgctggcccactggctgtcagactcaccagccccttggaatcacctgggagcctgaagaacaactatgcctgggccacccctcagagattctggttcattttcataggctgcaatctggacattcggatttttgtttaaagtctcttgcatgattttaatgagcaaccagggttaagaacctctagcttagatctaccacgttggatatcacaaatttactatcatgtgggagtttgagctgggtgatttttgacattaaaaaggcatccttgtgttgacaaaggaagggaatcaatgctccagaccatgaatccacttggagtttggagaaggaaaagaggtgtgatttgaagtctcagagatagcttctgagaagaggaaggatttgcagtgaactttgaagactgtggaggatataaacaagcctggatatttggggagcttgcaccaggacctggacataacagtaaatatgttggctagctggggtcacaataaagaggctggccagcagtgaaggtagaagcccttaaatggcaggctgaggggtggtgcttaagtcaagaagcagtgacaatagattactgtaaggctaaattatagtaaattacagtaccctaaactgccagatggtgctggctgcattggcaagtcaattatccatcagtaacacatgtttgtgtagtcagttatctgtcaataacacatgcttgtgtagtttaatagactggttaccatttcagatccagagccagattgcctacgtttcaattccatttctattgctattatatatgcggtctattagttaagagttaatatctgttaatacatagatagatctctctctctagtttcctcatctgtaaactagagataaaaagtagcaccaacttaaatacagaattatgctcttagtgtatagtctggtatatcataaacatcaccaatttgctcatttacaactacttaccaaaggcgtggccatcactagattctactttggttttcatgagatagcaaccttccaggcaatatgacacaagagagaacccgttcactttaagttatagcattgtgtctaaaagcaaacactatatttgcttctaaccctttgatttttttttcctgaagcttctgttctctgccaccagttcacatacctaaacaaagctttacattcctgtgaggccaagtggaaactgcacaagattttatttggaggggaaaagaaacaagtttcaaaagagtgtaaaaccaagaacaagaaaatattataatttctgttttgaaagagcaaacatttagtgatatttgggaacttaatattttgttttgatttgggtttttcacttctttatgcaacatcggtattggaggagttaaaggataattccttgttttttctcgtgcttgtctgcttaagtatttggcttcaaccaaaacgggatgccagagggggattagaagagatttttatgactaagaatgcaagaccaggagtctgtgaccagcctggtcaccacagcaagaccccatctctactaaagaaaaatttaaaagttatctgggcatggtggctcatgcctgtactcccagctactcgggaggatgaggcaggaggatcacctgagcccggggttttgtggctgcagtgagccaagattaggccactgcactccaacctgggcaacagagtgagaccttgtctctagggggaaaaaaaaaaaaaaagaaagcaagactttgatttttaaaaatatatacttgtcaggtatgtttactagcattatatatgctcttttcttcaaaggtacttaaaatagttcccctaccctttgatttaaggatgtgaggaaatagggaatgagaatgggaggttaatcaaacaggacaggatatgttgaatgtgaatatttgcaacaaaacaaaggaatcacagtaggactgggacttagtgagaggcaagtgagacgcttgcctagacacagaatttaagggaatgccagaaaactcagtcagcaaaattgattatattgcaatgtaatattttttaaaaatccaagctaatgccaaaaatgtttgataaagaaaatatcaaaattttaaaaagactagccatgcttagtcatagaacctgaaacaaaaggtaaaatatgtgctgctgccttaaatggaagcaactcataagtcatatttattttttgagacagggtctcgctctgtcacccaggctggagtgcagtggcacgaccatggttcattgcagcctcaaccgcctgggctcaagcgatcttcctgcctcagctcccaaagcaagattttcaaaatctactttgtttatcttggttccaactgagagaattgctatgtttgacagtttctcttgaccaagtgacaatcttaaataagttctaactaaattaacctgaaataaaataataaggaaattctgtttgggcatacataaaacatttaaatttaatataaatattataggttcgaatgtatcttcttttcaatttttcaattttttcaactgctttgatgttctgggaaaaaaaaatatacacaaaaccatgtatatagaggtacacagttttcttttgcctgaggcatctcgggcccctaagttccgcataagggatgctttgcagaactaagcatgattaatgtgaaaatcccccataaatccagagctcaggagagctcagcagagctcagatcatctgtgacacagtaactagtttcagcaacaggtcttgtaatttttaaatataggcttgaggaaacatataaagatttgctcttattctatcaaacctcaggggctccccagaaatagaatattaattaaataaggctaagtaaagtatcttcccttctatactctggaaacaagatcaaaatagaacaaatttaactgcatttggagagaaggcagatatggatgaactaaactcaggtatatatatttaaatttcattgtggttaattctattagtagccttcacaaagtttttactggaaaaaaaattaaactaaaattaattttaaaaattagcaaaactggtgactagtgtatcaagagcatggttgaagatctgtactagtctgaaaaaaaataaaatttcagtactgaaaaataattgtattgtttagctagatgttcatcttattgaatgacaaatctgccttcttcattctgggggagcattaggctttcttctaatttaaaggtatcacatttaacttaccaaatatcacatagatcatttcttttaatctttcaaagctcatcattaaaaatatcttttttcacaaacatggagtgttatgtgacagattataatttctgtttttcttttactaggatttttcatatcagaaagggtttcaggaaattttcagacaagaaatctaactttaccagtacaatgtaacagcaaagagtcctattgagtggcggtagctgttggcctcaataccctggaaattatgaagcattaactgcccctgcccccctcccccaacacacatactccattcaagaaagtctttccagccagatagttttagaaaaagcttatgtggaatagagaattccataatgaaaaattctaaaatgtgtgcatatatgccttctatggaaaggcattcaagatggagggagaatgtatcacattaccccttccttcctcacaccttcactatgattcacagcttctttataaatttgcagaatgttaatttgaagatgtttttatcaggccctctgtaaataatgaaaacaacactgtctgatcttcacctgtcataagtgctccatttgccagagacattaggagggaattaataaggactaaaaatgaggggaaaaatttcaccaaaggcttatgcccagggtgttagcttcatcatccagtggagagtttagagccatgtcagttcctctttgaagtggggtacctttatccctagcaatctgtcaaagggaggctttgtagaactgatggtgattaatgtgcacattcttcatgattccaaagctgctccagcagtggattcctttcccagtaccattgatataatccaagatggatgatacaatgctttcagttccaacagactggaacttatcagtcatatgattaagccaaggatgaagccaacacacatttgaaacctccacagttcttcttgctggggtagctcagcaaggtgctgggcgggccccatccggtgattgaaccggagttttccatttgtccccagaacaagttctgtgcttccggctgcagtgcaggcctgcccacagtaccctgccagcatgtttacgccctgacctggagggaccagctaagggtgagaatgtgactcgctctccatgcccatcccttgcttgtctggttagctgagattggccatgcatgctgtatgtagatggtcctggggtttgggggtctaacggggaaaccctccatgcatggaggcaaacccatgtagactggtgacctgtccacccaacctcaatccatgatgctctgagactggaaagagaagccaccaggcacttttggatgccaacttatgtcaactggcaactcattcacccaacattctgaacctcaatccatcaaactccaagacatacaaagagatgtcactatgtgcttttagactattcctcatctagtgaatcactgatcagagtaaaaatttcatgtaaatagatacatgagtattttaatgcctttatttgggaccctgaactcaaaactatcttcttagggttggattatcctagagtcaaatctgagagaaaacattgtggttgcttatctcatttttcggacatatccaaaagatggtatggttttctagatttgacactgagtgtcctgtggaaaatcactaaaacctcccctcctgggcccatttctccaccagtgttcagaaattagagtgctgccaattggaactggtttgtaggaaggtaatgcccactcaagaagctcccagagctgactcacaatgatgggttttagccaccatcaggcaccctggtcctggcagacaaccacttctctgacagttgtagcctgaaaggtagtttttctttcttttctcacttttatctctaggtttcagggtcagagaaatttcctttcctataaacttttaccatccacatttccactacactacacccggatttattcacaccctgtcttcttgcagaatttctggattataagaatttgttttttgatttgtgatttttatatggaaaatcttacagaactttatagattttacctgatttataaatttgacaagctgcttttacaatagcttccataaacttagaaatgtttcagaaactgggatagaatagaaagatttagaagtggaaaatggaaaatggacagacacaggaagcacaggtgtgtaatgaaggtatccacaatgactggatgcccagcccccattacaggagagacatgctctgaaaggccctcacaattctgcttccaagtctctggaaatttctccggactccagcctccattcagcaatcctactctctctctgttctgtgtctttacttccaattgtatcacctaagtgggtgtatgtgtatatgcatgtgtatatagttgcatttatgtgtatatgtaatatgtgtctgtgtatatgtgtacatgtctatgtcatatttgtgtgtgtgtatatgtgtttatgaatatgtatatgtgtgcatatgttgatgcatgtatatgtatgtgttcatatgttgatgcatgtatatgtatgtgtttatgtctgaatatgtatatgtatgtgcgtgtgtgttgggtatgtatgtatatgtgagtatgtgtatatatgttgatcctggatttgcttctgacagatataaaacaatagaatgacactatttttttaaaaaatctatgaactgcctatgttgttatgagagttctgaggagtgaataaaacagcttttttttttaatcggtgtgctttcatgtgagaagataattcttggacataggttcttaggcaaatttggctgccacttcctgacctctgctaagacaataaaatgatagggaaatattttaaacattttaaaaggctattaactctaagtaagaaagagcattttactactgatttgtaataatgttgaacactatctaccaaataaattctagaagaatcccaaccctaactgcctctgctgctagagagcatggtattcagcattcagtcagctccttgtttctttcactcaatcccagactcaggtcaggaaaaaggagagttgttaacagtagcttagtacagtgcctgccacataattaactctgtataaatattaacttttactctcctcacaggccaaggggatatttcacataagtatatttcccaaactgcttgccatgtgtactcacactgtatctcctcccatggctgggatacactggggggtggggaaactgtgaaaagaagacatcgtctctcattggatgccccctctgtctatgtccctggctgtgaccccagccatcccaaggaggttcagagcctgtgtctactatgagacacctcatctacctctacctccagggattcgcttcagccacccccactgtttcctccctgatggagggcccagctgtggtcactttgccggcttgacttaggagactgaaccagaagagcagagaacactacactggtacttcctacccccctttcacttcaaaatgttctgatccacaatgggactacactacattcagttgtctggatcctgcttaaggcagacagaggaggtccaggaatcggctgggatggggacacccttcctccttctcctaactgtggcctcagtcaccccaaggtcaggaccaccacattcactcccagggcagccaatgctgcagttttggctaccatctttggtttccctcctgatttggctcttagcagacctttagcccactgtcacatctacagattgagagaggaaaataaggtttggttattagaggttcccaaacatccccgtgcatcagaatcacctggagggattctttaaaaaatttgctggccccaccctgagtttcccttttaataggcagagctgactttcagggctgtgactccacactcagaagaagcccacatttggtttactgatttgcagtggccatcttgaaatgcttaacgctttttaaacacggggcatcacatgttcattttgcactgggctccacaaatggtgtagccagtcctgtcagtaggtccagaatggagctgtagaattggcattgccaacaagttcccaggtgagacagatgcagccaccctgggatgcacttcacaaccactcaatgagatcttgcagacctggaaaatcatcctcatagcagtcctctggctccttcccataagattacgtgatgagagttcaaagaggaggcaaggaaggggcttctttattccatgttggtaggaaatgtcctcagcaaaagggttcaggcccgtgtttgcctcagttacggctgtggcagtatcacagaagctgggatgtttttcccggcgatattaacccctgctggaaacctcagaggaagctagatccctgtgaatgcacttcctccagtttgcatgcacaaaaccatttggttaggaaagtgttgttcaggcatgtgtttaccttctttaagaaataaaaaggatttgttttgaaaaattaagccaaaagagagcaaagactagtaaagagaagtgaagtaagggggaaaagatgtaggttctggaacttttaatcaatctgtgattgtttcccttcaagatgttgtcagggccagttttgaggagggtagaaaagaaagatgtttccaggtaagacttcccatgctcttttcacgttgctcaagttctcatttttctgttccacatacattttcactgttatttctgtttctgtgacaactcatgaacacagaactatgataatggtatactaattagtacatcatatcagtttgtaaaagcactagtgccttgtagaatcattttagatgtatttgaataaaatggagtctagtgagggtcatatatttattgtttttgtcactactttatacatgaaacacttattcccaccggtggcatcaacatctttatcacatgaaggatggatttatttacactaagtacagtaagtattttggtgggatggaaaagttgtccagaaagccataatgaacttcaagcaaagtgtcaaccatagttttatctgaattatttttaatgcaggatattgaggaaagtgaaagagttatctactagtgtatccttacctaatagatagtgagcatcagactttcacttaaaaatggaagcaggaatgagtccctgaggcacttagcgatgcccattggcaaatgcagggctccttgtcggtttcattctcaccgtgccttctccatcattgccttttcctgttatatctgttgggttttactgccctctgctggtcatatcgttgaaaccctttcacgtcatggatgtacatgtcttggaacattgctcaaaatggtctttttgtttcagcccgtgtccacgcatactcctccagtcatttgtgtaatagccatattgtttaaatctggtcactacttgttaacaaactcacgcacctgtaattgtctcattgtgccagaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataacagtatttaattcattgagtttaatgaactaatccatgtaaagccctcaacgcagcacttcaaatgtaatacgcactcgataatacttgctgtgtaatcttgtgtgcatttcttacctgctccttacgctagttgcatcgtctgtaaaatgatctgctgggaacctcctagggatgaagtgagataacgcatgtgaactgctgaacacgtggaggcacccagtagacgtctgctgctataaatcgtaattataatcccatcatgggattgtagtgaggattaaatgagatggtgaaaaagcctaatgtagtgccttactccataaatattgatggataagctaaggggatttatgagtgaatgcatgcatgaagaaatccagtgataccaatagcaaagtattcctgaggatagtacagaaactctattgttcctctagttctgtgttaatgtgtttagcacctataaagctgttgtcacccatcacccttctattcatttcctataacatgcaaacttattattttatggttctggaggtgagaagtctaaaatgggtccacagggcctctttcccttctggacgtcctagggcacaatcgttttcttgccttttctagcttctagaagctgctgcattccttggctcgaggccccttcctccatcttttaagccaacagtctagcaacatcttctctcctacccctctcttataaggacccttgtaattatattggccccatccagataatccaggaaaatctccccatctcaagaaccataatttaatcacacctgcaaagcccttttcgaaaataacatctttgtagatttgtgggattatgacacagatatctttgggggggcccttattctgtctaccacgagcatgatatagaaagggcctttttgtaaatcccaagtagaatgaacacgctgaaaggtggatctgaattgtattctgttttgtatacaacaggatcttgaatacaatactttgcacagaagagatgttattaaaatgttcattgatttttaattttccttttgtgttatatacctttttatacactttttccctagatctgtcagaggagcctttcgatatctggggaacttggcattcaacattaaaaagcggatccaaagacccaggaatgacaggtgaagtattaattttaaactttattgcatttacttttaaaattattttctaaagttttctttactatcattatattacatgcttgtcaaacattacttgggaaatgctgaaaatgggaggggatgaaactatccttaggctttccacccaaatatgccaatctttgactatatttttttccatttcctttgcaaaggttttcatagttacagtcactctgtctgtgcaactttgtattattttctaacttccattttccagttactctccattatcctttttaagggccaggggtattccacagagtgcataatcatagcttacaaaccaatactaagtcatttgaaattttttgttattgttgtaataagttacactttcaggagcctcttttatgtaattaatttttcaaattattaatagattcacaaaattttggaaagcaagtcaaaggttataaatcccaaacagggaagtgcgtcaaatataacaaggctttccaagaatctggaggtacagtcacctcctgtgctgtatgggacccactaccttacattctgtaaactgtggatggcaggagattttacactgctgtgtgcaaatctcatcagtattgcaagttagtgggttttcacttttgctaacttaaaaaacaaaattgcatttgttaatttgatttgcatttctttcctaccagtatttttcagtgtttctattaatttgctgaacttccccccattgaattgttacttatatcatttcctatttatgtatgccagtgttttttaaattcttatgaactctttatataataaagatgttaactctttttccat

SEQ ID NO: 16929 - DNA, 524032 bp, Human; identical to SEQ ID NO: 16928
  misc_feature (1)...(524032): n = A,T,C or G

SEQ ID NO: 16930 - DNA, 524032 bp, Human; identical to SEQ ID NO: 16928
  misc_feature (1)...(524032): n = A,T,C or G

SEQ ID NO: 16931 - DNA, 524032 bp, Human; identical to SEQ ID NO: 16928
  misc_feature (1)...(524032): n = A,T,C or G

SEQ ID NO: 16932 - DNA, 11349 bp, Human
tcatcctctcattcttagaaggtgagaaaaagtataagatcaatctttctaaaactacaaggctactagtaattcatcattgacttcattagtagagattacccacaactttgtagaaaaaaaaaatatcctgaatcctttcagacactccaatatatgtaattatataaaatgggggaaaaagattgaaagtgaataaaatgtgatccacattttccttcctctcccttaccaccttgctgtacacccctgccaatcctcctaaggtccattttccaacttccttcaaagggaatccttcttgtctctgctataaaattcaccaataaatatattcataaataaagccaaatcctggggacatttggcttttagaatcatattctatgtttcttttcatgcatacattttacctgttataatcttctacttccttctttgcaatctctctctccctgattggaaggtcttacctttctttgcaatattcatccctactgatttatccccaaagatcatcttggaatcttgtttattagcattctttaaacatttactgtatgccagctgacagggttggggagagtaataaatagacttccatttccccagagatgtcactcatctacttttcacatgaattccctgagctaggttctgttattatttccattctacatatcaggaaattgaggctcagacaggctaagtaatttgtatatatacgtataaacatatgtatatatacaaactttataagtattacttgtgtattcaaagagatccaagtataacatcaactgtatctgggtagatattcagtatctcctttattgatctaatattgatggacgactcgtcagttagctcctgccactaattacaactttgctcaattagatcaatctaatcaaattccagaatgaaagaaaaagcccatgtgttataccaaggtagaggggtaaaacacacatgaatttaataggtagatgatcagaggttcttttagaaagtgaatagctttggtcattgcttagggaaaggggaggctgctgagaacatggaaacaaagtagctagccagacagttaagagactctgaaaaatagagaggaatttgggtttgcctgtatgagaaagtgggattgggccagaaggatatgggcaaagaagggccgccatactgagaggccaagctgctctgtgagatgggaggcaaaggacaacatcccctgtgacatgagtttgcttgtaaaaaacaaaatttactttaaaatgtgctgtctggtgtgcactccttgccttgtagtatagatcatcagtaaaagctttgctactgcaagaaccttaagttcctgattgtttttacggtagatgggtttcagcatggggccgagaaggggctttgtcccctgttttggtggacaccagaggggtgataaaggagtagccaaggggaacagagaaaaaataccttcaatggaagcagataatagagcagtggtgatcccaaaattataattcctcagagagaaactagagagagctttggggttttacccaaatgggaatttgaatcaatttctcctgatctgaaagggctggaaaaatcctggaggatatccagattacactagagaatctcaaccacctaccttgatttttgtaaagaacaacgttgtttgctagaactgaggaaaaggcgatggcagagaagctttttaaaaataaatctgaatatatcaacatgtacagtcaactaatttgctgacttcaaaatagcgtgatgaaactctttgcctgttaaacctattattgcccataatgaaagattccatatgcactaatcacaacatacagccttatgtctgatcatagcttctaaaaaatcatgatacagggatttttagttatactcaacacatttttcctttagaaactggattggttgttacagatgccatgaatgatataaattgagcttatagttggaagaaatctaaaggatcaagcatccctgagtttcaaacagaaacttgcactgaatacattcaaaggtatgtggattttatttataatttgatatcctttttattgtgcttatttctttctctgcatttcttttaaaagatataaatgtattctacatttctaatactatatgccatcaatagttactttttagttggcccataattaaattagactctgattactgaaatgatttttaactttataatgcaacaaagtgcttgtctaattccaaaggtctttcttggccacatttcacagtaaaatatttattttaattaattatcgattaaagtaaaaataatacattcacaggctgtgatctactactttgaaaagctttttatttaattacataaaatagaaccatccatgaagtgttttttctcattaacccaaacaaacaaacaaacaaaaaacaaatttaggagttagaaaactttagtgtacttttcatagacagcattatcacatgtaatattcacttcttatacaaaatttaaggtctttcttctgacagttttcccagtaatttgtgccacaaatcaatgtgcacattttaggaggacctgttttgcttaatgtcccaagggtcttatttatagaataattacagtgcaacatcaaacaaaatgaagattccattgaaagaaaatgaaacctcttagggagaaagtattcaaaattcattgaagaatcacataaaattcgtaccatcctctcctgttggttcagccacatcttttgctccacaatctggagctcagagatgttactggagggtcttgcctgaagttctgtagataggaatttctggaactaaaatctatcttggcaaattaatatattttctcaaatgattagtccttgtttttaacagtagcaatgtccaggtagactgtgcacgagacatttctgtgcctccttgttctaaaattataaaatactgtgcactttgatgatcttcccaacctttagagccaactttattcctttaatcattaattataaatacaatttagcttctatgactaagggctgtataggcataggaaaatggcatgcaaagtcatatgaagatagatcattcatgtccctgtaacttgtttagccctcaacctaaattaaatgcatctttatcactactgtgactccagaaacaatgaaataggctgagagctggaaatcacatatgactgaagtaaattcacaaacaatggctccatccttcttactagcaatagactaatgtagattatgtgtgttttatggagcattcattacatccatgtttcagaagagataagaaaagtggatgttgacttacatttcagaaccatcaagaaatggggacctggattttatttgcctgcctcctgggagcagcttttgccatgcctgtgagtaaaacaccccttgcataagtcagtgtccaatttcacaaacttggacataaaaatctgctcatagttggtgaaattagggtttaaaacagtatgagatcagatgtcttcatatgtctctgggttgaagaaacacttcaggagcttgttttaaaaaggtatattctcaaatgccgctaccaaaaattctgatttggtacagctggggcggggcccaggactctgcatttttataagcaccccaggagattctgttggaactgttagcttgtaaatatcaccacccatctctagatggaggaagcttttggaagggacccttgaaaggtctccagagaaagtgcttaaccagctttggacaaatattacagagatgccagttttgtctaaaacccaattcctctcaagattccaaatctcttcctgccctccacatattgctgctcttacccctcagggggtaagatttttgtgttaggaatccactttttgagccacattcctgttctcagaggccccacccctttgggtacatctgatgagtacgtgacttttttgtggttgcccgggatcctgcctacacccaatacatagtgatatattttatattcaaatgtattaaagatcaggacattagacccactctgtctggacacaggtgcataagggcagagaacttagatcacatgcatgccaagcaggctgcatctgctttttggtggaataaagagcagttgatacaaccagaagccagcaagcttgcacccttgcctcctctcttcctctctcacccacaaaaccaagattctgtgctctgacttcctgaaatcctgcattgcagcgattcctagtttcctcaggggtccctgccttacaaattcagcccttttcccactctctaagatggtattgttcaagagggtataggacctgactaaaaccattcacatccagatgagagagaataaaccttcccatgaaatgtgagcatttttaaagaatataatagagccaatcctaaatgaggccaatgtctgagggagattttctgcatgaccgtctctcctccctggaccccaggcacaaccagagttccacaatacaggcaccagacacttgggccccacttttgagaggacagacagtcctgattcagatcatcattcaggtggccttttatttttaacttgaaaatttttctgccataaaaccgttggcagaataataaaaaaagatcggcctaaacgtcataaatcaactctttcattttccatgggatttataatgtttccactttgctccacccatcttgttctggcattcatcaataattcccaccttgtggtttcttttgtggcttcttttgttgtatggaagtgttgtttactttgcatgtcaattatgagaaatccctttgatacttaaaagtacttgaccacctcctgatctacaagggaacattcgtgagacaattctctccttgttgatatttctttattgtgaaagagaaacacacttctctccccattatggggtgagttttatcagcaagtaaactgttgggcaggatagggtaggattcattgaaaacactgggcgtgggggtgggatgctgtccaaagatcactggagaataaatgtgtgctggtttctgcttccaggtctccagccataaggctataaccccaggaacagtcatttagctgttctgaacctctttaaaataaaaggtctcctcttctatacagcacatttgttcaaactaaaaacagacctcaagtatattctgcactatatagatttttttaaagtagcttcagtctcctttaatgtgaacaattgcatactgacttaatctcttcctctctcttctcttccttcactctctcccttcctctctctttctattctcctcccctcctccctgtaaaagctaccacctcatcctgggcaccctggttatatcaacttcagctatgaggtaatttttctctttactaattttgaccattgtttgcgttaacaatgccctgggctctgtaaagaatagtgtgttgattctttatcccagatgtttctcaagtggtcctgattttacagttcctaccaccagcttcccagtttaagctctgatggttggcctcaagcctgtgtcgtcccagcagcctcccgcctggccactctgactcagtctgtcctcctaaatatggccgtaagcttacccatcatgaaccactactcagggaggctccatgatagggcaaaaagtaaactctgaccagcttggttctaacccagctagtaaaatgtaaggattaggtaagatgttatttaaaactctttccagctcaaaaaactcctgattctaagatagtcacactctatgtgtgtctcttgcttgcctctgctgaaatattagtgactaagtggtataggagagactccgcagaacagcggaatgcatgagttttggacgtcgggtttgaggttctcctcaacctcttactaactttgtgattttgggcaaatcatttcctctttctggaaccctggtttcctcatctggagaaaggaaataattataataaccatatttcaaaatattgtttggagagtaatatagttaatgaatatgaaaagtgctttgtcaagtataatatgagcaaggttactgattattttttgtatcgattaaatgccgtattactatatgaagaatcctcaaacctaaggctaaccaagtatatatactgttcagaaaggaataagattcttacttctctcacaggttcaggtaacaatctatgagtttatttacttataaaagctgaagacaaatgttagtaagattttgaggcaagattttctgttgaaccgaaaagattgacacatctgatcagtcaatctgtgtttctaggatgagggacagtgtttgcacctctctttttcccattgtgacatcaaagaaaaaaatgaaattaacatcatgtcatattattatgtcataattttgtgtttgttttgctcttacaatgaaaagaaggaactatggaattaaacagatttactccctgtgtaacctcagtcaagttaatgaatctctttaactccccataaccttatctaaaaagtgagagtaataatacttgcctcctagcatataagaaaagatgaagaatgtgtgtgatggatgtaaacacagtgcctgtcacacaggaagcacccaacaaatttttaccttcttctttcttttgtagaactcacattctcaggctatcaatgttgacaggactgcattagtgagtctatatttcctactgcatcagtgagtttctatattggatgaaagtaaattaaatcaaatgggttctaatatctttttctcttaaggtgcttacccctttgaagtggtaccagagcataaggccaccggtatgtagacattttgttccttattccctgaaaatattaggcatgcattaaaattcccatattaagtgaaatatcatgtctactccacatgcagacattaatgggaaatttagtttgtaaaaaatcatatctgtgtacacagttacaaatttttgcaaaggaaaaatgaataaaatattcctatagccataatggcaaagaaaacactgctgcttctctggttggagtcacctgagccaatggtaaacctgcctctctgtttctcaccagtacccttcctatggttacgagcccatgggtggatggctgcaccaccaaatcatccccgtgctgtcccaacagcaccccccgactcacaccctgcagcctcatcaccacatcccagtggtgccagctcagcagcccgtgatcccccagcaaccaatgatgcccgttcctggccaacactccatgactccaatccaacaccaccagccaaacctccctccgcccgcccagcagccctaccagccccagcctgttcagccacagcctcaccagcccatgcagccccagccacctgtgcaccccatgcagcccctgccgccacagccacctctgcctccgatgttccccatgcagcccctgcctcccatgcttcctgatctgactctggaagcttggccatcaacagacaagaccaagcgggaggaagtggtgagtatattttgaagccactacaatgcaaatcctgtgaaaatggtgcagcaaaataggccccagagttctaaggtctccgacaaccaaggatctagagttgtagtagttacaggtctatgattctattagtccaagcaatatgctatacctttatgttaaagacaaattcctctaaatggcttggtaattaagaccacagtttttatggtaggtttcaattttactattactgaatttctaccagaatatgtattaccaaaacccattaatagaaatatatattactaaaccccatgaattttaagggcaacagtataagggaatatcagttctccttatatttcaaaggtttgactagcaagaataggctagagttgcactgaaggcttaagacaagagggagcggataattttgagagtgcaaatatctgaacaggctacaaaaggtagacgggaaatctcttcaaaaacctacaggaagattccccatttccagtagttttcaatctaacttggaggcggctaaactaaacatactgttagattccttttctgtactggggttctatagatgattaagcttttagcaagaagttactgcaatttagcactaaatcttccattacaggtagctcttacaaatgaatgggaatagtcaacaaaacaaacttaatctacatccataaagtcttacttctatgtatacgagattatgtgatcctatcatgtatatgtatccaactgtaattccaatttatacatgttattgatgatttgctactgagaagaagagagaagtgaggtggaaatgaccaggataagaagccaggacacaaaggttccaattctggctttgccctcaaagacgaggcagtattgtaaaagttacttcaaatgtatcggtgttttattttcttttaaatgggggaaaatgacgaaatcagattattttcaagtctctgtccaattataaataccatagtttctgaatttaaaaaaatcataatatatgtcataaatggcttcataattgtgagcatgtttacggaaaatatggggcagaattttttgaaaattgattgaatcccaagtaatcggtgcctatcattggctattctagtccaaggcacatgttctctctgtacatagaaaatgcatttacttctttatgaataattaataccatgaactttataatgtgctcacatcttgacaaagctatttatggaaaggtgactttgggcagatagtttgaactctttaaaactcagtttctttttgtgtaaaatttgagtataaacattgatagtttcttagagttgttttatggaaaacaaaatagcgtgataagcttggagcctgacatgcaagacgtaccccccaaaaaggtagcaattgttattttattataaaataataggctttaagtgtcctgaaggtggaagcagtcctcatggacacctaatatctaatgacaacgaaataacaaagaaacttcagaaattatagagttcaacttaaatggttgtacattgttttgacaaaactgaagccagacatgttattgtaaatggtactcactaggaacatttgtaaattattttaactgttcttttgcaatttttttcaggattaaaagatcagaagatgagaggggaatgaatacttcagatgctttcaggagtgacacaagaacacaatgatttttgcttataatcactttacttagcaaattctgtaactaaaaaagtaccattagcagacaataaaatgcattaaaaatcattcatgtctttgtgttgaatgaaacttaaattttcctatcatttgagatgatatattatgaatgagtattcttgaatcaggtaggaactgctcatttagtcatacaaattcaccatttggcaagcaaataaggaatatatttctttttagagaaaatttaaattatactgtctcaaatcttttttaaaaaacaaagtttatacatcagttaaaacagttgataaaatgaaaatttatgaatatgtacaataactaaaacctgaaccaaatgaagggaagtttatatgaaaaattctttacattaagaaagataaacttttgaagaatgtttatattatgaaacaaaataggacatggaacactggctttacacttcacaccacactggcaatcaaaatctggtcttttgatctcattctatggaaaaagatttttaaatgaaattatgtgatatgcataataatgtactgaatttaaagttattcaagtaatttgttttcctcaaaaaatgttatcaatggagcttcaaatagagaattgcagtgattttaaacacaagtcatttctttcacctcataactttaagataaattgtactgtatagtcttcaaaatgttaacaaatgcataaaatggactcaaaacaagttttctttctcactcatatttatatttgaatccttttttcttcctacacccacacagaattgtaaacagtctttgcagggtttatattacacaaacccatggtaactttattccagtacctttatgattaaggccccttaatcattttctggaatgaataaacataactttattgggagggtgtcaatattcaaacaaataacttgattttaaagaatttagattcaattttttaaaggtagaaaagcttttaatcaattggcatggaccaattctaatcaattgagtcaatatttattaagcacactctagggcaaggcactattccatgtgctggtgaaaagagcaaggccccatccttaaggaatctagaatctaccaaaggggtaaaataagcccacaaataacaattaaaaaggccaaatggtattaatactatgacagaagtacagtcaaaacactctggcaaatatggcaaatatccttggctagctgtccaacagctttcctcaccactcctttcctgttggcagagctggaatcaatcccagcattcagccacggtttccaaatcaaaattcagatacgtagtgtgataatacagaggaatgtttcaaaccagagacatacattaactggtaattatactctaatacttgcactgtcaaatatggtagtcctgtcctatgtggctatttaaatgtaaataaattaaaattaaataaaacttaaaattcaattcctccgtcatagtagacacattttaagcgctaaatagccacatggggctagtggctaccattctggacaacacagatacagaatatttccatcaccattcagttttatcagacagcattgctctatgtactacttcttgaagttgaaaaataattcttattaattcaaatattttaaacaaaagatgaaacaaaacagatttgctggttgaaactgaaaatctcagctacccacagcaagttgttccccaagcatgccagtaatcctgatcctctatgagaattttctaagaactgtagaagtgccattctcttcctcaggccaaactttacatactaaaatggtttcccctctagctttcatttagaacagataaatccagagttcagaagatatttacattcttttctattttgtggttcaaactaatagtgcaacataacatagagggaggcacacattcacgttacacacactcacacacccataaccacgcatgctttctgggtttacctgtagtaaaaagacacatgtggagacatgtgccatttgagtaacttgaaattttaaataaaacttctttccattacaatcatttagagaatgattatg

SEQ ID NO: 16933 - DNA, 101011 bp, Human
accaatcaagccactagtcaaattgcctttatgtttttcaaactctgggcatgtgtctttttcatgactaaaatgagatgtggaaaagctgtggccttctaacaaatctaggaataagtcttgctaccccccagtttaatttgaagaaagaagctggaattccaacccagaacccagaaattttgacctaaatctcctcagtccaaaataaaaaggaaccaggaatatgcagaacacttgttcgtaaaagagcttagtacccatgcttcccactataagaaaggaagcatttctagtgtagccttacagacacacaggcatggtggaaaggattttgggctttggagtaagcaagtttggtttcagtacccaactcctcttgaaactgaatgatttcagttgtcataaaaggtacctctcggccgggcgcgatggctcacgcctgttatcccagcactttgggaggccgaggcgggtggatcacgaggtcaggagatcgagaccatcctggctaacacggtgaaaccctgtctctactaaaaatacaaaaattagccgggcgtggtggtgggcacctgtaatcccagctactcgggaggctgaggcaggagaacggcgtgaacccgggaggcggagcttgcagtgagccgagatcgcgccactgcactctagcctgggcggacagagcgagactccgtctcaaaaaaaaaaaggtacttctcaagcaacacatttgatatcaacagttttttctgagacagtactgacatagaaatcccctctagttcttagaactaaatccaagaatctttgtgtttctccttcatgacttgaagtggcttcttttctaataaatttagttccgtgtcctgaaaccagggtgggtacagcttctctaaaatggacgaaaaaatcaagtcacatgacagggcctgaagagggaaatgatttttgcaacataaccaaatttaaatcctgctttggctgttgaaaaccagaaggagaagaggtaaagaaaaagcaaacgcaagtggagacagtttgagtgctgggttcttcaggttttcaatttctttctgccctgttggctttgacttcattctctttcttattaggtctattcaatggaagcagaaatctatgggacacgctgatattagccaggaagcaccatttgttgaaaaatgaggatgagataaaagggttaggtgcctttagttactaaattccacggttggcaaaagctattcatccgtcggtgacaaccacagctgtcgtggcctccctacggccatgttttgttggactcagccttgagatcctggtttgtgacgtcccactctccatcgtatacacctaagcactcttcgatagaaccctgtgagctccagaacacacaagaaaaggcaccgaacagaactgtcccagagcaggcattagtttttcttctgctacctatccagacactcagactaggaactcggtgccgtttgctgggctgtcgacaccatggacagctcttcaggcgccacctggttggctcggcgagccgaccgtcccgagcccttcctcctctcccgtcaggcccgtgggggcggcggggttggtcctgacgcccagcttggggagcagcaatacgcagccccccaagcttttctccggagtccctccccggcgctcacgctctgaagagcccacgcaaaaggaccaaggaggccagatcttccctctccctgcacccccggcggtgggatcgcagctctgcctgggggcggccgcaggaggcaaaggtagctggagactgaggctggggccgcccgcgggtgccaggcccagccggtcggcgcagagtgggcgtggtctccctcctgatgccccgccccttccctcgcgcggggcggatcttccgcccccggccgcggcgcaatgcggaagagatgggcctgctggagcggaagtgacgctcccggcggctgtggcggcggctgcgggagaaggaggaggaggagccggaggaagaggtgagcaagccggcggggggcggggagctgctgcggccagacccacgggcagccgggcgggcggacgcctccaagaccagtctctgcctccgcagcgtcagcgggagcggtgaggggcgaccgcgagcagccggggtgcgggaggacgggcggggttgtgagcagaccactggttgtgcggggtgccgcgtcaggctgggggctgtggtgacagcggctgtcagcccgcccgcgggaacgaaccgaatccgcctgggcgccggggtatctcttctggcgcataaatggagggtttgggctgctcggctcttccgtctctccgagaaggagccgctttcccgggcagtcgactgcccgggacccccgaggagccccagtcgggtcggtgccccgagtcgtgactcttcccgggtggccattcgtatttatcggccccgcctgccgtccccccagccggcggtagcccggggcaggagaggcggcggtaacctgtgccttttcccttgcccttcatcgccacccccgggagagcctgtcgcgtgggataatccttttccttctcctgccccctaaggagctttgaaccagccttgtcacccttccctcccacctccgctcctttcacctcgaaggaactgcttgaagtttccaaataggttccctttcaacgtagtgacagatcttgaagcaggaagctgataaacagctccggacgaaatacgctcaaaatttttcctttcagtaagcataaattaaacgggaaactcaaccagaccgttgattgacttacagtgctaaaaccttgtcttgccttggtatgagaattgatagcttttcctcttgctttttggtaaaattaagtgacgacttatcttttggaaaaagccattttctcccagagctgtctgttttttcccaccccaaccccccatcaaaacctggcggggagggacttttggatgctttgcagtccttgctgcagaaggaaacatcagcttcatttgctttgctttgcttggttttcgcagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctgtaagtcatctgttagagcccaatttgtcatggtctctgttttgatttgaaacaattcagatgcaaccattttttagaaaagagcccgacaaccctttcactgtatttcctctagcagattatgcttgtatttccttttaatcaaacttattttcctgcaaactttttgttaacaggtttttgttgagggggtgcagggagatgcaggttttggttgcaggattttgctttcttgggttctgctgctgcttctaaaagtaaatgttttttccaaagaaatattgtttcagtttgtatcatgtatcacataaacccatacagtgtcttgcttgacatatttactggtaggtcagttatagtagtaggtattatctaatattatccaatattgttggagtatttctgttatggccgttgtgttttcattaagggaattgtaaacaacctctagattttcatgtgagatacatgattgattttgtattatttttaaaagtattttgatagtctaatttaaagaaaaggactattgtaccacaagaaaaatagattagtaatgtttgagttattttaggggcagatggatgaaattaaaattaatttggatactgggtctttcttaatgtaagatatgccaggtgtgggggctcacgcctgtagtcccagcactttgggaggccaaggggggctgatcgcttgaggcggggagtttgagaccagtctgggcagcgtggtgaaaccctttctgtacaaaaaatacaaaaagtagttcggctccgtcgtgtgccctttagtccccgctacttgggaggctgaggtgggcggattgattgagtctggaaggtcgagactgcagtgagccttgatctcgccactgcgctccagcttgggcaacacagtgagaccctgtttcaaaaattaaaaagaaaaaaaagtatatgattatatatacacatatatatgatttaggcaaataatcctagtgttgggattagtttagttactgattatatctttataaattaaaaatagtgtttgaaaggcatacttacaaatataagcccttaaatatcttaaactactaagctttctccagcctcaataaatgaagagcataagacctcactctttgcatgtagaatattaatgtcagttaaagtgttaacttgactaaatagtataattgcatcttgatggggaaaaagatagtgacataatgaaaagtcttaagcaaagaacagtatataagaaatatatatttggtacatatattttttgaatgaaggagaaggggctctaggtcttccaagaaataagtataaataatattggctatactcaatcagtatggacttaattgcttcaagttgttttttgtatttaaactataccttggtacagtattaatttccattgcatatattttttactacaagtggaattcttatactgatgaattctgaattaaaatattgtgggggttgggtggggcgaatgtttgtttttgtatgggaagcatttttcagctgcttgtgttttttggtgacgttacctgacttactaatcttgtataaattctaaatgtttctttaattatgattactcataatagcaagtcaaatgttcagctacaaactgtgtattacttatagtttttagaattattgctacactttactccaaggttaggaaacctaagaataataatatttccaaaacctccagcagccgtcttttatgccaaataatggtttgtttttaccaaaaggccctaaaacatttattttggcattaatgtgcattctaaggagaaagaatattaaaatattgtctaagctattctattttcattagatttagactatgtgagcaattcagaaaaaaaatgttggaatattgactctttctgtaaagctaacataaatggatgtctaatctcttggaatgtcattatctttcctactataagctttacagtaatacttaacatattaatatttaagcagctaacaaaccttcttaagtcatttgacttttaaaattaatttggccttcattttggagtgataccaaggtttgtattgtgctgtacagtgttcacttaaaatcttcacactttaaaaatgcctattgtattcagaagctgtgcttggaaaatatcaatgtgttctcttcatcttcaataatcccagctccctgaatttcagtgcattctgcatattcatctacctgaagaatcttctaaaatcatgttttttctttgtttgtttgcttgtttgttttttgagacagggtctcactctgttgcccaggctggagtgcagtggcatgatctcggctcactgcaacctccacctcctgggttcaagtggttctcctgcctcggcctcccaagtagctggaattataggtgtgtgccaccacgccttgctaatttttgtatttttagtagagacagggtttcatcatgttggccaggctggtcttgaactcctgacctcaggtgattcgcctgcctcagcctcccaaagtgctgggattacaggcgtgagccaccgcgcccagccctaaaatcattttttatattaaagcaaagtgtaaccctgtttttcaccaagattaagtttgtactcctcaacctgtcatttgtccagtgttgatctcctttaaggagatctggtgtttcctcagtgccttcccaagcaccatgcttttttcagcttcatcatactgttgctttttacaccttcttcctccaagacagctagagtgctgcttctctaatctgagcctgtcagtcccaccgaggtcctactcaggtcttcttccttcataagactctgccccaaccactccagctcacctttatctctaccttctcttcatttctctagaacttactctgtatcacaaggtgcatacttcttttttgcttttattttttgagacatggtcttgttctgtcacccaggctggagtgcagtggcatgatcacagctcactgtaattgaactccctggaactcccgggctcaattgatcctcctgcctcagcctcctgagtagctgggactacaggcgcacacgactatgcccagataatttttttcgtatttttttgtagatagggggcttcctcatgttgccctgctgatctcagactcctgggttcatggtttccacctgcctcaggctcccaaagtattgggattacaggcgtgagccactgctcgcagccaagacgcatacttcttatgtgctggttttgttgttgtctaaatgctcatatgtaggtgtttttcttggaaaggggtggtggaagtgaccttagcaggacttggtctttatgtacacaaagttcctaatttcaagtctctacttgccctggctttactttaaaaagtaaattttaaacagacattttagtcagcatacagtgttgaggattagcaatcacttaattttcttggcctttgctgaagtgccatgagatacccaacatgaaattttgtctttcatactattagcacataccaaaagattgcaagtaaaaatacaatgaaaatagtctcatacaatggatccccttagggacccacgtgttcactaatgcagcctcaagactctgtctttatgtcgataggattctaagcttaaatcagtcatgatgttatgacattatcagtgttacagtcacctgggcagcttttacaaatactactgtctgggctctagccccctggatattctgatataattagattgtgatgctcatttctgagcaaagtgtatttaggcctttctatgatagattaggggattgcttttttttggcttgcagattttatccaaaataaccatgtttccagaattttggtgctgttgtcttttatggggctactaagtagttttcttgaaactgtcaggctgaaccaagtgctaatactcttgtagcactttgagtatagtgccttcatatcatatggaattctgctcaggttctgtgtctggatgccgcactccttgaggaaaaggcctgtgtgtcttagtaatatttgcagtcttagtgcttagtgtagtgttttactcatacttgaagaaaatgtgattattaaatgaatgacagcaagggaaagactaacctagattacaaagttgataaacatgcagttattatgtttgaaaataagagatatttttccgtaaatttttgttgttgttttttgagcagagtcttgttctgtcactgaggctggagtgcagtggtatgatctccgtgcactgcaacctccgcctcctgggttcaagtgattctcgtgcctcagcttcctgagtagctgggactacaggcgcacaccaacatgcccagctaatttttgtatttttagtagagatggggcttcaccatgttggccaggctgatctgaactcgtgaactcaagtgatccacctgccttggcctcccaaagtgctgggattataggcgtgagccaccaagcccagccctataaaacttatttcatatacatacatgcatacattatatatatatatatatatatatatatttttttttttttttttctttgagatggagtttcattcttgttgcccaggctagagtgcaatggcacgatctcggctcactgcaacctccccttcccaagttcaagtgattttcccgcatcagcctcccaagtagctgggattacaggcatgcgccatcatacctagctaattttgtatttttagtagagacagggtttctccatgttggtcaggctggtcttgaactcccgacctcaggtgatccgcccgccttggcctcccaaagtgctgggattacaggcataagtcactgcacctggcctatttcctatgtttttgagaattgttatctgactgaactgctgatataaaagatgtatattacacattatttagatttgttattgacaaatcctattggaaataactgttaaccacattattaaggttcttctgaaatgccaatttgaaatgtctatgataaatgttacttattatttctataagtactattaatttgtttcaaaattactttttttttttttccaagatggagtcttgctctgtcacccaagttggagtgcagtggtgcaatcttgactcactacagcctccgcctcctgggttcaaggagttctcctgcctcagcctcctgagtagctgggaccacaggcgccccccaccacacctagctaatttttccttatttttagtagagacagggtttcaccatgttggccaggctggtctcaaactcctgaccttgtgatccacccacctcagcttcccaaagtgctgagattataggcgtgagccaccacgcctggccttcaaaattacctgtttaaaatagaaaataatttcattattatttcttctgttgcattgatttatttaaaacactttctaaaaagttcttacccttagataacagttaatatgttttttaggagtgtacccatttttagcattactcagttttgaaaagtatttgtacagcaagtgtttgattaaattgcaatttgatgtctttggaatagtggttcagtgtagcaggtgagctctgtgactagtttgctgcatctaccagtttaagcagcttgtgtgatggttagcaagttataaacaggtacatatttttttcctggaaacaatttattaagagataaaagatgtctctcagctttgtgtacaattcattgttcttagtctttctccagtttacacacacatacacaaagactgtcacaggagaaggacaagctgtcagtctgacatacatgcattaaattcacaatctcaatattttacagcccatctcaggcttcaataaagtgaatgattcatttcataattatatcctaaatagaagatggagtaaagaaaaggtcaacatatgggaaatggaggataactctaaaaacagaagttatggacctctacgtaaaagatggggaggtgaggtggcgccatggattcctaactcttaaaattaaagcttttgctcttttccatattacatgctagcatgggagtaaggatgaattgcttttatctgtctagtggtaagattactttcaggcttttcaagtagcataatttgagtcagattaggactcaaatcatgcattttataaatagcaaggccatatcactgcacctggttttcctccaagttgtccttatgagattctttgtctacctaattttttcttacaacataagtcataatactatatataatactcaatataagtcataatactataggatgatattctgagatctttattacagaatatgaaatatcctctcttttctataaaactgcgtaaaggactaatcgtagtgaaatgataatggctaccacttactggaagcttattctgccagtcacaacattaagccagaggtttttaaacttcattgttttatggtgaccttattatctcattaagttgtttttgtttttgtttttgtttttgagagggagagtttcgctcttgttgcccaagctggagtgcaatggtgcgatctcggctcactgcaacctctgcctcccgggttcaagcagttctcctgcctcagcctcccaagtagctgggattacaggcatgtggcaccacgcccagctaattttgtatttttagtagagacggggtttctccatgttggtcaggctggtcttgagctcctgacctcaggtgatctgcccacctcggccttccaaagtcctgggattacaggtgtgagccactgtgcctggcctcgttaagtttttcacaacacccctaggccacaaacaatacttaatagttctgtttattaaatagttaggtccaaaaaatatttgtgtcccaacagcttttgtagctgttcaaaaaaaaaaatgcagaaaaaatagaacatttattttcttcataagtaaccacaatttactaatgagatgtgtgtgcttgttgagcactgagcactaaatagcttttctttttctttctttttttttttttttaagatggagttttactcttgtcacccaggttggagtgcaatggcacggtctcggctcactgcaacctctgcctacgggttcaagcaattctcctgcctcagcctctcaagtagctgggattgcaggcacccgctaccacacctggctaatgtttgtatttttagtagagacggggtttcaccatgttggccaggctggtctcgaactcctgacctcaggtgatctgcccaccatggccttccaaagtgctgggattacgggcgtgagccactgctcccagcctgcatagcttttcaaaccttggaacagagtacactgccgtcctcatttcctgttccacattgattttcaagtgacacttgcttttatcacagcaaccagcaaaaacccggtttcactaatatatatcatccaaggaatgcactgcaatctaatatgacaactcaagcacctcaggttaatagtttggctggtttccagcatgtgttgagaatctcagtgtttccttctgtttaaaatatgcagcttccctgggagtttgctgtagtgccgtggggcatctgagcacacagttcaggagatgtggcatttgacacactttatttcattcagttcagattgtgcttttatccacatttcagagatttggaaactgaggattggaaagataactgccccaatgacatagtcctaccatttaatttttttttactgtaattattgtttgtgctgttgtgaggctattgtattaccatatattgtgtggctattattttcaggggtggggaatgaagtgtaaaaataagggaaggcgttaaggttaagagtgtaattggtagcattttctaatgagggaactgtacacttgtgtttttccctacaaactattaacatattaatatattagaggagaaagtatggtttaatttacagtaaagtcattaaaaacaaagtttctttcctgggccaagttaaatgtcaggttctagacttttggataaatatagtaggtggtaatgccaaacagtgtgtgtagtttgttttttttttttaattgccaaacgctgtcaacatgattgccctttagataagttgcagtgtcctgtctcttttaaagaaaaatttgcaagttgagggaagaagtgactttttatagttgactttttcagcagagaaatcatgaaatttagacttgttatatatcactttatgttagggttgcaaaaattcattttctttttataaatacctttggaaggtgcatatttattttctttctttttttatgtgcccctgtagtctgaggaatgtacgtatttaatagaaagtaacttaaatgtcaactctttaaaaagaaaatcaaccaaacttttttattctgggttggtagtaggattgacctagggtcaaaccagtagttagttcttaagtgctttcatttcttcaccacttaactttgctatgaggaaataaaaaggaaaggcagaacttccactctcactgaatagtaaaaactctgtggctttttattacatcatctcaggtctatcagatgttctaacttgtcctataaaatatacgtaactcaggactataacgggagcttctgaccatagtggagtaacaggaactagatttaccctcctaccttaagtaacaacaacaaaatgaacaaaatacatggaatgatttgcagaccttgaacaaaaggcagcacaagatgctgacccctgagagaagggaaacaaatgaggtgggttttatgaatgctccagcttactgcctggagagcttccaggccacagcagcagaagagtcactcaagcaaagcttgacaggattcctgagtagggaatatggggaggccaaggcagccagaatctcagggctgtgtactagagatgagacagttgcacaaagagctccagagatctgtagaggactccgtttgagacttcagctcagtgttgatcggtgccagtgtgtaaggaaaccatttgaggcagggaaagaatcaccaaaaaggagtaggcagaaaaatttctggagctcacacagggctgggaatagttcatgtttaacaactagagtggagaagtcctgcatggagaattaggttgagtactgcaaagggtatactgcttcagtaaaggggcaaagtagtcctagactaaattccactccagccctccctaacaaagcttaaaagcaagacccaaagggatgccactgtttccaagtaaccgaacttccaaataactgtatcccagaacgaagtttaagaatatttataggaatataggaaaatatacctcataaggagcaaagtcaaatgtagaaacagatgctgtaatagacaaggacattaaaacagctattgtaaatatactccatatgttcaacaagtagaggaaaaaatgaacctgttaagacgagatatgaaaaatgtgaaagaggccaggcacggtggcttacactgttaatcccagcactttgggaggccgaggtgggcggatcacctgaggtcaggtgttcaagaccagcctggccaacatggtgaaatcccatctctactaaaaatacaaaattagccgggcgtggtggcaggcacctgtaatcccagctactcgagaggctgaggcaggagaattacttgaacccaggagttggaggttgcagtgagccaagagcatgccattgcattccagtctgggcaacagagcaagactccgtctctaaaaaaaaaaaaagtgaaagacccaaattagacttctagatgtggtagggattactatattagacattgtagaagaaatgattggcaaacttgaagacatagtaatagaaactgtccaaaataaaatacagagagaaaaaaggctaaaataaataaatacacagagcatcagtgaactgcaggacgacttccggtgacccaatatacatgaatatgtggatcccagaaagaagttggtagggaagaaaaacacttgaagaaataatagctggcacttttgcaaatttcatgaaagctatgaatccacatatccaagaagctaaatgaacataaagcagaacactatacccaaatacatgatcaagttactgtttaccagtgatacagagaagatcttaaaagtagcccaaggaagaaaagacacacatttacagaagagtgaagataagaatgatagtagacttttctttgcaagcaatccaagccagaggacattgggaacatctttaaagtactggaaggaagaaaccaaaccaaaccattcacctagagttttgtacccaaccacaaatgaagatgtaaagacttttcagacattcgaaggttgaaaaaatatgagctaattataatgactagcagtttaatattgtagtattacctttcttagtatccaataccaacattttcaaaacttttgagattataaagtctgaatcagtgaaattttgaaagaagcatacaaagtgaaagaagcaataaagagtggaatgggctagtgcaattgtttagccttgttagagtatcaaaaggaagtatagttttaaaaattgtgcatgatttttactggtgacaattaaaatttgctttgagtgttttaatggttgttaataagaatttgtattttatctttttccagcttaaatagagtttataaatataagccattgctgatcagtagtgttacgtatgtgagcacatgcattcacattgggttgcatttcatagctactgaaccaaatgatgaatgatttggcacttggagaaaataaatttggcatttggagagatatataaattcttcttggttggatactcattacttcctcagttcagaatgaaaaaattttagacccttgaaattcctggataattctgggccaactgagtcagtgaaaagaaaaaaattaaaaaaaaactttattgtctcaaaacattaaatatttctatatgttaaatgtacttattaaaattttgtgtttctatttcattatagtcttatttaactttttatatataaaggtgtgtttacttatataactagctcttagcaataaatatttattatgagttatgtttcattctgttcactagtggaccataggattgctgtaatctcttgaatgtgttgctgaaatatagataaacaaaatcatttaatatcctgtggaccatgtgtgaactataagtagaatgaatcttcttttttcaattttttttttttttgagacagagtctcactttgttgcccaggctggagtgcagtggcatgatcttggctcactgtaacctcagcctcctgggttcaggtgattctcctgcctcagcatcccgagtagctgaaattatgggtgtgcaccaccatgcccagctgatttttgtatctctttattagagacaggtttcaccttactggccaggctggtctcgaactcctgacatcaagtgatccacctgcctcagctccccaaaatgctggggttacaggcgtgagccaccgtgcccggcctctttttgtttttatttttaaattccagaatcttataattaaataaatttctagctggttgtaccttagtgctcattagttgtctttccttggttagcattgggaatatatctttggcctatcttgttcccagttttatcaattctcttagagaatggagtagaaagtacagttttcagatttttagttgtggcaaagtgacgtaggattgatgagagctgggttgaataattatgttggatgacacaattgagatccagctttttgaaactcagataatgggttagaacccacaaaaggaaaatgcacttccccttgcaccggattgagtgtttgtgtattcctgaaccaaaaatgactgttgagatatcatgtgctgtttgcatcaggtagatcattggcagaagaaggtagaaatttctgtgatttccatagtatcacaaactgtttggtggctaccaaatgaggaagagttggaataggtaccgtattgatggtcttaccaaccactgcatatcctcaaacctgatctttccttcagtctcccttatgtcaatggattgcactccatctaccaagttgtttcaaacaacttaagaatcatcctcaacacctcttcccctcacatttcacacattctctctattaccaagtctagtcaattcctcctcttaatttccttgagattccatgcaactgcctgcatttagctggctctgtttcaatcaagacactgttgtctctttcatggatcattacaattccctccttaactggtccctctgcttctacttaccacgcctacaccccagtcttttaaaaaacatggtttagatcttattaatcccctgcctaatactcttcagtgattggccactgaagttaaaatctaaactctaagatgacctacaataaaatcgagtttctgcttccctcttcaacctgttaccactttacctcttggtttctatgttctaacctcattggccgcctttcagttctgaatgtaccaaattctttctggcgtcagggtctttacatatgctgttccgtctgctcaaatgtatttttttaaaataataagctttttaaattataatacatgtagaaaagtatataaatcttaaacatacagcttgatatattattatagaatgaacatacccttattaccacaactgggttgagaaatagaatattattactagcataccagagagctttccagagaataatcccctcatgctccttcccagttatctttattatgatctgcaaagataatcactattcagacctcttacatcatggaatagttttaagtgtttttcagcttaacataaatggagtcattctctgtgtattctttggtatctagctcctttcactcaatgaaatcatccatgttgacatatgggaaatcatccatgttgacatatgggaaatcatccatgttgatatatgggaaatcatccatgttgatatatgggaaatcatccatgttgatatatgggaaatcatccatgttgatatatgggaaatcatccatgttgacatatgggaaatcatccatgttgacatatgggaaatcatccatgttgacatatgggaaatcatccatgttgacatatgggaaatcatccatgttgacatatgggaaatcatctatgttgatatatgggaaatcatccatgttgatatatgggaaatcatccatgttgacatatgggaaatcatccatgttgacatatgggaaatcatccatgttgacatatgggaaatcatccatgttgacatatgggaaatcatccatgttgacatatgggaaatcatccatgttgatatatgggaaatcatccatgttgacatatgggaaatcatccatgttgacatgggaaatcatccatgttgatatatgggaaatcatccatgttgacatatgggaaatcatccatgttgatatatgggaaatcatccatgttgacatatgggaaatcatccatgttgacatatgggaaatcatccatgttgatatatgggaaatcatccatgttgacatatgggaaatcatccatgttgacatatgggaaatcatccatgttgtagcaagtggcagtagtttactcatatttgttgcagtgtagtccattttatgaatattaaaatatttagctgttttgttgacatttgctttatttccaattttgctattataaatgacacaagtatgaacatccttgtacatgttttttggtacatatatgtacacatttctgttggctgtattcttaggaatggaattgctggatcacagtatatacgtatgtcgcctgaaacatttttatctccaccgtttatttggctagccttcctgtctcactataaaggtcacttcctcagtgaggtttattctaatcattgtcctcctccaacaaacaatttaaaattaggttctcccattgtaatctgttagaactccattatagtacttactataatttataattttgcatttgtatggttatataattcctgtcttcctaatctgattcctaagaaggtgtcacggtactgactgtttttattcctagaaccttgccaggggcctggtgcatggtaggcattcaataaatacttcttgcgtgaatgaaagttttttttttttccttaaatgtcaccaagattggaatgtgaagtttaaataggacattaatttagatagtttaatatctttcagctggaattttaattacttttgtaagagaaaccttttccttttaaaataatttttctctttatatatgatgaaatggaaagaagctttactgccagctagttatgtgatcttggatgaatgatctaatctctactctttttcttctgaaaatgagaagcttggattacatgatctctaggatcctcatacaggaggttctctggttctataccaaagtgctgtctgcatgcaaataagctcaccacaaactgcagtgcatgcaaccacaggcaaattgtggttctagagagatcattctaacatgcagtcttatttttacattgttattgaccttctttagcttagtcttctgtatcagctggggaagaacagtgtattctcagactgcaaggtttgacccacagcagaatgttgacattggatagtaggcccttcatttggatggctttattatttagcttaaattattataatccatcagaagttggagaaatttacatttaaatttaatcctgaaaatacttttaaagtaaaatgaaagtgacatttaagttacctattgctcttggataagaagttaattttgtttcttttctgttcagatgtggagttagcaatgcaggtgtgattatcatgcgacaactatgttatgtttaacaagcctctcttttagagccacaactcatgaaaatcaagaaataggtatatgattatgtcttcatctgaatttttatatttgatcctaatacttcattatttgccttaaattctaatttgagaaacgaggttgtaatacaacaatgctgaataatgccagttatgtcacatgacatagtattataagtcattgctgggcgcggtggctcacacctgtaatcccagcactctgggaggctgaggtgggcagatcatgaggtcaagagatcgagaccatcctggccaacatggtgaaacccgtttctactaaaaatacaaaaattagctgggcatggtggcgcgcgcctgtagtcccagctactctggaggctgaggcagaagaatcgcttgaacacaggaggtggaggttgcagtgagccaagatcacaccactgcactccagcctggcgacagaacgagactccatctcaaaaaaaaaaaaaagtaagtcactccagaaaaaagaaaaaggtggaggatgtcaaataatatgatagagcacaattgatatgttaaattttgatagagaacaattgatatatttatactctgagtgttttctgtagtctataaatagaccacctctaccgtttctatttttgtcaccttccagtagcttaacgaggaaaagttgtaggttggggctcccttcagtcatgcatgaatttgttcagttaaaagaagtttgaaaacatgcacaaaactaaaataaggaaggagttgagttatctgaattaagttgtaggatattactacctcatggctttatatagttttaaatatttcctaacttctgtgataatgagcaaaaacaaacttattattttccaagtatagtttccatttcaacagttagaatattaaaactaaattatttaggaagaatataaggaaaacattgatggcagggtataacaatatttacccttcctaaggcctccattctggaattactaaatcttttcctttcttaatttattatatatttactatttgatgagtgtttgagagccttgggaagtgtgggctatggggccattctaaagattgtaggacttacaagtccctttgaagtttataaaagtccaaatcaatcaggtgcaatggctcacacttataatcccagcactttgggaggttgaggcgggagaatcgcttgagcccaggggtttcaggttacagtgagctatgatcatgccactgcactcaggcttgggtgagagtgagagatcctgtctgggaaaaaaaaaaaagttcaaatgtctgttaaacttttggctaatgcactcctggtctagggtaattagagaaaagttcttctctgatcccttagaattccagtagcttctggctgtctcaagataattggccagagttatctctctcctttctgaatttatccaatagttcaaagaatgtaataatttttttaacattttatttggagaaatagtgtaactgttacatatgtcacctagcctccataatatcaactcatggacacttttgtttttctatatttctacctactatctctccctccttatttatttatttatttatgtttttatttatttattttgagaaggcatcttgttctgtcactcaggctggagtacaatgatgtaatctcggctcactgcaacctcaacctcctgggttcgagcttttatgccttagccttccaagtagctgggattacaggtgtctgcaaccatgcccggctaatttttgtattttttgtagtagagatgggttttttaccatgttggccaggctagtctcaaactcctgacttcaagtgatcctcccaccttggcctcccaaagtgctgggattacaggcatgagccaccacaccccacctgatttccatttctttcacatgaaacacatggcagtgagaattctgtcaatactctttaagcataacataagtacatgagtttaataggcagtgtttttggctggacaccatggcttacgcctataatcccagcactttgggaagccaaggtgggaggatcaccggagctcaggagttcaagaccagcctagccaaaatggtgaaaccccatctctactaaaaatacaaaaattagctgggcgtgttggtgggcacctgtaatcccagctactcgagaggctgaggcaggagaattgcttgaacccaggaggcgaaggttacagtgagccaagatcgcgtcactgcactctagcctaggtgacaagagtgagactctgtctcaaaaaaaaaaaaacactccataaaatctctttcttttttttttttttttttttttttgagacagagtcttgctgtgtcgcccagggtggaaaggcggtggtgtgatcttggctcactactacctccgcctgccggcttcaagtgattctcctgccgtagcctcctgactagctgggactacagttgtgcgccaccacgccctgctaatttttgtatttttagtagagacagggtttcaccatgctggtttcaaactcctgacctcagtgagccacccaccttgggcctcccaaagtgctgggattataggtgtgagccactgtgcccaaccggcagtgttttttcttaagtcagtaaaaattttactgtctaaaagcgtgttggatccatgggtgaattgaaatatatttctaatacataagtaagattggtttttatttagctttttaattgttctgtgattaacaagccattgaaaaatgaatcttgttaattgttaaaatcttcttattgtctttatatggcaagttttggttatccctcacctgttacatattgttccacctttattttttattttttagaggtggggtcttgctatcttgcctaggatggtgttgaactcttgggttcaagcaatccacttgcttggcctcttaaagtgttaggattacaggcgtgagccaccacacccagcaaaatgattctttttgggcccacaaagaagtttttcttttctaataaagagctggtatcaaatgaaaaaaaaaaaaggtacctaagaaaaggtatgaatgaaagatggtgttgagtatgacatgggaaaaatagtcttttcctttaaaataagctatagagggagttaggtactatttattcctgaggtgttatagcagaaactttagaagttggaatttgctttagcttatgtgttcagcatgtgaactaatgcggtgcaggccgccttacctcacctgaactgctgtcgatcttgatgggctcagaatcactccgaaagcaattctcttctgggacattcctacctacttatggttagaaatcagtaacttacaaagaaaggtttgttttgcctagcatctcgtttgtttaataaccaccatgaataggaggggaaaaaaaatacctcttcacaaaagggagtttattccattcgttgaaagtgcagtggatgccttgaaagactgcactagcaggaaagtgacctgaacttcctccctaacacggtatcttccgaactttcatttccgctcattctttcagtttgtttcctctgagctccccacacaccctgccacttcataaacttcagtattttaaaccctagttagcaaccatttaacaatgcctatatttcccacccccaccttactactccctgccacagacatacacatttgaaagtttccagacgtaactgaggagttgttgaatgtgaatctcagtaatgagggcattcaaatactttcaatgataaagtaaaatgttttacctcttttttgagacggagtctcactgtgtcacccaggctggagtgcggtggcacatcttggctcactgcaacctccgcctcccaggctcaagcagttctcctgcctcagcctcccaagtagctgggattacagacatgcatcatcacgcccacctaatttttgtatttttaatagagacggggtttcaccatgatggccaggctggtttcgatctcccaacctcaggtgatccactttatatattatttttatattagcaaaacatgttctttaatgcacaacctttccatttgtttttgtctattagatgaacatttaatcagcaattgcagtgttccattcagagtctctgtgttaggttaggtattgtgttgagatataaggaaatgaggctaggtgcagttgctcatgcctgtaatcccagtactttgcgaggccaaggcaggaggatcacttgaagccagaagtttcagaccagcctgggcaacatagaaagaccctgtctctacaaaaaataaaaattaaccaggtatggtggcacgtacctgtagtcctaatactactcagtagtagtcctgtagtattagtgcctgtagtcctagctactcaggaaggaggctgaggcaggaggatcacttgagcccaggagcttgaggttacagtgagtcatgattgtgccactgtactccagggtgggtgatagagtgagatcctgtctcaaaaaaaaaaaaaaaaaaaaaggaaaaagaaataagacttagtttctgttgttactagtttacatgtaactatagtataaaataggagaaagatttacctccagctagagtgatcagggaaaatctttgggaagggaagtggtgttttaatttggaactgaaggataggtaatatttggaaacacaaagatgattaaaggttggtccagatgaaacaacagtatgaaaaaagggagaaagggaagagaatgtggaacatgtgggcaacaaaattattcattttggctgaagcatgggatgcaagggagattattaagggaaaaagaatgatggtgatgattgtaaaatatttccaagtgctgtattttatctaaagattatacatattattttatgtaatgttgtatatagcctttcttattttaaataatctctttatagtagaagattctaaaataattttctggaattaaattatcagagaagtggggcagaaatttaattaggttcatcccccttccatcatgtatttttgtgaagtttatggagtctcataaaataaggaaatcttttttccccattaaaaaaatgtacagggagggaataacaaggtatttagaagagtttaccttattaacgtcagagataaaagcttctttatctgggaataagtatatgtatttttaaaaattatttttgctggttacattgaaaaaattttaattttgcagcaatttaaaacataaagaaaggttgaagtatagtacaaataactttttttcctctggacttctttttttttttttttgccccagaactgagtggattctctggactttttaagaataggttgctgacatgatgacccatcacccccaaatactttgctatgtatttcctagaaagacattctcttgtaaaactatcataaaattaacagtgatgtattatggctatctaatccttatcctctcttcaatttttaccaattgccccaacaatgtcttttatagcaaaaggatccagttcagatgtgtacattttattttgttgtcatgtctctttagtctccttaaatggaaaaatttctcgatctgtgacatttgtggccttaaaaatgttgaaagtgaaaaccagttactttgtagattctccctcactttgggtctgtctgatggctcatgcgtagattcaggttattcacctctggcaggagtattgcagcaatggtgcttttttcatagtgtcttgacaagtggctcgcagttttgacttgtcctcttactgttggtgttcactttggtttgctgttgttgttgagacagggtttcactctgtcggccaggctggagtacagtggcatgatctcagctcactgcagccttgacttcccaggctcaatcaaccttcccgccacagcctcctgagtagttgggaccccaggtgcatgccaccacacctggataatttttatatttttttgtagagacagggtctcgccacgttgcccaggctggtctcgaactcctgggttcaaggggtccttctgcatcagcttcccgaagtgctgggattacaggcgtgagccactgtgccaggcccctgttggtgttcactttgattacttgataaaggtgatggtttgctaggcatgtcgggaagactttttttccctttataattgttttgcccattcctcatgagactttcaattcataggcttataacccattactcttattatttattttgatgctcaaattgtcctggatttcaccagtagaagccccttcaagctgccttctgcatgtttgtgacatatctcaattatcctttgaacacttgcttactttttggcacaatactatgttttaggctcattttgtccctgcctttgccctggaatcaaccatttctccaaggaatgctagtagttccttttagtggagaatggtatgtagaagccaaagtatgctaggtatgcgcattgctgtcagagtattgtagatcctgggtctgctcagtggctagtgctaaggagtatatgtaactatatatgtatatgacatatatacttatatctgtgtttctatctttttgtctgtctttagtctatctagaaaacactggtaactccaattctttttttttttttttgagacagagtctcactctgtcaccaggctggagtgcagtggtgcaatctcggtttactgcaacctacgcctcccaggttcaagtgattctcctgcctcaacttcccgagtagctgggactacatgtgcctgccaccacacctggctaattttttgtgtttttcgtagagacagggtttcaccatgttggccaggatggtctcaatctcttgacctcataatccgcccacctgggcctcccaaagtgctgggattacagacgtgagccaccatacccggcctggtaactccaattctaatcaacactgtccattctagtttctctgtttgcatttgtgagtaccttctctgacagtgagaaacctggctctcattatccttgatcataccccatagataaccactctcctattgccagtgtagcctcctccactgcataggtgccctccttaccccactggcacttcaaaaccctgcctttcccatccctctcaagctctaacttaccatgccggggtgcccctaacacccatgggtggacagtcctctcctcaccctagtcagacttcaggaactcatgccaggcggcccctcccacaagtggacgcccttttcccctgcctctagcttcagcttcttgcacaggccatccttctcctagtggccattactgggcctccctccagtctactcaaaacctttgaagcatatatcgtaaagtagggaaacatctactgtccttcagatacaaatgtatttatgaagaagatactgttttctcttaagaaatttggagtgtctggagttaaaagtacctttggctctaagagtatgcactttaaggtgtgtgtgtgggtgtgtgtgtatcctgtttcctgagtgtccgaatagaatacaaacatgtaaataactaaactgcaaggcatttgtttgcatgtttgaattagatgatagtctaatagatgggccttcatcagtcctgagagacatacgtttatgtatttggagtgtaattaatgagaagatagttattatgcattattagaagagagaacattttgttacatggtaatttaagttatagaatgacttctctgttttctaaaggaaggtggtgacttaatgttaagaatatgttttttgcccatgcctgtaatcctagcacttcgagaggctcagacaggaggattgcttgagcccgagagtttccaaccagcctgggcaacgtagagaaactgtatctctacaaaaataaaaaataaaaaaaattagctggacatagtggcacatgcctgtagtcccagctccttgggaggctgaggtgggaggattacttgagccctggaggtcaaggctgcattgagctgtgattgtgtcactgaactccagcctctgtctcaaaaaaaaaaaataaaaataaaaataaaactatattttcttcttaactcctactgcctcctggcatttgaacccaaatgatgattgctgctgaaatggatatatctagtactttctatattactatattagtgattgtattttaaatgtatatggcatataacttgtaaacctctagaataatatttatcctggaagtcatgccttctgtcctgagaggtataacaagtctctctaatgtttacagtacatatggtactcttaacgaggcagtatttagaaggcaattctattttgctttataaaatgtaattaaagtttatattgtaatgttttacatttgggttgcttgtcatggaatgttaggatcaactgttggataaacataagatgtaataataataggaactcaaggaatacagaatgaaatataaatccccatcactttaacgggttggcgaatctccactccctaatttcatactgggtggtttgataatggcccacacttaataatgaacatgttagagaatcgtgaaaatatcagctaattgagtgactgagtcagttagtcttagcctgtgctgcaactagcagagcaaaactcatcagaaggcagaagccagatcactaggaagaaggcttaagcctacgtggtctgaaaagaggtgaagcaggcagggaaagtgagatgttctataggactctggagaagagcttcaggcaaagtagaagatctctaatgcaaagtacaaaggagtattaggcaaagcagtaggctgagaagagcccttttgttggcaataaagatggacaggaaatgagacagtcataagtatctacttacgtgattttctaacgtggaacacgtcagtgttgccaaacatcctattttgtagataaaggaaaggggataagtgtaagagataagaagtaaataaggtatgaaccagtcagccaggaggtgagttgagtgtggtgtagataatggaaaagggaaaaaagcaaagaaggaaagaaacctggaaggaaaggaaggtatctttctcaaggatcaactgtagactgtgggatgtattatttgtatttgtcctttgaaatactggttgttaatatttctttggttctttgtgaaatttttaatgtgtaattgctaagtgctaggaaggttttttctttaacgtttcaggatttgatttttttttgttgttttttcttctcaatagaataatcataatagcctgtcttaggaaaattattctgtggtttatattcattaacaaggtaacgttaactttatagcagaagaaataaatcaaggcaaagaccagacttttgtcctttcagaatcagatttccctattcttgccctacatttgtgtagtcaagtgttgccattagcttttatcatttaaatgttttgtcagtttctaagtgtcgagcactattctgtcaagaataaaagggtaagaagacagagttcagatcagtggacaggatggattaattaatagatggtcttggaataatttattaactctttgggaagaatactaatgttactagtttaagaaaatatgcagtacatttattttaagaatatcagatttagaaacttttgattgaaactctggatttatacttagctaaatagaatccaatgtttcaggtcatttttcttaaactaaaacttttttttgtagcatctgcagaaaaagaggcaatcaagggtacatactccaaagtactggatgcatatggactcttaggtgttctgcggttaaatcttggtaagtttatcattcagtagaattcatccattttttcatttctattttgtaattctaaggatttgagagggactagctatgaattattgtagactccatatttaagctacacatgtgctaacatcttttaaacattaatgtagctaatattgtgataatgtttgttgcccaaaaaggcgtgctacatgctcaaactcatgtgagtggaagttcggagacagtctctggtttgaccacttgaagagataagtatcagttgtcaaaagagaaaatcagaacattctcctttttgttgattcagtgcatttaggaaaaagtgtctgcatgagaactacactgatttttcttggtttgtattggaaaagacatctgttttgaattcagaaagtgtctgcttgagccttttttttttttttgccacgtaatgtcaccgtgagctgcagagtaacctttgcagttactagtttatctgtaattttgcagctcaaagtgttcttcaacattggtactggtccataaatcattttgttattgatccgtgataagataaggagcttgcactatgatacaaatcaacatgtggcttccttcattgataaagtcttactagaaaaaaaagtcagctcaactaaagggtgaacttagtaatatagttgatttccattctggtgtaagtgtcctttctcattgtgagctggtaacagttcatggaccatactttgagtagcactggtctataaaatggagatttgtcatttgttatgaatctatcacatataaagcactgcgcttaggtgctttactgattactcctgggtaagcctcacagtataatgaggtatttgctttaatctctttttataagagatgatatctcaggttcgttatgctacatactgaaattggtccaggtaataagtaatggagccaagattcagggccgcttctacctgtgtcagagcccatgctcacagtataccattgctcaatttcaactttatactaatttcataggctttttgtcataattacatgaaaaaaatctctgtgaaagtttttgtaaaccaaattgctttataagttgttaccagagacttttgtccatttgtcatcaacatcatcagctgataatagtataccattttttcaactttactatttacaaagaacttgttaaaatgagtgtgaattcattatcttacctgaattttctgacaatcattaagcaaaagtagagaaggtaacacatacttttttatttgataaagtttttttcttgtttgtttgttcgtgtggttttttttgagacgtagttttagctcctgttgcccaggctggagtgcaatggtgtgatcttggctcactgcagactccaccttccaggttcaagtgattctcctgcctcagcctcctgagtagctgggatcacaggcatgcaccaccacgcccagctagtttttgtatttttagtagagatggggtttctccatgttagtcagggtggtctttaattcccggcctcaggtgatccacctgcctcagcctcccaaagtgctgggattacaggcgtgagccaccgcacccagccaattattcgataaagtttttttagcctcagaataagttcaggaacaatttcgtgtgagattatcctgttaatgtttaaatgctttattatacttaatatatttaaacaaggatttttttcaactaaaatgtctagtgaatttcaacacatccatgataagtttaaaataatcacaatgtcagatttaaaaaatagaggtgcaagaagaaatggaatagcttgaaaatgttgggatttttcatccagtaaaatctttgggttttgcaggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggtgagttcattttttcccttttggtgatttgggacataatatgttcagcagttgttcagtcatcaaaaacctcctcaccgtgacagcaagaaaggaggaagaaccctgaagaccctcgatgccccttttcagcagcaagtagctacagagaatgacctctacctcatctcccaaaagatttctgggtcccaacgccttgagggagcaatgtaagagtagacagtcagatatgagcaggcacgagggggtggtatacgtgttggaaagaatgccccggaactcctcttaggatgctcagtactcactccgtggtcgaactgtcagaatgttgttaagtagatcctgataaggaaggaaaaaggcaaaggggaattcctgagagctgagcaggcataatgagtacaaaattgatggctataccttcctggggtggtggtaataagcagtgccaccattagataggattcatattgatcactggttcccgtgcatgtgcattaagcacagtaagggaggatcccccaaaccttggtgagaactgggtaaagaaagaactgagacaatagaagatcacaatgcagaatgtcttgggggtgtttccagcagggtcagcccactcctttcttggagtgtacttgtacttcctcaataaaacttttgcttgctttacaaagaaaaaaagttcagcagttgttatgtctagagataacaagggatagacattgctaattgagtgtatccatctttccttctctggagtcctcagcagagcatggcaggcagccaatgtcggtttattgaagttggcatgtgacataaaacccctgtgctccccccagtctacactgaactttcatttccaaaatacatttaaaatagttgtgtatatttagaaatgaatttaattgtaacaaaactgtgttactcacgtttcctattcttggttttgagatcttgtctctggcggcattccctttctaagccaacattcccttattattctaaattttaaggttataagtaggtggtcttgattcaagagcaacagattgtgaagaagtagtatactgggacaaaatctagtactataataagttaggacttatgtaggtaagtgtgatgtatttcatgattatgcataactgtgctgtattctaagtaggcacaaatggtgagcagaacacatgggactataattagcattgttctattgcagcagaccagatttctagtatagtggttctgttgtttacagccagcattgatgttgactttttctcttgatatcatgtgcaaattatgtattattatattgacatatgttataaggccaaagttcaggactctttgctcttggcctcccttaacagttcagattcaagatggtttcctcttgtgtactttttctctctcacactttcactgtcacttatatagtccttgagtagcacattcgggtgtcacccatttgccctagctgtcagaagactcaaagtcaacaacaaacttaggataagaaacttaactttagagcaacagcttggtcacgttgtagctcacatggaagtgttttgacccagagtggtggcatcagggagaagagtggacagaataaaaacagggtttatagcattatgtgttagagacttgggtttagcagaggaggagaccatgagggagaggaaaggagagaggggatgcagggactaacagggcagatgaatggacatgagttcctgcctgcccaaagaagctagcagtgatgggatgtacttttgtgaagcattgagaaataggcttccaagagttaaaaccatgccaacactacattttttctagtagaagatgttgaagtcccttgaaaaggtaaatgtgttgcagctgtccttacatttttttccctcctcatttttacccaaagtttcttagattgagagataaaagctttcatacaacaattagaagtccaagcagatgcagatatattgcctaggtttaatcaataggcatgattaattggatggttggttgattgatttttttgagtgtcactctgtcgcccaggctggagcgcagtggcgcgatcttggctcactgcaaccttcacctcctgggttcaagcaattctcctgcctcagcctcctgggtagctgggaccacaggcgtgcgccaccacgcaggctaatatttttgtgtttttaataaggatggggtttcaccacgttggccaggctggtctccaactcctgacctcaagtgatcccccccaccttagcctcccaaagtgctaggattataggcatgagccaccgtacttggcctcctttttttttttttttaattcacttaagagtagagatgggggcaaagtcagataaaagaaagcctgagatttgtccagcaggagacaggttgaacaaagggacagctagagcaccaaaggtgaattttgctcattttacaattttgctaaggattggcattcttgagcttcagtttatatagaaaaacgggaacttttggaattcattgtgcatacccttgcacttagtagcaatattttccaggatacaaccatgtaatttttgtagccaaagagtggcagatacctgtgacaaagcccagatagctttactccattggaaattctaagctgctgccagtcaaaagtcatgtataaatttaaatgctaaaacagtgacacactgacagcaaagaaaaatgaaaactgacagcagagagagaaactctgcctgcacaaaatgcataggatttaaggtctatttaaatgaggacaagtaagtttcttataactttgctgtggcgtaggtctcagctgtggtggttggacatactgggtcacaaccagtttgaactttgcctcagatcaatgtgggtaatagtaaagtatggaagtttaagtcagtgtatttttaaaataagtaatggtcatcagatttaacattatccctgttgtaatatcatcactcatttatattcccgtgtgatttcctggatggataagaggggttggggtcatagctggttttccagaactgctgaccaccctttttatctctgttgcagcctgtaatctgaggggctggcagggagttggggctattgctgtgagtcttcaagataatgctattacatcttttataccttatttaagacaggaagagagagagagtacggagcacttaagtagaagaattccacttaaaacctaaagagtcaagcttcaataatatagaaaactcattttcaaattgatagagtttttccacttaacaatgtattttccttagtggtatattgttagtagcttctttatatgttctgtggaggtctaaggttccaggagagatccctgaggggtaatcagggtgagaaggccaacccagcaaagttcagtcccaatccccactttagccatagcagcttttatctgtatcataatcattgggcttctgcatgtttgtttgaataaaatttgtttctctgaaaaaagtttggaaaccaggccacatctgttacctagaatgctaaaagtatttggagcgatgataaaccctatgcctgcactatctaatgtggtagccactagccacatcttgctatttaaatttaaattaattaaaatagagccttataaaagtcaagccttaaaagtagagcttcatgggcgggcgcggtggctcacgcctgtaatcccagcactttgggaggccgaggcaggtggatcacaaggtcaggagttcaggaccatcctggctaacactaacacggggaaaccccgtctctaccaaaaatacaaaaaattagccaagcatggtggtgggcgcctgtggtcccagctactcaggaggctgaggcaggagaatgacataaaactgggaggcagagcttgcagtgagccaagatcccgccactgcactccaacctgggcgacagagcgagactccgtctcaaaaaagaaaaaaaaaaacaaaacaaaacaaaaaattagcccggcttggtggtgcatgcctgtaatcccagctacgtgggaggctgaggcagaagaatcgcttgaacctgggagacagaggttgcagtgagacgagataatgccactgcactccagcctgggcaacattccgagactccatctcaaaaataaataaataaataaataaataaataaataaataaataaatatttttttaaaaagtagagcttcataaattggggtggggacatgcatatgtattcctttttggaacaagttaggttataaacacattatatataaagacataacagaaatgggccacagatactaaaaacacaaaaatactccttttctgtggatcatagatcacatgttgaaggatctcgttttatagccctatcttctgatccctagcatagtaaatgtaaatgaattgatttgttgtttgtgcctttaaatttaataatattaaattaattttccaggagattattttaaaagtcatactttgttacttagtattccataagctaatcatttatttcttttcctattaggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggtatatatagtgttttatattacttaattaatttattataggagaagcacagaaaatactagaataacagatttttatttgattcggagcttattttaacatctataatgttttatgattgttcttggttacttatgggccttaaaaaaaggcttccctaaaaaaaacttattttggtgtggctcttcatctaggtaagaagatgtcactaatcagcatgacatagtcagtgttgtgtgttttggtattgaattttaatgaattttaaaatcctcagctgtagagttagacaacttgtttttttgtgaagtgaaattaaacccagctcttaatggcaaatatgtgtaccatctaaaaatcagaaattatgatatttttggctatgaaactatatgattataaattcaggccatgaacccagcccaacacagatcttcaaattaggttataaagagctaaacaaaatgaaatataaagatatgtatgtaaaatattaagatttaaaaggaatttattttttaaagttgtgaatcttatgcttataattttactaatttttttggttaatatcgctaacagaaaaaaaagtcaaacctgtatagtggcctgttttggacaattgtatatgagagttagatcataaaatgtaactagtatgcaatagattttagtaaatttgtttttctaatgtaagtgtaacaacttttctgtggaaatagtttacatattatttttttttctgtaggttgtgtacttagatgactcagtttcttccttcatacaaatccgaggatctgttccattgttctgggagcaaccagggttgcaagtatgtgtttgacattcagttatttttgttttttgaacaattttcatattttctaaactttctggatagtttattaattaattcattgatggttccattattccatctaataatgttagctggatttgcaaataagggtctagacgagtacagagtttctggaattatcttagatattttttcttttaatgctctttcaaatagccattgaaattgagctgctgtatttagtgttaaaaattttgaagtctttatagtgtattgatttgcaatgtgattccatatttattaccttcttatcttagtatataatgatttagtctctttaggcagaagaatgtagtagataaaacaaagccttgggaaccagacttcttaattgggatctttactctaccactactagctgtgtgatcttgggcaaataatttaacccttgtgtgtctcagtttccttatctgtataatgggaataatattaatagtacctactttatagggttgttgtaaggattaaattaaaagcacttagaatagcacctggcccccagtcagcaccatgtaagggttaactattgttgacattttatttttattcaaaatttattagtccttgaagtatatcatatttactttaggatctgggtatgtatagtctagtaagtttggtgcttcagcctatagtattgagaaaagggaaagaaaaaaaaatctttcttcctttatttgactgctggatctcttacatcttagactggttattgcagagaaaaattacagactacttgaacctttttagtaacattttatttaagacagtctaagagttaacaaggattaacacttctactgctctgcaaaaattcttgaattcttgtcaagacgatttgacttgttttatctttgtagggataacgtaaatagatatatctttccctaaatttcccttaggagagaatgccaacagaaccccacttctcctacgctttcatgatcaacagtgggtgtttggagtatttgctttaagaacattgctgaaaccctgatgtgatgcgaggtgaatgcttttgttttagggacaggctagtgttagagattctaataaccagtttatgagccctatggtacactgtttttatgttattttatttctttgtttaatttatttatatttatttatttatatatttatttatttgagacagggtctcactctgccacccaggcttgagtgcactggtgcaatcatggctcactgcagcctcgatctcccaggctcaagtgatcctcccacctcagcctgccaggtagctgggactacaggcacataccactattttttgtagagacagggtcccaccttgttgcccaggatggtcttgaactcctgggcaaacagttctcctgccttggcctcccaaaatgctaggattacaggcctgagccactgtacttggcctgtgttattttaataagttctgaattacagtgttttgatgatccaataaggttgcgtcctgagtagttacactgagggatcttccttgagtgggacttccttgtgccttccttctcctgtgtgctttccttcctatacggtctggttggctaatgttatgtggtgataggtggaaaattatggattttttttttggcacggaatgatgctctgtcgcccaggctggagtgcagtggtgcgatctcagcttactgcaacctccgcctcccagggtcaagcaattctcctacctcagcctcccgagagctgggactataggcgcgtgccaccacacttggctaatttttttatttttagtagaaatggggtttcaccatattgaccagactggtcttgcactcctgatctcaggtgatccacctgccttggcctcccaaaggactgggattacaggcatgagccaccgtgcccggccaggaatcctcatttttaaccaagttctctaccactcaaagtcaagaacttctattttataagatcctactctaatggctatgaagcagccagtcctgaccaagtgaaaagtagccctgttaccattagtctcagcattgttctaggcagtaggactttctttttattcccactactatcctctgagttaaggttttcataatttcttctagcctggaagattctcacagttttctgtcttgtccctctaggccctgcttcctactagctccgacaggtcttcttatttttgatatatatgttatgcgtgtcagatttactaggcacctatgtccttatgatctggtttactcagcctgtccaacttcaggccttgcagttttctagcaggaatcctctacttccaaaattaagatttattgtccttcagtggccactcagatctcttcactaaatacttgagttcttcctgtgtatgttattttatgctaggtgctatgagagattcaaagatataatgatgcttcatagagaggttgccatttgggcactcaggccttttatggaaaagataaataccaagatgaatttgtttgaggcattataagaattgtcataaggtgttacacaagtaagaatgacatttttagtgctggcaacttacttatgatttcctttgacttgtgattttccttttacttatgatttcctttccctgaagttgtttagcatttataacttataatactcagatcatatattattatactacatttacagtatatatcagtttattagtccattctcacattgctgtaaagaaatacccaagtctgagtaatttatgaagaaagaagtttaattggcttatggttctgcaggttgtacaggaagaatggcagcatctgcttctggggaggcttcaggaagcttccagtcatggcaaaaggcaaaaggggagcgaggagtctcacatggtgggagcaggagcaaaagaaagataagagcgaggtgctacacacttttaagtaaccagatctcatgagaactcactcactagtatgagaacaatacaagggggcatagtgccaaaccattcatgagaactccacccccatgattcagtcacctcccaccagaccccaccttcaaccttgggggttacaattcagaatgagatttagggggtacacagatccaaaccgtatcaatcagtcaaaaaatggtaaacattgtaaggtctacccccaatttttggttgaaatttcagaaatatgtgaaggtaaagaagtaatattgatggaaaatgatataccataccacacaattaaatgatttttaaaaatacctttaatgcaagctttttttttcccccaagttggaatttagctcttgttgcccattggagtgcaatggcacagtcttggctcaccgcaacctccgcctcccggcttcaagtgattctcctacctcagcatcccgagtagctgggattacaggcatgtgccaccatgcccagctaatttttgtattttagtagagacaaggtttcaccatgttggtcaggccggtctcaaactcctgacctcaggtgatccgctggtctcgaactcctgacctcaggtgatccagctgcctcggcctccccaagtactgggattacaggcatgagccaccacacctggccgcaacttttttttaattgggtaaagttatggttatttaaagccttaacactttctggagtgctacttttatcacgattggcaatagctctgttattgtaaaacttttctttcaacattgagtaataaaacctagtctaggaggccatgatgggaggattacttgagaccaggagttcaagaccatcctgggcaacatagacccatatttctacaaaaaaataaaaaaataaaaatcattcgggcatggtgacgtgtgcctgtagtctcagctactcagcaggctgaggtgggaggatcccttgagcccaggaggtcgaggctgcagtgagctatggttgcaccactgcattccagcatggttacagagtgagaccctgtctctaataacacaaaaacagaaatctaatctagtctagccagtatattgctatgagagctgtgatacatagctgaatgtatatatgtgttggggaacagagtggtggaaaacaaccataggcattacctggaagacatgaaaactggatttttttcaccttatgcaccgttgcagtactatgcaaaataaatgttaatcagtaaacaaaaatgctaagttttgaacttgtatggagtgataggcaattaatctgggattactccaaagaaaaagtatcaacttgtgagttttctgcagtctaaaatgcttaatgtcctgggacatacgtctttcaaattttaaacttttatgaatattattaagtaccataaaatgaaattgaacacagatgtgacattaggctaattgatttcttatttaaaaattaaagagagaatcccctggttatcagaatactcattagattatctgacttagtgcagtgagggataatgcttaatgaatgataatactgtactgttaattcagttttggaattggatgagcatattagagtttattttctggttttacttgtccaattacatgactgatttgacaaccccccttttacaccctctttaaaagcactttgcgcggggcgcggtggctcatgcctgtaatcccagcactttgggaggctgaggcgggcagatcacaaggtcaagagattgagaccatcctggccaacatggcgaaaccctgtctctactaaaaatacaaaaattagctgggcgtggtggcgggcgcctgtagtcccagccactcgggaggctgaggcaggagaatcgcctgaacccgggaggcagaggttgcagtgagccgagatcacgccaatgcactccagcctggcaacagagtgagactccgtcccccacaaaaaaaagcactttgttcacaggttagcaagaatgaattttgggcaacttttttgccccccctcagtgatccttgttgtgattgggcaaccttcattccaacgtctcagagagaaatgtttaaattgaagttcagggaaataatctggtctcacctatatatttcttcttggcatgttatatctttctcaattatgcctcatctctctgctattctcctgtgtaagaaaagaaaaattataacaatatacaataggtagatattttccatcttgtttaatttgcttaacccaaaattcctgattctgcaaaatgtgcaaatactataattgggtgatggcaaggttgacttggaaagtctgcttttccaggaaggaatgatattctcaatttggtggaactttggtgtgaatagaatattcaacatagtagagaagaaaacacatagacatttgtattggtaggcagcttggaggagtaggaatttaggtcagagacataaagtctcatctgaatctcttttggaattggttatgttgatctcagatagcaagttattttacctgttggtattttggtttttttaattacccaaatggtaatagtatctgttacacagggcatgtagtttgaacttaaaacaaagtaccatatatgaaaacacctttaaaaatagttttcatcaataaaaattcctactagtttacgagtatttcataatgatgtaacttctttttttgatgaggttggttttttaaaaataaaggtggagggtggaaattccctggaacttgtttttttaaaagcatatcatgaatggaaatcagttatttgattaacgactgtgtgttcagcaaagaaattgttagatattgtaagcagtgatatttctttcgtctatatgttggtttttggtttgattaaatatatttttcttgtctaaggtgggatctcatcgtgtccgtatgtcaaggggatttgaagccaatgcacctgcttttgacaggtaagacaatttttacatagtgctttaagttttgatattgctaagcagtgggactgcttgtatttactgattcacttcaaacttttttggctttaaataaaattcctctgactcctaatttaattgaaagacagtgacacctagtgttacgacttctgggggtggtagtgctggaagtgtgggtcttgatctcttgaccttaaaacttcctctgtgggcgcattgtccagtatagcagccactagccacatgtagctactgggcacttgaaatgtgactagtctcagttgagatgtgctgcaagtataaaatgcacactagatttcaaagactgccttaaaaaataaaaaagaatgtaaggtatctcattagtaaaatcatgttcggtatactcagagtattggttctaccctcacataccaaaatctgtgcatactcaagtcccacagtcggccatgtggaacccatgcttatgaaaagtcatcattcatattcatgggttttgcatgccaggaatactgtagttttgattcttctttggttgaaaaaaatccatatataagtggacttgcacagttcaaacctgtgttgttgaaaggttaactgtagttgttttatattgattacatgttgaaatgatattttagacatgttgagttaaagaaagtataattaatttcatgtttataaatgcaccttcttgaaaatttaacattataggtgtggtttatgttacatttctttgtgtggcattgctctacatagtttctggaatggttagaagctggaaagagaaaagactcgtatttggggcccatttttctgaagactggagctagtaaggaggtccctctgaatactcaacggagtaggtgatgtcctcacatgtgagcagcagccctttgccatctgcccttactgcctttccagtcaagcttatggctggtgtctgtcttgtctggtgccagcctcacagagtgggcagaagctggatgcctccacagctccaacaggggtggaagtctcagtacccataagtcagagaggaagttgcattcatgagttttcgtaaattcggctttgagaccatgtacaatgaattcgcacccagttttccaattctgtgtttaaaatactgccatgtaagttatatttaataatggattattgtttattgaaaaaattgggcttcttatttgacatgtatttatttcctttctttcttaaataggcattttagaacacttaagaacttatatggtaaacaaataatagtaaatttgcttggatctaaggaaggtgaacatatgctaagtaaagctttccaggtaagtatggtcatttcttatttcattctggcccatggacacctagaatggtattaaaaaataaaataatacagtaatcagattcttccaggaagtaaattacttccaagaaaaaggttgggtacttgttggaaacttgaactctttgggtctattaagaaacaatttaggctaatgttgctgaaattgggattctaaaaagctttcaatgcaaatgacactgttttctaatctgcttttttattttgtagagaaacagaaaaataccctccttgccaaaaatgtttatctgtcactagtagagaaatagcagtttccttcttcatctgttgattgctttgcctgcttcctagaaccatagtcattgtttttcacctatggaattgtgaatgatgcatttatatacatgcaacgctataccttcttgtactgatgagagaaaacttgagaatttcatgtcaaaaagaaccccaaaattgcctgacttctaaagaaaaaatattttaatgaacacttattgaattaataatgaattaatataaattatgttgttacataagattataaacttaaacaagattgttagaaaacattttctaaagttcaatctcctaagtccaaaagcatcctgattttatagctatttttttaatctggtgaaataaatattgttaataaacagattatactttacagagtgactttatggtaaaatttaagaatatttgtatgtattgaatgaagttataaaatatgaatctttcagtctttgataggctttgtcttagatgactttgagattctataataggtctaaatagtaagtttgtgttgtaaaaataaaatgctggcaattggaaataattttttatttcctaagccagatgagaatattatttaagtacactgatgttaattgtgtcaccgtatctctcagggatagtttttgaggctttagggaaaagatttattgccagtgtcaatgaaatgtgatgaatatttagatggatatttgcctttttactttcatttagatgaatatttgcctttttactttcagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaaggtttgactgttctgtttctctgttctttgaattggaacattaattaaaaattattcttaacgttgaactcttaaattttctttttaaaattaaagtttataattaaatatcttttaaatatttcattttatttttatttttattattttgaaatagggcctcactttgttgcccaggctggtgtgcagtggtgcagtctcagctccctgcagcctctgccttctggtttcaggagatcctctcacctcagcctcctgagtagctgggactacaggtgtgtgccaccatgcctggcttattttttttttttttttttttttttggtagagacgggggtctccctgtattgccctggctgggctcaaactcctgggctcaagtgatccacctgcctcagcctcccaaagtgctaggtttacaggcatgagccatctcacccatcctatacttgattttaaacttgtttttctttctttagaattcaccaaataataatgagaggttacattagtgagcgcattttatggagcaggcagtgtacttaagtcttttttttttttttttttgagacggagtctcgctctgtcgcccaggctggagtgcagtggtgcgatcttggctcactgcaagctccgcctcccgggctcatgccagtctcctgcctcagcctcctgagtagctgggactacaagcgcccgccaccactcccggctgttttttttttgtatttttagtagagacggggtttcaccgtgttagccaggatggtctcgatctcctgacctcgtgatccacccgcctccgcctcccaaagtgctgggattacaggcgtgagccaccgcgcccggccgtacttaagtcttaacatgtatcaataacaattatagggatagactctattattatgcccatttccatctgctgcaagtctcataattagcaagtgttagaactgggattcgtctggctccatacttcatgctgttatatatgaaactgttttgcttctcttttaaaacttacgttttaatatttcttgatgccagtaaagattattaaatgcaaatagaagtgaaaggctttgtttactgtctgctttagtataatttaaatattcagtttttgtatgtgaaatagaggagaaaagtaaatgttaagagagttaagttcagaatataggttaagggaaactttagtgcagaaagctcaaatttttaatttttcaatttgtattttatttagcatcaatgctgtagacacagtcattagagataacagatcttaggtttaaaaaaattttgttctataaatatttttattttatgtgcaaagaactgtaagagcataaacctgaatgtatatttagtttctaattgttggcctaattaaaaataagtgtgtgatagataatgtaatgaagcatatgtgacaaaatgttaacagttgtcaaatttaaatggtgggtatatggatgttcacagtataattttttttgtatatttgaatactgtaataataaaaagttggagagggaaggtggatgctacattttaattacctcaattattcactgtttgttttagctttatttttgttccaaactggatatttaactttattggttacagatgccagagtggtacagttcgaacaaactgcttggattgtcttgatagaacaaatagtgtgcaggcatttcttggcttagaggtaaaagaataaattaaaatgtatgtgccttgtatcatctgcctctttaagtgctttttgaatacttatgtttcttattaccttccagaaagtgtatgtaatgttatgcttcattttgtacttctaatctctgtctctttttttggccaaactttcttttgatttaaatatttcctttacctgatcttcatattctctttaggtagctctctatctacttctgttgttccttattctcccttttaaaatctgctgtttatagtatttcaacaattttttccctgtcttttggaggaaatatatatgtgtgggtgtgggtgtatgtgtgtatttggccttttattctctgtgttgtcttttaaaaatctattttaggataagaagggtctattttcatatgtacaattatataggactatatttttgacaatttgtaacccaatccagtttgtttggtgttttcaaattagtagctataaaaaaacaggatcagatgaaaatgccatagttagtgagaatgaaaatgaatgcaattcaacttctctgataccaatccagtttgtttggtgttttcaaattagtagctataaaaaaacaggatcagatgaaaatgccatagttagtgagaatgaaaatgaatgcaattcaacttctctgataaggtcgctgtttgcaacgttttttcttttttttttttctttactacttatccatcagattcagcctaagataaacatagtctcaactctttgacaaactatttagcaatgctgagctttctaagtcttccctcctctgcaagttaaggttataaggctgtggctaaacttcgtttagttccatcagaacttaacatagttctcaaatactataaaaaaacagcaataggaagttacatgttcttatttcctttagttaatgatcttaaatttgacctgagtattggttaattagttactttgcagctgaggttctttatctcaaaaatgaaagtacagtgtataaaattctctactacagaatatatttttcatgtaactaaataaattttactgtttggattttttgagtatgtttttgatgtttatttgtaatttatttagaaaatttgacagaaacaagaaaatgaaagcaagcatgttggtcatttagataagagtttatcacatgccttggatttgtttcaagttttaagtggctgaataaatgtacatggattctgataataagcttattgaagtacttggacctcttcatcaaaattataacagatgttagttttcaggatctgacttagctgattctccactgttgatagttaggaattagaaaactccctaggatagcaattggttgacaggttacaaagtttgacaccaagatagacaaagccaaactagtagaggaataagatcagttttgcccagttccttgaagaaagatttaaatgataaaggaggccctggggctcattttgttttattctccatgctagcaaagaacagctctggtgtaagtctctaggtaattaaatgaacccagtttaaggtttttttaatcttattttagcttttggttcttctataattatggatgatcaccatacttacatgataaaataaaacgtaaattggaaagagttaagttaaaatgcaaggcatagaatatgactagattccaaatacacagattggataaagatcgaacattgactctgtcagatttataggctagaattcttgcatataaagatcaataactttttggaacacttttattgttatatgtgataaggacttgtggaagccgagaggtccttgaatttcttgcatgctcttccccctagttcttcccttatatatattaccgatgtggattttatgcataaaaagctgtcatgacttcattcagaagttttacttattttctttattttgtgacaatttaagagcaactcctttttttcattttttttaccttaattacttaaacttataaagccaaatccaaaagttaaagagacctagttatttatgtttaggactaagtaaacttttttttattctaatgcaggctgttgattgatgaattcttttaggtgggcaaggtaaacaactctgatttatagggatactttaataagataaattttatcatttaaccagaaagaagtccttatcaatacttgtagtttccattgatacagtatttgttttaaaaattgaaatgatgggaaataactcagcctagtaaactgttatgttttcagaagctagtcccaaatagtgctataatgataaatttttggtttgattctggtagttcttaaaagccatattacaattaatatattaatgtacttataaaaatttcttgtttgctttttaagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaaggtatatctagatctatcataacattacagaatatcctctttttcctctcttcataaagcttttaaatggccttttaaaagttaatagatggtttaaattaatagatgtgtcttagaattctgtttaatgtgcttttatgccttctttgatacttcctttcacagtggatactagtgaataaatggaagataggtatttccctaagtttgggaagtatgtatatataacgtatctagtcatttagtgacaatccactaagatgatatatattgctctttttttcatgatttcccttgtatatctgttttactttttgtattgtttgttttgattacaaatatgatttttaaaaccatagacctcttaataaagggttctctcttatttggctttgcgttccctgcacttaacacagtgcctactgttaatagatgtgtgacgtatgccacttggacaagtaagtccatcaacagcttatgcagtgcttactaggaacccaagattagggcataattgatctttacttatcttaccttagaaaggtggctatcaagatgtgccaacgaagtgtgagatatgggccaggtgtggtggctgacgcctataatcccagcactttgggaggctgaggcaggtggatcacttgagaccaggagttctagtctagcctggccaacatagcgaaaccacatctctactgaaaatagaaaatactagctgggcatggtggtgcacacctgaaatcccagctactcgggagtttgaggcatgagaatcacttgaacccaggaggtggtggttgcagtgagccaagatcacgccactgcactccatccagcctgagtgacagagtgagactctgttccaaaaaaaaaaaagaatggacttaattataattgtctgtttcatcattactttttatttcctggtattatctacagactactttcttctcaagtatttgtcccttattgagggagtttggaacaatacttgagatagttttcattattttatattcttaaatattgtttaactttttaaggatcctggcctcacttgaatttatcaactttctaaatctccacaatttctcaaattatttcaagaatagaaatgagaacatttatcacttttatagttctcattcagcttcttccatacagcaactgaaattctttaaagaccattcatggtctccaagtcttcttttaatttccaagtcttcctcttctgtgtctcataatatgccatgcctctgcccagaggtattggccttacctgcaaagtttcttttgttcaactcatagaaataatttgtattgacttttacaaatatttacttcttaagtggtccctatttttgtaaacatcaaattgttaaactttgatttattccttttaaacaacataattcttgctattaaaagctgattctcaaactattgcttaaaatattcttttatatacttctaccttttcatttctgcagtgactacaatatatgtacagaggttacatatattttcagtggtcttttatctttaacataatatatagatataaaattttatacattaaatatgctagcctgaattgaactaaaatctaacatctgaactgctctttcttttccttttctctgggttccttttgattaattgcctgataatgtgaatggtgagtgtcttttcaaataatgtcatttgcatatgctattatatagaaagaaataacacttaatgccaaacattaattgcttattaaatatagtagcattcatttaatggcattgaagaaaactggttcttcatttagtggcatttaagaaaattggctctttattctaaaaagaagccttgagttactgttatttctttaaagaataaaaattacatattgcaaactgaagttatttcctaaaagacgcaagttttttgttttgacaatcatcaaaatctgtaagatcaaaataaatcattatggtaactaacatgcctaagtaaaatatatattcattaaaagttataatcaaatctcactataggaataagtttattatcttatgatgtatttttgcatgggcaataaaatgactcaaaatatacaaactgtagtttacatgtaatattcgtttatgaactgtacttgtaaatttcttttgagactagaccttcattcttaggtttagttttaattttaactcatgtaagctatttgggagcaatttccattttctttttctactaccaaagtaatttgaagtttttctaggggcagttaagctcagtgtatcttcttttatctcccatttctccttacccattttatccccaagtttacaaattaccttgtaagaaggaattttcttgttttaaataagttcacttcagtttatttcctttgtaataagcaattttaaacatttgttgccctagatgtaattactggatgaggttgtagcactgagctttttcatttctttgtgcagagctttaatccaaaagaagaaaggaaacagtgacatgttggaggcattttaattgtcatgactatatattcaaaatagaacgattaggtccttttttatactaaaatcatataaaactgatttaaaatttcaaaaaacctaatgagtaaaatcagtaatatttaaaatgaaaatctgcgctcctttcttaacaggctggaaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtggtatgtgcactttatattttatttgttatttatattcctaaaggtccaagaggtaaatgtaaacttatttacacagaatttttagttggttaaaatagtttttgaagggatttctgtaaaggtaatttttgaaaagtacattctccaagggaagtttgtctgttttaaaatatttgtacaatcagtggtattactaagctgtaaactgaggcccttgcatggtttcttctatagattatgattgaggggtaaataattaagcattgttaactttgtacaaggcagtatttcatagaatattcagctagtacttgtaatacagcatttaataatctaattatgcagaaaaatgctttactgggaaaactaatgcctatattggttattttttaaatcactatcccaaaagtttctgtaacttggtcttaacttttaattgctattgtttgaataagcattaaatcatattaataatttaaagtagtgctaattattgggcactaactgctattaccaattttaatatttgaaataaatatatgaccttcagaataggttttcaccttccactgtgtcttttaaaaaaaaacttctcctatcagtgagcacataaaagtagcatgacgggaaaactcaacattcattgtagaatttaatagattagacttactttttctttctctaaaatgtattgaggtataattgacaaaataaattttttccattttaactttttagcactctgaaaaagaaattttttttctgttagccctaaaccaaactttttaatgttccctgttcaagtgggagaaaattgtttctgcatcaagtaatgtattcttgggtaattacttggtcaaataagttatggattattttagaatttgcatggtgcctaaaggtagttaattacggacagttcctcagggacctgtaagtgggctagggaacttagacctactaaaactccaaaaaatgtctgatcttagctactactttcaacttcaggctttcttcctggcttccaaaagtagagacttgactgatttgtgttttgtcacctctttccacctgtgcctacattgatgtggaggcattaataagcaacaattgaaagtaagtggttgaaggaaagaagaggagaaacaagggacctatgtaatcctcaaacttcagcattagtgtttttagtttcctgcgcattttactataagtaaaatcatacctttaaaaaaaagtacagtcagttctgctgtaacgcttgttctgagaatgggaatttgttccaatatgatatattagggaactgtttgagcataaggccaattttgcatgagcttatgcatgattttgctgggaagcaacactaggtaaatgcagaaaagtgcacccagcagaactaagatggctagaaatatgtacaacatataaaacacacatacacatatgcacacacacctcaaacatcttcccctgcctcagttcactatgtgtgttatgagccatacacattcacatctgttctttcaacttttcattgaatttcagatatccctttctccattattcatattacaagctgcactctgcctgatgcccatttctacaagccaacttcattcaagatgaagtgccttattaatggttatattcatgcatttcataaccatttaacatgtataatgtcttgctactatttttatgaggttcccatcttttttgatgtgtcattgttgaagtttttgaacgtggtaccccaaccccatttttcccataagccctgtggctgtgggaatttgcaaaatttgcatagcatggtgatgtttttagaatgcatttttcttgttatagctgaagtgattatacttatcaactgctaagtcccagaaagaatactaaaaggtgtgtattagggcagtatcttccatatcttcaacatcctccatcttcttaggttttcatatttatattcataatattctcaaacatgtgcgcatgcatgcataacatacacacaggagcagccagaagcgcaggcctaggagcttctgatggtgaaacggtggatatcactgagtcactgtaggattcttcttaggtgcagaaggtttgtatcaatcattgtcgtttatttgtaacacttggtgttctatagctatcagaaaaaaataaagtcatcaaattgacttaagtgaggtcttctcaaaatgttttgtcactatactcaacattttaattgtaacttgtttttactaatgattctttgttttcttcttgttgcatccatagtttctgagcagacattacagtcaggtacagtatagaaaatcaatctataaataaaagcaattttttcttattttttctgaagtcgatattgtaaacaaataaagccatataattggaaactttctcattttgccatcagatcctaacaggataaattgatatcttgttttaatctgagaaaagaatttcaagcttgagaaaattaagtacttcattctgaagaaaatgtgcagtgctctttgtcttcctgtagcaattgcttaattccagttaaagataattcagctagttttaatttcacttttacatttcattgaacaaatattattagtgttatgccttactcttaataggctgatggaaaaaaatccagatgtaactactttgaattaatttctgagtgccatccgtgatatttacaactactaaacagtgtttctcacatataatatttaagaaggcattgttgcatttccttattgtgaatgaaatagtttcaaaactatagacttgcactaaaatatgatctgaaatcttttaattttaaaaagtgccaagatttctaacaaagaatagttaagtgtgtgagacctaaagactatttattatttttcttgcctatttattcctaggaatctcacgtcttcattctctgggcaaggtttatgatcttgtctttaaacatgaatctgtggcaaaaggaatgaaagcttaactcttgccagaaatttagttgaaaaggatttgctatcacttaagaattgtttggcttagttattgttctgaatgttttgagaagctgttgattattttctcgagaagggtagaggaagagagcacctagatatatttttgagttatataatgaacaccattttctgaaatagtatggtatttagggatggacatctgttgtttgagcatagactcatttcttttttaaaattttttattttattttatttttttgactctctgtttctttaagcacattaaggtggcaccagttaagaataaactaggactattttttatctttttatttcatttaaaaactgacttgactttattagttcatacagtgaggcagtacgtttttattcacacagttcattgtcttgctgaatattttaagccgtgtaattattatagaacttgtgtgttgatatagaatggattatagacactatgttcgcattggtaacaagcagtgacttcaatttttaagagcaatgataaaccataattatagagaattatttttatctaggtacagtcagctttgaattaaccataccaacaggccagacaagtaatctgctttcattaccacccagacacctctatacaagcaatcaaagcaaacagctaggtggtgagaaatctgcatatctgcccctggaaacaatggggatatacttatctaaatcagcagttccacaggtcaaaattatctttacaagaatactaagacatcactcgcctttttcactctcatttcctcataagactgctatatcttggtatcataagagaatatcataataaaataagatcatgtggtaaaaggtgaaagtagttttgatgtccttttcctgttaccggttagctaccaatgaagtacagatttttaggttgaggtgcttttaaggttctatgctgagaatttaaccaggatagaatgtggtttagaaagggaaaagatgggttgtagaccaaaaaaaaaaaaaacgggagagattgaggattcaaaatgtattgaacattcattcatttaacaattatttattgagcacttactgcgtaccaggtagtcttttagttactaggagtattcccataaagaaaacagactaacatgtctgccctcatggattttccattctcatgaggggagacagttacaggataaataaataaaatacatagtttataaatgtgataaatgctatagagaaaaataaagcagggaggggataatggaaagttaagggcagagtgcagtttaaataaagtggtcagagaaggcctcattggaaagtaaagacttgaaggatgtgcgggaagagtgttgcaggctgtgggcacagccagtgcaaaggccctgtggtggaagcaggcctcatatgtttttgaaacagcaggaaggccagtgtctgagcagtgagtgcaccagggagagtggaagatgagggtggaaaaacaagacaaattgttgagggccttgtggaccattgtttaagcactttggcttccactctgagtgagatgggaagcatttagtagtgatttcattttcagaaatatcagcttgtatttttctcaaggagccattattcatcaagctgcctgtcagtagctacaatcttaaatgtaaatgttcttaaatgtttttgtttggagaaaaataaaatttatatttttaccagactcttaatgaaaattgtagaaagttaattgctatattcctaaaaatgtatagttcattggatttgtacattaatgtaccatttcattgaaacagaactatttgttctgcatgttgctgcaataattctgtatgtgtagtatttttttttttactttggctattgtatttaatgttgacttttttttttttttaaagatgtgttggttaattgcctcataccaggctttgcattgaaggctgatctttttttgtgcctgtgcctgtatcttttgcttgtttgtgcttgtgataataattgtgctttccagcggacatcgtatctcagttatgaaaatcaatttttataaatggtttgatgcagctaaaattctattgtgtcttctcttgattagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaaggttggctttttataatatggatttagttaataaatcctgactgtgttgtattgatctagaaaacaaatatagcacttcagaggatgcattaattgatgaaagaaacttggagctatacatttgaagaccaacaacatctttaaagatcacatctattaaaatctcagctttttaaaatttctagaccattattttctacttcataaaaatatatgatggtaaaacaaaaaatcttttttccataattgattctcaggaaataggaattcacacatagatttctttgaaggcaaccacacatataagaaaatctagttttgtttttattttaaatggacataaaccaagattatggacataaaccaagattatgtccatttaacattgatcatttattaattttaattaaaattacataattaaaatataattgatcacttgagttttatttttcaaacctactatgtcccatttttcaattcttaatcctctatttagttactaagataagaaatgtcagagtgggtcttgagcagccttataaaacttgtgatatttattggtacttatgtaataacttaagagcactggtttatccttgaaaaactttgttggcattcagtttgggttctctgcaccaaactgttaataaatagccagaaccaaacatttagcagaggatacttttgttaaggttttgggctgggcacggtggctcacgcctgtaatcccagcactttgggaggccgaggcaggtggatcacctgaggacaggagtttgagatcagcctcgccaacatggtgaaactccgtctctactaaaaataaaaaaattagccgggtgtggtggtgtgcgcctgtaatcccagctactcgggaggctgaggcaggagaaatgtttgaatccaggaggtagaggttgcagtgagcggagatcccaccactgcatccagcctgggtgacaagagtgaaactctcaaaaaaacaaaaaaacaaaaaaaaagaaagaaagaaaaagattttgattagaatcatgaacttaattttcttctttttaaaaattaactttaattcctttttaaaatagtatataattaccaagttttatatgtgagggtgatgtgtataggaaatggtgtgagataaaatttttcttttttagttatttttcatcagtttcatcttaaaccctgggattctccccaaactttttattaaaatacctttctttcttttctttttctttttctttttctttttttttttttttttttttttttgagattgagtttagctcttgttgcccaggctggagtgcagtggcaggatctcggctcactgcaacctctacctcccgagttcaaacgattctcctgcctcagcctcctgagtagctgggattacaggcatctgccaccgtgcccggctaattttttgtatttttagtagagatggggtttcaccatgttggccaggctggtctcaaactcctgacctcaggtgatccacccgcctcggcttcccaaagtgttgtgattacaagcgtgaggcactgcacctggcctaaaatgccctttcttacttaattgaacctaacttgaagttgtgatagtaatgataataaaataacagctaacactataattctatgtaccttacatgtgttcatttaatcctcagagctgacctattatttcatagacaccattattccaattttacagatgaggaaactgagacattgaaagggaaggaacctgcccatgtttgtgcagtagtggcaaagccaggatttgaactcaggcagtttggctttagagtgtgtatgccaggctgcattttatgtgtgaacttgggcaagcttcctgtttgtaaataaaagataaaaataatctttcttagaagatgtttttatggcagtttaaataagatgatgtatgcatgagacttgcacataatagcagtcaataatttttttttaatttcagtgttagttcagactatttataggctcttcttttttttttctttttgagacagggtctttctctgttgcccaggcagtggtgcagtctccatatcataggtcacgataacctcaaactcctgggctcaagagatcctccctcctcagccttctgaatagctaggcatgccaccatgctaagctaatttttttatttttatttttttgtagtgatgggggtctcactatgttgcccaggctggtctcaaactcctggcttcaagtgatcctctcacctcagccttccaaagtgtttggcattacaggcaggggctgtagcatctggccatataggctctttctagctatttgtcctcatttctagaaacttggggcacccgaagtctccctgggctgctttctcaggcagctctgttctccgttagtccttgtagtttccagagtgccagcagctagacagagtgatgtgtcttactttctggatctctcctagttttcctggatttctttcacccagaaaatagcaaaaagatcaagattatgtttttcaaatatgaatgtgaaaaattcctcccaactgttaccagcaatttgaggtagtttctcagtcactttattctttgtgccttttctgaataatttctctctccagttttatgtgagattttgatttgagaaatgatttgtttctgtgctgtccctggtaaaaactttagcaagagttttttcaaagtgaattctgaaagggcttaagaatcttcaaggataaccgtcttaaagaagcaaacttaggacaccctaatagaaagtaaattttaataatttcattccactcaagagtgtttgcctttaatatgaatttggttaaactcaaaacacagaaatcagtctttatgagacctggtgttatgttgtgttggatggggttgctatttgcctgaggctatatttaaaagtatttcttggatgcttaattttagataaaagaagtaagccaactgatatatttgcaattggttttgaagaaatggtagaattgaatgctggaaacattgtgagtgcaaggtaagctagccacattaatccactgaaaaatttgccagttgagggaaactatggaggacagataattaagtaattgttacaaggatagtttgaaataataaatggaagggtgctcgtaaaactgtaaaagagcatttctcatacttttgggtctgaggatctctctgcacacttaaaaatattgagaatgttaaataacttttgctaatgttgtttatatctttgttatattaggaattaaaaatgaaaatttaaaaacatttaattcacttaaaaacaataataaacctattacatgctaacttaaaataaattttttgaaaaataactttttcaaaacaaaaaatttactgagaagggtggcactgtcttgtagttttccaaatctctttaatgtctagtttaagacagccagattcttacatctacttctgtgtcagtctgctgcagtatgttgttttgattgaagtatatgaagaaaaatcacataactatgtagtttgaaaaggaaatattttaataacctttctagataatttcttctctgatactacaccaaaacagataatttattctctgctgtagtatagataacagagaagtattatcttggtgtagtgtgtggataagacactataccaaatggtagtgtcctaaaggttagttgcaaaatggaatctgaaaccatattgatgaactttttctgctctattatctaaaattcatcttttacctttgcgtgattttgtaacatcatgtattggtcacttgggttccctaagttatgtagcacttccaaattttaacacatttcattatataatatcaaagcatcatattggttaattaccagcattggtaactgcatcagaaaataattgttgggaagctgtaaggatcatggtagcagatacaagttttccagaatactaatttttgcctgaaaacgcaagtttttccattgaaaacaaatgctcttggttgtttttcttaaagagacaggcttagttgaaaaaaatgccacataacctaaatctgaataaccaccgtctgtcattagttcttttaaggaaaaattgtattccaaaaaaaaagtggcagtttgactcacaatttaaagcattttctttttttgttacagatcataagtcagtatgcaacacaagtgctttgtatgtatttcctgtgtatcacacagaatattaaaaagatgtgacctgggttgagctttaataaaatcaataatgtctgttgcttcatcaaggacattcttaggcgaagtggcattttttttttcctgcaagtatatggcagtggggattgtaatgatgactagtatagtttggtgcctaaattcgagtgaaagcaccagcacttttacccattgttgcttttgcaccatcagtgcaaatgttagtcaacacagtgaaagatgtcttaatagtatgatgaaaatagttgtgaccccatgggctttgggaaccctcaaagatgtctccagatcacactttgggaacgctgttctgaatccatattataaatacaaattatatgagtgaggcttaaaacttcagtgttttattttaacaaagtatgcttgcttttaaatttcagcagtttcccatcttttatgacatttttaaagatttttaggagaaaattataggctgaaatagtcatcaatcttgcaagtgacaaatattttattaggcaaaatgaaaaacaattcacatcaggaaaattggaaagaaatcaacttcacccattttgttgtttgattatgtttcctgaaaaatatattcaggtcctaaactagactataactctgagggttcctagtactaagtgcatggatcaattgtttgtctaaatagagtttaatcaaattcttctttaggctaggtttaatcaaattctttaggctgggtgtggtggctcatgcctgtaatcccaatgctttgggaggccaaggcaggtggatcacttgaggtcaggagtttgagaccagcctggccaatatagtgaaaccctatctctactaaaaatacaaaaaaatcagctggacgtggtgccccgtgcctgtaatcccagctactcaggaggctgaggcagggagaatcgcttgaacctgggagacggaggttgcagtgagtggagatcgcaccaccgcactccggcctgagtgacagagcaagactctgtctcaaatatgtatatgtatatatatatacacacatgcacacacacacacacacacacacacacacacacacacacatatatattcttctttaataaagtagtgaatatttattcatttatttaagcagtacctactgagtaccactcttaagtacctccaatgaatcaaacagacaaaaatccctatcttcatggacttcgtattctagtgggaagaaacggacagtgaacaataacaacaataagtaaattatacagcatgttagaaaagtgcaatggaaaagagaggaaaaggagatcaactatagggacacagggaagtgttggaagtctcaaatgaatgatcaagataaggttcattgagaagatgaggaatgagtttcagctacttgcggggctgaggtgggaggatcgcttgagctcaggcagaggttgcagtgaaccgacatcctgccacagcactccagccctgggtgacagagtgagaccccatctcaagaaaaaaagagagattaggagacatgacaagcaaatgcaatatgtagaccttgtttggaccctttttaaagaaacaaaccaactgttagaagatttttttttaataaatggggaactttaagtataaactattagatgatattaaggaattattaatgtttaaatgtgataaggtgaagaggatggaaaaaatagattggcaaaatgttggtaattttgaaatgggtatatggtggtttgtttaatgattatgtcttctaatttcccatagcaagattttttaaaaagacattagttataatttagaaaaattttgaaaagtggggaaatgtatttggaagcacatatagtcacatatatgtgcacagttagctgtccttatccatgggtctgacatctttggattcaactcatcaaaatattaaatattttttaaaattgtgtctatactgaacatgtgtagcctttttttttttgtcttttttacttgcagacttttttgtatcgttattccctaaacattacaatataacaactaattacattgtattaggtattataggtaatctagagatgatttaaagtatacgagagatttacatgggttatatgcaagtattactccattttatgtaagggacttgagtatccttggattttggtatcatgggaggtcctgaaaccaatctcccacagatacttctatacttctctgtgatcttaatgaatacttaaggaaaaagtaaaatgtataagtttgaatttactcacccagtgagtagccatttaatgtctttatattttctttgtaaagaagtaatagattagattttgaaatgtggttttcttttggctaaattgtagattttcctttttaaaggaaacaaaaacagcctaagcttccttcagagtcttaggatatttgggtagataaaggtataattgacaattgtcataaaataggctattgtcaatacctttttaaaaaattctctttttaatattttcttgtagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcaggtcagtaaacagaacactcctctaaggctacttcctaccattaaataacaagaaaaaagcctagaatgtttattgtttcagttcttcaaacaaaaactatccatagttcttgttttaaaatggggttttgggggttttgattaaagactcaccaatagcttcactgtactatttcaaaggcttgccctcaaagtaccataccatgtgtacttaaatgattatgtatattcctcatttcctatgcacatggaactcttgaaatttcaaatctgcgatttagaattctttgtttcaaagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatggtaagctcttgctgcttgttcttgaagataaagctttgaaatatattttaatttgccccaaattctacatcaatgtttttggaaatttaagatagttcctagaaacattaagaatattcacctaaatagatatttcatgtgtattaacccaaaatatctgagacagggctcagtcaatttagaaagtttattttgccaaggttaaggatgtggccatgatatagcctccagaattcagaatgacatgtgcccaaggtggtcgggggtacagtttgcttttatacattttagggagacctgagacatcagtcagtatgtgtatgatgtacactggtttggtctggtaaggcaggacaactcgaagtgggggcttccaggttagaagtagataagacgcaaaaggttgcattcttttaagtcctagatcagccttccactgaatacacaatttagtgtggctcagtgaatctgcatttttgcataaacaatagggcagaggaagcagtcagatgtgcatttgtctcaggtgagtctcagagggatgactttgagttcagtctatactttgtccacaaggaatttcctgtgggcaaattgtgagggagttatgtagcttcttatctttggagctatcttatttaggagtaaaatgggaggcaggtttacctgtcatagttcctggcttgatttttctctgggcttagtgattttggggtcctgagatttattttcgtttcacatgtgttattactgttgggtcaaagaaacaggacatgggaggagacaagcatatctcaggcaaagaaatagttgtaaaacatttttgaacattgattgttttgaatttaaaattctatctcattgctttcagggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtatatctatacttgagaaaatacttgcattaagattttgggtcgtgaaacatgcctttttaaatcaagatgttttaaaattttcttggggtctttttgtacttaaatatgcatctgtaggtaaacagataatagaattatctttccttaaagtgtagcaggatgagctgcagacaagaacccttcagacaccaagttgtagaaggaaagggctttattcagctgggagcagcagcggactcacgtctccaaaaaccgagctccccgagtgagcaattcctgtcccttttaagggcttacagctctaagggagtccatgtgagagggtcgtgatcgattgagcaagcagggggtatgggactgggggctgcatgcactggtaatcagaatggaacagaacaggacagggattttcacgatgcttttccatacaatgtctgaaatctatagatagcacaagcggttaggtcaagggttgatttttaactaccaggcccagggcacagtgctgggctatctgcctgtgattccatttctgccttttagttttcacttctttctttggaggcagaaattgggcataagacaatatgaggggtggtctcctcccttattcccccctttgagaacttcactcattaatgggagttctcactttcatcctcattacccatgtcttcttgcaagacagattgatagtgattcatatggtacacttgcgctgaagcattttggtgagctaaggtagtgatgaagctttttatcatttgaagaagtacaagtagcaaacaagggagcagtaagcaggttcctattactattataactcctattataagagttttaaatcctcctagcactgggaaccatttttcaaacatggcccccggatcaaatccatgccacacttgcacaggcacatgtgtcagttttgtcatatctctaattatgtcttcaactacttgcccttcatcatctgtgtatagacagcaattagtaaggttaaatttcccacagacccccaccttcagctgctagcaagtagtcgagagccaatctattttgatagatagcatttctcatctgagactcttgccagggcagtatagtcaaggctctgccagttttattagtgattatttctaagacagcttgtaaccgtatgattcggttgagcatgtaaatgggggtccagtatccccacgagccatcttgtgcccaagtagcaggtctgtaatattgtatgattctctcagggggccattcatcatctttccaatttcctatagctatgcttctcttttctcgggcagcatagacagggaaacccaggagtttgcctgtctttatgggcagtaggaagaaagatggtttaatagtgccaataacacaactacctgtccactggttggataatttggcacaagctctatgcccacatatacagtataatccagtgggggctgtccagtcctggtgggactccggatgggtccacacggtttgcaactttgggaatttactaaatggattcctttctgtgtgatttgaactccaccaagtgactgtttttgtggtaccattatacagtttctgtcccagacaactaagtcatcctacggggtgagtgaattcttttccttctccagctatgcaatattgtccaataattgaggtttttaggacccagaaattatcagggtgattcttttgagctgggaattcatcaggaactgggtctgtaggtactaattctcgggcttctcatggccattgatctcccattacagttcctccacatacataatgtgaagcaacattgagagactaggctacatgcttggctaattgcaaaaacaaatttcttgtttttcctggaatttctggtactggcacatttagttcatcatagaaagtttgaagcactggctcaggagagtgtttgtaaacttctcctcgaactaagatatttactcgaggatccagtccagccccattgattcctaaggtcacacgctccccttttttccagcgaggatcaaggggattggttattactagctctaaggggttacattgtcccttagtacaggaagggccactttttcctttctgaagctgcactggatccttttcattttttatccaagtggcccaaatgacaccagtatccacattgatttccacacagtcctaattcatgacaaatatacttatttttggtcatatagcctttttcccaatcaaaagccacaccccttcctaacttattgctcttaatgacagcacaggcatcaaatttcaagattatgcgtttgggcacccctttttcttctgttttggctaatacttgtatcatttacaagtccccatcagtcttcagtccttaatcttacttcaaaaactgtggacctgggaggccacagagggatcataacacacatctgggcagtcgtttcctaggctacatacctcgtactgagtgtcattatataaacacgttccttttaaagttcctaggcattcatagtaactatagaacagaaagattgttttaacttgttaccctacctcagtaacctgatgtatacactgagagcagtcttctatgcagggaaaatcagtggaagtttttactatacaagtccaaattataaggaaaatgagtcccacgatgattctcctcatgcctcggccgtgcgtagaccagtcagcttccgggtgtgactggagcagggcttgtcatcctcctcagagtcactttcaggagttgtctgggctcggttttgcctcccaagtttcagcagctgcaggtttcacacggctgtggtggatccaggctgggattccttctcctttacagccgtgggggtggtcaggatgatggtgtgaggtcttttccactgtggccgcaaagggactacgttccagtccttgatccacatgcgatcacttggagagaaagggtgaactggggagaataagctgacgggacacctctcatttacccaagttgagattgtttgtgtaatttttcccaaagcccgtagctgtcactgtaactcaatttcacctaactctcggggagtgcctggaagtccccctagtataggaggaggcctatgatacagtatttcataaggggagtatcctgttagaagggatgcatctaattttaaacaataccataggaagggcctgtatccattttaatcctgtttcctgacatactttccctaaactatttttgatagtctgattcattcgctccacctttccagaactctgaggtcagtaggcggcatgtagtttccaagtgattcctaatgcctttgctgtcttctgtaccaagtcagccacaaacaccggcccgttatgtgagccaattcgtaagggcagtccaaacctaggaataagatctcggagaagcacacgggttacttcgtaggccttttcagtttgtgttggataagcctccacccacccagagtaagtacacacaagaaccagcaaatacttgttaccttcacattttggcatttctgtgaaatccacctgaagaccctcaaaaggagccgctccataagcttgtatgctgggtggaaccgtggggccttgcctcacattgcgctgtcagcaagtaacacaccattgtgctactgctttggcaagggctggcaagtgtgagatgtagaagtaccggcctaacaacttttcaagtgactcttgacctagaagagtggtttcatgcatggccagtacgactgtggctctcagcaactgtggcacagctaccttcccatctggcagtctgatccatccttcttttattacttgccccacttctgtgtggaaaaagtctttttcttccttagaataggtaggtaccaggtcaggtgtttgagggagtaagggggctgctactgatgcacagtaaggggtagatgctgcttttcgagcttctgagtcagtttgggagtttcctaaggccactgaggtggaggctcgctggtgtcccctgcagtgcatgactgccaccttctgaggtttccacactgcctctaataattgtagaatttcttgttgatattttatgtcctttcccctagagtttaacaggcccttttccttatataatgctccatgcacttggagggttagaaaggcatatcaagagtcagtgtagatgtttacagtcttaccttcactgagttctagagcccgagttaaagcaatgagctcagccttctgggctgaagtgccctgtggcaatggtttggcttcaatgacagcattcaaagttaccaccgcatatcctgcacatctttctccatgtggattgatgaagttgctcccgtccatgtataactcccagtctgctgatgcccatggctggtcccgaaggtcaggtctgctagaataaactgagtccaacatgtctacacagttatgcttgaccaggctctctgatactgggagcagggtggcgggatttagggtgttacagacgtcagtggttatgcggggattttcacatagcaagctttggtacttggttaatctagcatttgttagccaatgatgtcctttggtattcatcaaagttaccacagtatggaaggcctttatattcaggttttgcccaagggttagtttatctgcttcttgtgctaacagggccattgctgccagggcccttagacatgggggccagcctttggaaaccccatctagttgttttgagagataggccactggccttggccagagccgcacagtctgggttaaaactccaactgccattttttatctttctgacacatagagtgtaaaggggtttgtcaaatctggtagtcctagggctggggccaacataagtttttcctttaactcatgggggcctgccatgcgctgctgtggtgaggcgttcgaccggggcaattacctacccggaagtgctctcaggatccgcattgctcaagctggccggagtcccccacagggatgtgccacagggcaggcctaagccacctaaggggctgccttgaccatccgttaatcacctcacttcccggtcggggaaccaagaaatgtagcaggacgagcctcagacaagaacccctcagacaccgagttgtagaaggaaagggctttattcagctgggagcatcggcagacttgcgtctccaaaaactgagctccccgagtgagcaattcctgtcccttttaagggcttacaactccaagggggtccgcgtgatagggtcatgatcaattgagcaagcagggggtatgtgactgggggctgcatgcaccagtaatcagaacagaacaggacagggattttcatgatgcttttccatacaggcctgaaatctataggtaacacaaacagttaggtcaggggttgatttttaaccaccaggcccagggcgcagtgctgggctatctgcttgtggcttccatttctgccttttagtttttacttcttctttctttggaggcagaaattgggcataagacaatatgtggggtggtgtcctcccttaaaagtaataaaaataggaaagagaaaacccataataattcccataaagaaaaatatattatgtatctataagattcactttcaaatagaaggataaacttttttttccttggtgatagtttagaatcttcatctttagggctgttttttttttgggttaagtcctgtggttattgacttttcttttgtttctatgtcatctgacttttgaaacacttcttaaagcttatgaccacaaaatttgggaagaatttattaaatttttttttttttttaggtaaaaggatcagtggccatctggtatggtgcctggtgatcaccagacttgaatctttgggcaccacattaccttttcaggcctcagcacctcattgagaataagatatcaggctagatgtttccagaatcccatttacagttccaaatgtctcatatagctcaaagatcaggcagaattcccttattcatgtagttagtttaatcaaatgtcaaacaagtggtattgaagcaggatatttccctgactgcttcgcaggtgggaactggagtgcatgggcactggcggggcgaactctgctcacttgacccactgcactccacccctgtaggagggggagttctggtaagtgagtgcaggagctggggtgagcgcttttgggcaccggcaagagcgaactttgtaccaggcccgtggcagtgtctaggggagggtgcctccaacccctgaagccccacagaaagtgttacagtgctgttttagctctgctgcctgcagatggcttaagtgttaacagcttagtggggggtcagtgcgacagccttatgctcccacactcatggcacccgagttcttatctggtgtccaggaggaatgaggtcacatgaacgaattgaagatggtaaatatggggtattttattgccgatgaaaatggctcttggcaggaaggggagctgaaaaggggacagagcaataagataatcttcccctgaaatccagccatcccatggccagactcctctccaaaactgtgctgccaagctgtccctttgaagtcaagctgcttctctctgacatccagctgcctctcctctctctgccagctgagcctggggtttttatgggcacaggattgggggcaaggcaggccatgggtggttttggaaaaagcaacattcgagcgagaaaacagggatataagttctcatttggggctgtggtaacagactttttggcttgagggtgggacccagcaaagggacccacccacttctgcccagaatttccctgtctcctgtccctatgggtatgaaaaatgctatgtctcaggttatttttctaagctttgttccattcagctagaagtgttcatcagacgcatacagatttcttctgagagcatccagcatgtaatagacatttaatggatgactgtctgaatgaaaacagaacttgttgctgtttgggaataacttactttgtatatgtttattttaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcaggttgggaaatgggcttctttatttaaatgaactaatgtaaacttatgaggaagcagggaatgacataatatcaaatgaggagaatattgtttttcaagaaacattaactggaatagaataaataaaatttaaatatgtcagatttttagaaatatcagatctgtttataataacttatttaatttttcagcctattttcatataatttcatgtaaagagaagcaaggaaatatttttgtgaaatttttaattgaagctaatttaggtttttaagctaactttagtggtttgcatatgttttgaactgccacttgtctcttgaattgtttatgaaacaccatttagtcccagtcctttaagtaatcttggaaataaagccagatcttaatttttactaaataaagcataaaatgataactttaccaaaacctttcgaatttaaaggtatttagactgcctgcctattaccaagtgtttctggcattccagcctcaaaccactgaagctcatgaaaggaaggagaatgcctctttgctctacacgatctgtcctgcttatacagcttctcttgtgttttcatttcttctgactgcagctgaagatctagatcttctaaatgctagttttcaagatgaaagcaaaattctgtacacgtggactccaggcactttgctgcactatggaagagctgagctgaagacttctgaccacaggtttaagcagtctcagtttttctaatagtgtttgaaatttgtttgaaatacacccttttaaaaacatttctaatacatctatcttcctttatgccttaaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataaggtaagatgtttattatgcaaaagtagcttgtgattcataaacaatcatttctatatagaaatcaccttatttggggaaggagagaattttaaaaaagaaagataccaccttatttagtgtttagtatatgagtatttttatttccaaactaaagcaagatcatactgtggatattattctgtaggtttttataactgaattctcaacttagaaagtttaaatgaatagtgaaactttttttttaagacagggtctcacccagtcacccaggctggaatgcagtcatgtgttcatgtctcactgcagccccaaccacccaggctcaagcaattctcccacctcagcctcccaaatagctgggtctgcaagtgcacaccaccacacctggctaagttttgttttgttttgttttgtttttgtagaggcagggtttcaccatgttgcccaggctggtctcaaacccctggccttaagcgatctgcccagctcagccccacaaagtgctgggattacaggcgtgagccaccatacccagctaaacagtgaaactttatgtgaacaattgaaaacaaaaataggtgcaagttcagatatgaactctcacgattcctatacaatagaacatgtaacaaaaccctataacaaaatgaagctgtgattgctatttttttttaaggagagataagaatgactccctccctgcctcagttaaagaaatttgagtaattttaagtatgtttaatttctaacagagatgtgatgactagtcaagagtcattccttctagtcttggtttccctcattgatctagccatctgccttttgcagaaccagatgcctgtttccttgttttaaaaatgttctcttccaactatacagcagttttgagagactgaatgatgtgcatgtgtgcatgtgtttggatttcatagggaaagaggtaccattaaatccctttaaataccattcatttgcttagttaggtatgtttgatagatatttggtgggcagatctctatactagttgctgtagaagagcagaggagaaatggaagatacaactcctgcttgtaatctagtagggaaagtcagcatgtgtgtaatgacacccccagatcctaaagggcgtagtccacagaattaagatggtatggcttctacagagtgaaaatcaaagacacctcaagtcctttcagagagtaaatgaacaaatggagaagaagttgtgtttagactttcctcaaatcttttgacaaaggtctatcccaaagctttcaaattaaacaaaacaaaacatttcaaaaatcttaaggttcttgaaagtacacagtgaaatctgcaagtgtacagatgacagtatactttgccaagtacagaaatgccaaaccaccagaagcatcatgtagactgtgtgagtgggcagcagagtagcagataaatgtcttcctgagcaaatgtaaaatactgcactgagctacaaagaatccaaactgtataagggatgaaagactctgatacaggaaagggacctgtctttataacccaacctctaaagaacttgttaaattgaagccagaaggtttcccacaaatgtttgtcatcattaggaaaagtattggtaagaaactaaggcattaacctaacattataaaaccatggggtgtctccaacctggaatattggttgttaaaccccaagatgactaagttggaagagaaaaagcaaacactgaaagtcaacaaggagaggatctctataagtagtgagaagaaactgattattaccttttagtctagattaagacagccattaaggagtgagtaaaccctgtgaacccctttatttttaaataagaggttccctggaaatgtgtatgggataaatttaaatacatatagatgcttacattaattgaaggaagagtctagaagcttttactgtagtgagtgaaagcaggaagaaaatatagcttccaaaagaacttacataaatcaatagatataagaaccagaatcccttgttaaagttagaaatgtgtaaggggcacattgctgattgagaataaggacaaagatattagccctaacccaggaccacaaaagtgttggtacctatcaaagaacaaataatgtttggggtcttaggggactggtgcagcataaatgtatgcttacagtggtgattataacctttggaggagggatagtctccattgccaacaatctgaaaaagataccttcgtgtagttaggtaagaatggtctccctgtgtatttcaaaggatagcatcctgcaatttagttttatgccaaagaaattgagtcagttgccttggtcatatctgtgggattgtagaaatcggttccctccaggcccttgattttaccagggtgaagtacttatgcacacttttgttttggccttttcctcttaatattcataattcatactttggaatcctagtttaagtagggggttagggggagagtgatactctgtgtgtgtgtgtgtgtttgtgtgtacatgttttcctctcattgtggaaaaatctgtaaagatttctgaacttgtggtttaactcgccaaattttctgtaataagactgataacatcataatttgttcttttttgaataataacttcattacatacctgcgaccctcttcagaacttcttctgtcctttttattttttttttcctcttgatagtttttttatttcaaaagtaaaaacttggaatcctatcaaagaccattgaagtcccaaaagagtaaatgtttgtcaatgatgaaagacaaggagcataacttatctaaggcttcttggggccagtctggttttgttttctttcactggcaactctcatcttttttgatcataggaaattttcttcagggaagtcactgagacagtgaaaatacatagtactgggttgtggggtccggagacttggatcccagccctgtaacttattctccttatagagtcactttgaacaagtcacttaacctctgtccctttttgccttgtcaatgaaatggaggattggatgggactggattagcagtgatcacaaatggaggtgcacagactcatttcttgtggctgttccattaacatagtatttgaaattggagttagagtgtttttaggggaagagtgccctctccaggtcaccaccagccctacctgcgctccctcctttactttttacttcctggcctcttgtggcccttgttaatgatcaataatcatgggagtagtcactgagcttgttatgtctatggtattaattatggttttttattgtttttcttaaagatttgtagaagataaaatgtgggttacatttttggagggaagctctgccttgaatgttctgagcctaaatggtaaagaggtaaggtagcatttgttgattctaaaccattctgaaattaaatgtctgaagatggtatgatatttttatagacatgcagcaagattatctaaatgggaggggaaaagaccttatggtatgttcgaggagttatttaatgttttttatttagactggatttctgactagcctaggcttattttggcccctccccagagatattaactgttgatatagactaagaaggaaacatgtttagcacctaatttgatttattacattttatgatgcaaaaagttttaaagttttaattgggggtagtctggcttatctgtatagtagaaaaacattctatcaagtgaagaaaatgcattatgtaccagaaaacaagggagagaggtgctcattattcctaggaatttgtttcattggcttggcttacctagttatcttcttcaaacataactaaattaatttccagagataacagatccatcccattgaagtattttagaaatttttaacaaatggagatattcctaacctgtgatttgaaaagtcattgatgacggaaacttacattgttggcctggaatagttttacttctctgaagtgcttcatctgtcatttttttctgaactcctttagacccaaatcctaaatttctaagtatatagtcagtgcacaagatggattgtactctaggcctgattcctgcagcactgagcaactctgtgagcactgtcctgagctgcttcttctgtcacatcaacttctttggagaaaaaaaattctttgtatgtattaggctgggtgcggtggctcacgcctgtaatcccagcactttgggaggccgagacaggtggatcacctgaggtcaggagtttgagaccagcctggccaacatggcaaaaacctgtctctactaaaaatacaagaagtagccaggcgtggtggtgggcgcctgtaatcccagctgcttgggagactgaggcagcagaatcacttgaacctgggtggcagaggttgcagcgagccgagattgcaccagtgcactccagcctgggcaacagagcgagactctgtctcaaaaaaaaaaaaaaaattctttgtgtgtattgcttttgaaataggttttgtagagttttgtttgttttcctaaatgtaatactagtatactcatgtaaaatcatgtatcaggaaacatggaaaagaattaaaaataagaccactcacataatgctaccattctgaagtaatttctcttaaccttaatattagcatatacatatgtaaatacaaatgggattttatatacacacaaacacattaacacaaatgggatatgcatatacgcaaacacaaattgaaaccgtgttataaagctattttcttactacctcttatgactgtgtcagggacatcttaaacaaatatgtcatttttaatggcttcattaatttcattttgtgaataaatatatacatttattaaaccaaactcctatagacatctagattatttcctattcttaattattaaagccaatattccagtgaacctctatgtatctttttgaatatttttttggtcttctaaatttcttccttttcatttggccctggtctctaccaaggggatagtcctaaggaattacatcttaattggccattatggtgataggtatttaagaatgcttgttagtattttttgatgaatataaaagaattttgttgactttgaaaagtaatatatgacttgtaaagcgtgttaagttctgaaattggattgattttagtactcatatctacttggcaagtaaaggattatgaattcttaggattctgactttaaagctcagtgtggatgctaaattactaataaacacagctgtgccactcagttcagcaactttcaacctctccattattatgccttcaaggaattctaatatcagtaacactttgagccaaggaagatctgtacccacaaaggtgccaactgtcagcacagcatattgatcacagctacacagttcatttgcaaataccaaaaatattcacatcttgttcacattaagaaactcttcaaacaaaggaaattgaaactatgtgggagagagattaaatttagaaagcaagtttgttataagaatatgggttttaaatgagaactcctttctagtgcacattttgtccttgaccaaagagtcttgctgttatcagcaagtttttttgagagtattttttaaatacattgacacgatctgctataatttgattataatgtcttggttgtcttagattatactttagtctaaaagtcacccaaatttatagagaaggcagagtgccagtttcacaggtagaagtcattctgtttttagaatgattaatttttgttgaagatttaaaatggtgttcagttctcttaatattcttctgacatttgaaatgctaaaactgtataggttagcacttagcagctgacaatatagcagctcttaggaccatatgccaagttaggaaagaccaaatgaacaggaacaggaaatgcattttaaagattttctgctgtctcttttgtagttgtttcacgtgggaacaattacttaatctgtgaatcaaaattaagaaagtataaagttatgtagcagagttgttggtgaatttacatctggccaggaaaacatagtggttgtagcaaaggaaacttgcatctctgggcatcctagaaaagatctttatttatcaccacaggtgtttaaagggagaactgggaacaacctttaaactagtttgaaatttagtatatgtgaaagaactatttctttagttagctgaattgtctaactaaattaactgtctataccattgcatagtttaacgaagtcagcctctttattccaaattagttagctttcatgttaatctttattttatatctcttttactccgctagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtttgtttcttaaacacatttacttcttgtagttctagatatgttttcttccaatctgtaaagtcttattttccaagttcatctttcttcttcttcttgggacgtacatagcactattaattagaatgtattttggccaggtgcggcagctcatgcctgcaatcacagcactttgggaggctgaggagggtggattgcctgaggccaggagttcaagaccagcctgtccaacatggcgaaaccctgtctctactaaaagtacaaaatttagctgggcgtggtggtgcatgcctgtaatcccagctactcaggaggctgaggcaggagaatcgcatgaacccaggaggcagaggttgcagtgagccgagattgtgccactgcactccagcctgggcaacagagcgaggctgtctcaaaacaaaacaaaacaaaacaaatttatttcacatcatattgtgtttattttgcgtatactttaaatgtatttaccattcttccattcaaatattaagacctttacaaatgttaatttatattcttattggataaatacccaaattagtattgttggtgtatggtttagtcccaataattaaagttgaggtaaaaaagtagaagttccaaaagggtattctaagaacagaaatgaatttaagtaattacgctgaaaatttccttaaacatgatttaaaaatgcatttgtttgatggcaacattatcaaaagaaaaaatttttaaatgcatttgttttctaacacaatatgctattctagccagtttttcattaaaatgcataccttagattataataatattgtaatgccctgtatagctaggtaccacatttaagagttgaacgtcttacaaggttatctcattttcacattatctgttcatttgtttactcagtccacacatatttatgtagtacctttatgccagatacagctgggtgctggagattcgacagctgtggttcttgcctttccagaactcatagcttattgggtgttacgtgtaagtaagcaggcaattataataaagtgacataaatgtgataatgaatggttttgtggtagctcatgggaaagttgcttaacctggatttgggaaattgggcaagctttcccagaggaattgaaatttaagttgagaatccaaagactcagggagaatggaattaatgctatagaggagtgatccaagaagaaagcatgtgcacagtctaagtggggataaagaggatccaaatggattatggagggatgtttgtgagggagtaaatgaagaaaagaaatgcagagagagaagtaggtgtgggatggaagatgaattttgtttcggatatgttgaatttgagatgttcatggagtcagtcaaacatgagtctggtgctcaggaaagagctctggagtcaaggcagctctaatagcctgcaaagcatgggcatttgttaatataactttggccaataggattatgacgagacagaagagaatgaatcgaatatggagaaatacagacctgggattgagtatgtggaaacacagagtttaaatatagacagaagaaggctgcccgtgaaaagaaaatgagaagaaacaatggcaattgtttctagaaatgtcaaagagccaagagaaattcatggcttaaaaatcaaggaaagaaagtggagcatggaaggggagtagtcagtggtgtcttgtaacacagaaagatgagaagaaatgaggacagaaatgtgtccttctgatttaataacaggaagggaagctgttgttgacatttcatgagagtgatctcagaagtgatgaagtcagatagtggtaaattgatatggatggaaggtgaagaagtggagaaaagtgtctgtagacaactctttaagaaagtttggggggaaagagaagagggcaattgctctaggaagattggaggtcctagggtggtggttttggatgggacaggcttgagaatgcacagtgctaatggaaaagtagaggagaaagggctgatggtttgggggaagggcaaggcagaatagtagagcagtgtcactgagaaaattaggctgggtggggcccatttgttccatcctcagatacccaagtgacaaccatgtaatgagactccagcttgggggcaggctgttgaagtaggggttcccatcttaagacttccctcttctctgtgaagtgttgaagtgatctgcaggagtgggacagctcacagtttcaggagggttaaggagttttgcagtaaagctcctgaagagcaaagggtgaggggaagagcaaaccagcaaatcatggaattgccaggcactttaggccagaagagactgaaaagcataatttcaaatgtgactgcagttgtcaggactgggtggttttctttagcagaggcagtcagcaatccaagtgttatcacagaaagattaaacaggggaatcagtgcagggatggggttatgtcaagcacgtgcaatggaagaagagtgaagtagggtaatgtttgagatgaagaaccatagaatctgaaggtaggtacagaagaaagcagaatcagatggaggtaaaagttagagggatcaaaccctggcttctgaagaaatcaaaagagaaggagtagccaagggagagaactgaaaagctgggaggccaaagtcagagtgaagcttttgagtttattatttcagaagagtgcagttctgaggggtgagggttaggagtgaaggcgaatgtccataaggataggaccaaggcattttgctattgaacgagttgtccacatggactttgatgccacgcagaaagatggtgcgggacctgacttacagtcttgctctctgcttagtcctcagtgagtgggttcaggaaatggaagaatggacgttggagatgactgtagcaagtgggggtagaggatgttacataaattcctgatggcatagcctcagagcagtaggactttttgttcagggttggaagactaatgttctggaatggcagttaggttgcaagggttaccttgtgcccactttcctacccagaagtaagtggagatgaggagaccctgggggagaaccagtgtttacttaattaaagcaaagcgggtctttgtggggtgagggttgcagggaggagccttctgggggaagactgtgtggctcctgagagcttgttgactctgaggctggacctgggttaggcaagggagtggggcagttccacagagcacagtggacaggtttggaaggagagcaggaaacttgagttggcttgcactggagaagctgctctggggcatattgaaagcccattgggtcaccccagctccaagtggttggtcacctgacatcttattgctcagagacaatagatacctttacatcttctgaaacaagcatttctactaattgtggttttatacatgccttcatgcttaatccatgtgtgtttgcaatgacataatgttcatatttgttttgtgtattttaactttttaaaacctaaggtgaaaaaaatctctgagcaagttaaaatggagttatctctgatcaagcctgcttttccttaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagtatgcattttatttgaaagttttgtatggcttcctgtggccaatgtgcttgatgttggagagtcatcgtttaagtttcatacctaggtgataaagtgcaccctgttttctccggtacagaataggaaaacttgtagatgataagctctcaatggaaaggaaacttgctataactgtcactagatgacaattgttcttaatcttttttctatgtggttaggtttgtctatgtcttataactgatgattttctatggtatgaacccgttaactatttgagctttttcttctctctactggccagactacaaaatggcttaactcaaacaatactttgtgcatatcaatagggccacttagtaaattagctttcagcacctgaggcctaggtaagaagtcagcacagaggtagcattattgctgccatggtaccaaagggcagtttaatagtagactgcttttgttattcatactgaaaatacatgccctttctttacaccattgtgcacattttatagaacattacacatatatatgaaggactgttcccttctgtcaacagctacttagaagctgatcttcttacctcctgtgcgctttttaggttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggtgacaaccttttatttccatttctgctagatgtaaaattcttcactctattttaaaatgttttgcatgttttccaatctctagcttctggattttacagttttttctatcattattgctatttcttagcttttctctaaagaacatggtaggcgcaacagacaaggtagagtgtttgcagagtagattcctctaaggtgttttcacagctgcctttagctgccttctcaccagccagccagagaggtttattttgtttttgctaatttgatctagttaggcatgtaaactgttcttaggtaaaattaggtttaatttttttcaaaatcctcatttctggatgatttataagcataaaataattaaaatgtactaatttctgtaaaagtataataaaactggagagcatacgtattaatgtacaattgtatgtatttgtttaatgttcttttaaattaaatatagtgctgttacttcaattataagcatatgcattgaataatagtttttgtagtacgtagataatatgtaattcctgcatgatacttgatgtcatggatactatagcaatctttgacatttcacttctgtatttaatgtcatttcctttctgctgcctattttcttatgaactataaggggctaggagtcctgcacccactagaaaggaatttggaggtaaccatttacatttgttagcatgtgtgaatcgtggttcattaatgttttacacctgaaagacattttagatttgtttgataaaagtcaaaatgaatgacattctagtttaaaactaatccacaaataaaactaataaaggctttcatttcccaggtaggctgggattgttcatcaggcctaattttttttttaataaatgtggtcgattcatttacaaagatttaatacccaaaagttatattaattttaaaagtcattcaggtacagtaaatacagaacatttcccaagtatctgattagtgatacatttattttctagtggaaaagcttttggattagcaaagaactgtatgattttcttttcctttcttcataaggaaatttttattcacaaagggtcactttttgtttgaagtatagtttatttggtttacatgaaaactcacagagctcagttggagttatacatttgacaagtttatttaatctaaatctcaagaaaagatgagatgagttttcacaattcctcagaagaacttttacaaatccagtgttactaaggctcactgtgcatgtgtagcctggtctgtttctattgtagcttgcctagtgacatggctgagcaattcaggtcttactacagactgactttgcctgtgtgtagatcttaatgactgcgtgtgataagaatagctaaattatttcagcattacagcttctgccgaatacagctaagtgatcatttctccattgacctacagaaaacatttaatttttcccttttcaagctcctgcttttatagaaaacatttaatttttcccttttcaagctcctgcttttatttaaatttccatgataatttttgcttatcttctgctttaattaggaaaacatcctgtagaaaataaatttaaaatgaatctgtcaaaagttaggcaagccagtggattacagtgaaatctgtcttaattttaaaaattgctccccttcataattcttttgtaagtagtgtttgcaacatgttttttcatcctataaacaataattcctttacgtcattatagtacattagagtttttaaaattaatgcatcaaaaactaacttcaaaagacttacgtagtctcatagaaatttatgatttctttccttttgactatcaaatatcagagtttttacttgctctggatataaggagtaagatgatttttaaagcaaaggtcttcattaaacatattttttaaattccctactggtagtaattgcatacataaaaagaaaactgtcatcctgtttctactcttctgtttgagtaaagggaggattcagatttgggccaagcatctaaagtcactttggtttgtattgatatctttgaagaaatttaaagcaataaaagagcctttttgcaaaagtgagtttactatggaaattgtcttgtgtgcctgcctttcattctgtgctgtgggccctgaacaatatatagtttctgttctttctctaaaaaggtattggagcccctcccagtcctggggtagctaggagagagatggaaggtaacaagactcttgcattatagaagtggttctctcattttatttctcagtgtcagcgccccacctccccaccccgcagtgtttgcaggcatactaaatcttttcttggtccagctgtaaacttctctttcccctccttatgtataccttgtattttttcctctcttcattctatgtcacctatagtttctaatggatatccatttaatttccctgagatccttaatgttgtttgtactctgtttcatatatagtttatatatgcccaggttgtgaaattactgtttaagaatgtcttcaaaattcttttcagaataagtaaaatatttagaaatgtactttactaatctgaagttttaaaaattaatgattataattaaaccctattaattcagatccaagaatatagtattttgtagttgatttcagataacatagctattttatagattagcactgagccagatttgtttaaaagacctttaagactagaggccatttgttatgattttagttattaaaaggctgatgtatttcttataacaattgtacttgaatttctttacaaaaaggagagtttatttaagatgctgcccttgatagtcactcctactccttttggctccaagagtaatttatttcattttatccttcagctacctttctaatgagtttgaacatatttttaacactgtcttccataaggcagatatttggtaataacatatgcctgtcttctgtcttaatgatgggattttgttatagaaatccgaaagatctcatcataagataaccttatccacagtgacatctacagcgtgaagccctaaagtattgctactaggagcctcttgtgtaatttgacaaatgcagtcctgtctgttgctcagaagccacttgtctgccagactctaaggggcagcagtgccgcatcttgtgaccattcacacagctgactgtatgttttcaaggttcacaagagagagttctatggggaatgccaccctaaaagtggtcccatgagtgagatatcaaactaaagtcaccacttgtctcccataaaggtctatctaaatattgtaatttttctctcttttggagtatttcattcaggactgataatacccttcatcattatacaaagcaaagtgctttgttttgttaccatctcatgcccccatttctgctggtaatgaagcagaacagcaagctgatgttatgcaatattgcttaattgttaacttacaactaatttttttttcccttcttgcttcaaagcacccaaaagccctggaacaacaaggaaagataatataggtaaaaacacttgaatgtagctattcacccttaaaactggaccgtgaaatagacacttggaatataagtacatggtttcttgtttatttttttaaacttaaatatatgatatgatgtctttgttccaggacgcagtcagccttcacctcaagcaggacttgcaggcccaggacctgctggatacagtacagccagaccggtaggtaaaacctcgcctggggccaaggggtctcggttctaagtcctgtttactactagtcagttttgttaccttggagaaatcatgtgacccttcaaggcctcaatttcctcatctctaaaatgagggaattgcacttgatgatcttccgactctaacattattttaacatactcttcaaaaataacaaacttcattatttggataaaagtgatacacttaaaacaattatggtcactaaataaatatcttaagagtctcagtatatgaggaaatgatggatttgggcagctttttatcattttacctgagtaattaatgaagatataaagtaatccttcattaaaaaggattttaattacatttcagaaaaaaaaatgataaattcagtatagtaaaactggttctaaaggtttttttctctttttggtttttttcttgatcaggttcatcatattccgtaaaggtattagaaataggagagtagatgttgttacaggatttttccctacctgatgaatgtgtcttttctgtatgtttatatgttctcttatacacataggttttttattatttgaaaactttctctggactataacaggtaatcaagaacagagagaaagagcaaatagaaaccagtaatcagtgacttaggctagtccagtaggagctgggactactgagaggcccatatctgaagagtaggaaactgagagctattactgtacctagaaattaagattattaagattgtgagaactgaggaaaccacttcctatgaagatagaagctttttgtcttttctgttgtagctgtccacttaacaatctgaaggttcttttttatatgtaatattactcttcaaatatttatcctccttttttcaaaaaaagggaaatttgccattcactgatcccatgaccacacttggcacaagaactttcttgattctgttgaataccataagtataggaaaagaaagtcaggatttttgtgagtttaaaagttcatattttgcttaaaataaatattgttagcttagatccttcagcaaacatatgaaaatagaaaaaatatttttcactgatgagtctttcagtgtatttaattcggaatattgagttagtcattcaaaagttgtacttctgtgtttaaaagcaatatatatggctgggtggcagtggcatgcacctgtagtcccagctacgcaggggactacattggaaagatcgcttgaacccaggagttcaagtctagctggagcaacatagcaagaccccatctcttaaaaaacaaatcttgaccaggtacggtggctcacgcctgtggtcccagcactttgggaggccgaggcgggtggatcatgatgtcaggagatcgagaccatcctggccaacatggtgaaaccccatctgtactaaaaatacaaaaaattagccgcgtgtggtggcgggcgcctgtagtcccagctactcggaaggctgaggcaggaaagtgccagaacccaggaggcagaggttgcagtgagcagagattgtgccactgcactcccgtctggccacagagtgagactccatctcaaaaaaaaaccaaaaaaaaaacaaatctcagggtgttttttccccaaagtctcctagttgctcaggtatgtatctctctatctccttgtatattttaaaatcatcccagttttccccataaagacagcattgcacatggttaagaaccctagccctgcagccagtcagacctgagtttggatcctggctctgctttctgtgtggctttgggcaagttgtatatatttcttcatcttaatttaaaatagagatgataaaataatacctacttctgagggatattttgaagatgaaatggaaatgcctgtacagtacttaattaacataatgtctggcacatagtaaatagtcagaagtaaacaggaagattttaaaattcatcattataatggcttcaagtagagagcacttaaaatgacaaattagggactaataccatagaagaaagtaaatgagatgcaaaagcaaatgttttcacagaattttacctgtggaaggtaagtaaatgtctcaagtgttatgtttcctatctgtagacgattcctcctcgtgctggagttatcagtgccccacagagccacgcgcgggcatctgctggaagactgactcctgaaagccaaagcaaaacatcagaaacgtcgaaaggtaggtcctctttgggaggctgaggcaggaggatcacttgagcccagaaatttgagaccagcttgggcaacatagtgagacccgcctgtaaaaaaattaaaaactcttaaaattagccaggggtgatggcacatgcctgtggtcccagctactcgggcggctaaggtgggaggatcacttgagcctgggaggttgagactgtggtaagccgtgatcacaccactgcactccagcctgggcaaaagaacaagaccctgtctcaaaaatcaaaaatttttaaaaattgagagaaaagaaaggtagatactatattagaaatactgtactggttttgttgtatatttttctctttttccttctgtcatctcccaccttctacaacatatattcagatagctatatccttccttcattataccacaagaaatgaggctacttattgggggaagaaataactagaatgttctcctaacatttcactaaagaaggaaaaaaacatggttttctagaatatacctaacatctgacaaccactggttttttaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaagtctcatttgttacacaaaatattatctttgatgcatatgatttagtctttgaacatacctattttaattattgcctgttataagaagtaaaaataaatacgagttttaattttctttttatatttgttattatacatatatatgtgtatatatatatatatgtttgggttttttgttgttgtttgtgtgtttgttttttcctttttaagacgaagtcttgctctgtctcccaggctggagtgaagtggcatgatctccgctcactgcaacctccgcctcccgggttcaagcgattctcctgcctcagcctcctgagtagctgggattacaggtgcctgccaccatgcccggctaatttttatatttttggtagagacagggtttcaccatgttagccaggctggtcttgaactcctgacctcaggcaatctgcccacctcagtctcccaaagtgctgggattacaggcgtgagccaccatgcccagcctactctgaattttcaaagtgatctttccttaaaagtatctcattaaactcttttgaaaaaactgtgagatgagtgaaccctaacactttggaaggctgaggtgggcagatcccttgagcctgcaagttcaagaccagcctgggcaacatagagaaaccttgtctctacaaattaaagaactatccaggtgttgtgccatgcacctgtggtcctggctacttgggagtctgaggtgggaggattacttgagcccaggacatcaaggctgcagtgagccatgatcgctccactgcattccagcctggtgacacagtgagaccctgtacctccaaaaataataataaataaataaaaagtcttcttttacactttggaaagatctgaaatacagaaataatacgtattggcaatgtccctttaacacatttataagtaatagtttacatttatttttacagatatataggtatgtccagctagttggcagaagtgagcagtttcttaagtgtctacagggtgaaaacagatattaaagtaaatatgattcaatacaatatgaataaagttagcagttagcatttattaagtcacatttgtaaaagttgaaggatatataatacagaaaaataaatgttcccttaagctggttaataccaaaaagaattctatatttttttagtttagaaaattgaggatgaagtctgggagcggtggctcatgcctgtaatcccagcactttgggaggccatggcgggtcgatcgcctgaggtcaggaattcaagaccagcctgaccaatatggtgaaaccctgtctcttttgttttgtaaaaatacaaaaattacccaggcatggtggtgtgcgcctgtagtcccagctactcaggaggctgagacaggagaattggttgaacctgcgaggtggaggttgcagtgagctgagatcgcaccactgcactccagcctgggtgacagagcgagactccatctcaaaaaaaaaaaaaaaaaaaagaaaaaagaaaaattgaggatggtgaaaatatataataatggtagaactctttcaaataatgattttttttttctgctaatccatttttagtgaatcgtgaatttttcttattttcttgtatactcttttgtagtttttaaaatgtaattgaagggcaaaaaactttttcaactagccactctgagctttctaggactgttttagggcatccatctcattgtagttgcgtgccataattactaaaactctgatggtttaagtgtccttagaccaatacaaaagtagataaagtactctgaaaaacttccggaggtgcaaactgttagctgagattgtagttatcattataaaatcattctaagacacatatcattttctcagaaaactttccattgttttatgtttttcattgaagtgagtatagcgatttggtggccgacgggcacatgctttgtgtgtgcccccttagattgtgttcttgaatctcatggttgtcagttcatcaaaaagacaaagatatttgtttcaaatcctgaagtatctttttgcctcagtcattgatatcaaactccttaatattagatacacagacacacttttctttcttggagggtggggtcttgtttacatgcagagtgtcattgtgagggatcacaaagtggttacagtttcctccagggaatgcccaatgctgggggccaggaggcaggtgaggaggagtctttctatctttttgtaccttttgaattttgaaccgtaaaataatgcctattttaaaaataataaaaaaaattttaaattattggaagtagctgttaagttgaacaatttacaagattttcaaacctgatggtgagatttttaaatatgacaagtttgatattttgtaatgacatgaaatagttttagaattgaacatttgtaatttttacaagtctttacttatcctattccaaatctacaaggtatttaaaacataatgtatatgacccagttttactttttattatttatcctttgactttataattttgtatagaagagattcatttaattcgagtgattatataacatgttatacgtcctttacaaagtataaaaaatcctcacttatctatctgacttctagcatcttagtcatctttatcagctgagagccagaaataaggaaatgcaactggaagtaaaggaaccgaactcactgctatactgttactgtgagacctggtagaaaaatcacagcattctagacccatttaatggaggatacagcaaccttgtacctctcagtataaacctattcctgatctcctgtccactgccagagctgatacataaaactctgagtgttaaataagagtctcatgtttactaggcaggaaattctaaagtacttaatatatttctgggtgatgtctctgaattgtcaaaattagttttgctatttagtaataggtttagatattggagaagatttacctcaaaacttgcttgaggatactagattttaaaaaataatggtatattatagagggattatgatttcatttttaaacaaaggtaaattccaaatttcttgtaaggtacaagtttcttgtaccttccaactaatacattatgaagtaaattaatgatattaagagtatcatccttcagaaaatttgagtaagataaaacaagctggatgagtactaattttcagtagggtagtctttttgcaaaatagtatgtaccaaaaatggtaccattttgtaccattacattgccattttctctaataatgacatccctaggctatcctaaggctgtgtcttagtctgcttgggttgacatatgaaataccatagactgggtggcttacacaacagaaatttattttctcacagttttggaggctggaagtctgagatcagggtgccagcatggttgagttctggtgagggcactctttgtggtgtgctgacagccaccttctcactgtgtgttcacacagcctcattgcatgtggtgcctggaatgagagcatgcacacacccttgcacacgctctctggtgtctcttctcataaggacactgattccatcatggggtcccaccttcatgacctcatctaactctaattacctcctagtggccccacctccaaataccatcacacaggggcttatggaatcaacatatgaatttgggaggggagagcacacaaatattcagtccataacaggttgcttaaaatattttagaactctgaaatcatttggagtattatttttggaataacaaaactgaactggttagtaatcaacctcagacaaaactaaagtctggaccctaattcaacaaaattataaaaggaattggaattgtcttttgaatttatgttacaacctgcaaatattgctgctcttgggttctgtctgtaacttagaaagcattttgttgactgaattgttagggttgctggttgatctcggattgtcctcctaactctttcctttgatgtctgtttcctttctcaaagcaggagcaaccatcagggtaacaggtatctgacaatttatcaatcttacatgtgttttcatccgtctcaacacattagatgtatgaatctctgcttcatacatctaaagtttcacccatttttaaaaccacctgtctccattaataaattctatcataccataaaacctgctttttctttttcttagtattttggattttaggaaccatgtagttgttcttgctaatgctttaccactttttgcttcatttttttatgaaaattaacaaaactaaaaagtgtaacttcaagaaagtaagatttaggtatatgaaggcctttttggcaaaaccagatcggttcttggttttaacaatggcatttatgtaattacataaacacaaaattcagtatgttttttaggaaaaaatatttgggggaaatattttttcaaatggttttagtagcaagattgttattggtaaggaagaattgatggtttagaaagatgaaagttaccagtataacaagattatctaaaggtccttccaacacctttctctgtaaaaatagcaccaattttaatattgtcatcacaaatcctgcttagattacaaattaattctaatgtgatgaatggtgatgtggttgtcattgtaatttcaagtctgggaaaaatgatcctgattctatcaaattaacttattttgaaataaaaattttcttatatatgcaaataaaggtgtttaaatgtatagcactgatgcagcaggtgacttctgttctaagctggcagagcacaaaattctcctttcctataatgtctgtgttgcagacgattctatctgccataggagaattttgtctcagacagaagtatttcattttgtattaactataaatagtccagagatttttggtaatatagagttaattttataatatctatataaatttccttttaagtacatttccacatataggtctacttacctaagacatttagagtacagtttaaagtctgtgacatgttttctctttagttttgtacaaatttatcacactaagtttgaagaaaaatatactgtttcaaccaattataaagcatattctaggatagttgaataaaacagatacttgaaagttattcacttaagtcatccatttccttttacaagtgaacatccttccatattcttaagcagtaactaagtgtttcatagtatgcagttacattttattgagactgctgctgtttttttccaatatatttcatgaaagtatagttatgttgctttaacaactatccaaattccttttgggcagtgctcattttattacattgccagtcttgaactgaatttttttttgccctatcgtatccaaccctgaagttttcttaagttagcataagtgtccaagtcatctaccctagttttaagaattatatacatttttttcaaaattaataatgtatgcctgataagctaatttgcttatgaggcaagaatcatagttcttttccttcatccgatcatttgtctttgctcagtcccttggctgtgctccactccaaccaccttctttatggagtagggaccaagggatttagggcaggagtgaaggaattccaagcactcttcctactgataacagttcacagccaactctgtcacatagaagggaccaggcaccactctaggcacatcattgtggttgtagacttcataaaccaaatagaaaatggaactttttttcctctggttttaagcaatggttgcatttggttactaatagtgtatctgttttggaatatttttacaagacaggagggtcaatttttttatggaaagttgtcacattactcagtttttgttttttgttttttgaggcggagttttgctcttgcccaagctggagtgcggtggtgcgatctcagctcactgcaacctctgcctcccaggttcaagcaattctccttcctcagcctcctgagtagctgggattataggcgcgcaccaccatgcccagctaattttttgtatttttagtagagacaggtttcattatgttggccaggctggtctggaactcctgacctcaggtgatccacctgcctcagccttacaaagtgcagggattataggcttgagccaccgcgcccagcctcacattactcagtttattcaacaaaggagagcttacattaaaagtcagctgtgccgggcatggtggctcacgcctgtaatcctgacactttgggaggctaaggtgggcagattgcctgcactcaggagtttgtgaccagcctgggcaacatagtgaaaccccatctgtactaaaatacaaaaaattagctagacctggtggcacacgcctgtagtcccagctactcaagaggctgaggcacaagaatcacttgaacccgggaggtggaggttgcagtgagccaaaatcgtgccattgcactccagcctgggtgacagcacaagacttggtctccaaaaaaaaaaaaaagagggggtgggcaaagaactctcaaaatttatttttccaagtagaagacagaaagatggagtcttcgtcttaggaataaaatatgctaatagaattaattttatctataaaattgaatttccatagtaacattaattttagaaaacacacttaaaagaacaatgaaaccacatcatcatcatagatgggtgttagaattttatttatatagatttagcataagttataagtatggatttcttaagttcatgctgaaatgtgatagaactgggcatgaacaaatttgttaattctgtacaattctccttcttaccatttcaaaacttgcatgaatgaaataagctctttgattttgagggatttaaaaatggatttaattagaaaggatttatttagaaagaagtttttaaagactgtaggtgtttcatgttatttaaaccaccggagtaacaaactacacaaagctactttttagtttctaaatttacatgcttgcccctaaaagggaagaataattgagacaggaagaatagggggtattaagagtaaatataaactgatttttcagtgctccctttcttttgcaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttct

SEQ ID NO: 16934 - DNA, 100567 bp, Human
ttttcatggttaccaggcaaatggtgtggtagagatggggaaaatttaaaaaatcagtttgcaaaacaggtgaatctggcaggtgctctgtttgtttttcctggctgcatgtagttgaaagttcaaacctcttagaccttcaaaatctccctttaatctgtttttcctactttttctgttaaccctgtatcattccctacaccctgaatctagaagcaccaagctattttctcttcctggaatgcactgtgctcttcatgcctatcagcctttatacaggtttcttcttagtttggaatgccattttctccctagtctgcctggtaacttctagtcatcttttaggtctagctcagagttatatctggaaacacttgactttcaaataagagtttattgctctttttgtgtttcactttgtttgcactattctaggactcctatcacattggattgtagttgcctaatctgtctcttttctctaccaccttggacattttagaagtaaaactatgccttgatcttatttgtctcaatggtggcttgtcattgggttgtacgtagcagaggttcaataaaattctcatcagttattatttttctctttttctccccgacctaaataatctcagtacccccagctccctaaactatcaacaaatagaaaaaaagctctattcatttttatccttgttctttactctccttagtttaaacccaaatttgactatgtaaatgtaatttcattttgttaccccttccttcattaaaacaaaaatacccttcatgcacatgcaaaacactctaccccacactattaaaacagcagaaatgaacactaacaaaagccaagataaaaaatttccccaatgttgaatttttggacttagtgtgggggtaggaaaaatggagacataattctggttctccctttggcagttttcaattgctgtttcttaatctcagtcagaaaacacatttctctgcctctccttttgccccatttctaccctctcctcccttgcccctgtgcaaaaccaaagatgggttaagaggcaaggcataatggaagaggaatgttcttttcctccactcccactttcttcttcaaattctgttttgggaccatccttccccaccctcccattttcatctgatggacacactgtctctgttgtctcttgtcatatttgattttatgatatttcatgttttatgtgcttttttttttttttagtaaattcatggacagagaatgtatcctggtaaacacttagattaaaacaaatttacatagttgattactataaatgaaaattagtgactcaaattctccaggtttctaagctacttagactaagccaatcaggtaatttttgctacttctgggcaaaatgtatctgaattcctattcagtggatttgcaggatgaaatctaagtttacctctttcatctctcatttaaatgtggaaaaacgaaatcaataaaaatctatatatgcttattaagcattttaaggagggtgtgaataaggagtgaaagctttgagcagtgactacagcagtttttcgaaagtcaaaacaataaccaatgccaatcagtagctctcttcacctctcacacaataatagagacaggacaggataaaaaagggttacatttaaaaaaaagtatggatgttaaaccattggaaatggcactgtaaatgacaccggaaaagatcgcctccaggcactgtgtggaactttgcaaactcgggtcctcacccgaggaccgcacggccgacctcggggaggctccaccccagaaactatttcattggcgccacctctagcccacacttcccctcttccgcatgcgcacaaggagcagaagccgaccagctcgtcacgtcgccttccccgcccctaaatttccagttccgattggtctgtttcatgggaccgcccctctggcccgaccaatgtggaagcctcctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctggaacctccttgcctcagggtctaactgtggttcacttcttgctctatttttgtgactgttcagccctcgagacgcagtcccccctcccccgcaactttgagatgggtgagagggcatactgccacctggaagagcctgagggtggaggggtggtgcccagggaacgcctcccttttctctgtcctccgtccttgctttctcaacccaggccttaggtgttgttccagcctggccaggactgggccactagcttaggtagaggcatttaaaagatatatatatatgtttatatatatatattttaaatgtatattatatatattatatataaaatatatatatgtatataaaatcaattcagttactcagtcccttggtttcttcttacatacagaaattgtgtgtatgtgtgtgtgtgtgtgtgtgtgtgtgtgtatatatccacacacatatatatatgtgtggatatatatacgcgcatatatatgcatatatatgtgcgcatatatatatatatgcatatatatatatgcacacatatatatgcatatatatatgcatatatgtatatatgtcccttggtttcttcttacctacagaattctgagtaattgaactgattttcccaaggtcacagaacaggtccttcctagagatgtgaaagaattcagactttctacttgagcttagtactgagcttgtcctgggctatgctgccacttagccaaggaggtgaaggggatgagaggaggaagccataggaagggcatgtagcaaactcctcatagtatgactgttgcatgatttttaccatttctgcaagtttcatgtaatgtctctcatcagaatatcagatccagtgtctctcttcagaatatcaggaaactgtagggaaacatgtattgcttccttgtctaataacttctcatgtgcatgctagagctgacatttttggaagtgtgtcttgtggataagaatgaacagttattgagtgcttaccagggtcaggtgctgtgtgtatgtttcatcatctcatttaagggttaggacaaccttaaaaggttagtaaagtttttattcccattttgcagttaggttaatggagtcttgagacagtttgaccaagattacacaggtaagttagtggtagctccaaagctccagctttggaatctaattgatcagattccagagcttccattctaaacaatgtactaagatgcgtgtagatataatttacttggagggcgtcccagtattgtgaaacagtaggtaccataaaggttaatagtaggtgtttttttttttttttccaccaccaagatgagccctcaattctgtcttcaaagcaaattctgtcttcaaagcaaagaaattttggtctaatacttgagaaatagtccaactttccatagttgtaaacttactaaaatctaagtaaaatgatatcatgttatcatgatatatatcatgatatatataaacttgttcttattttaaaaataatacaaacatattaacagataatttggataatggataaaaagtaaaaaaaaaaaaaaaaaatctgccgggcgcagtggctcacgtctgtaatcccagcactttgggaggcggaggcaggcggatcaccaggtcaagagatcgagaccatcctggccaacatggtgaaacccggtctctaccaaaaatacaaaaattagctgggcgtggcagcgcatgcctgtagtcccagctactcgggaggctgagggaggagaatcgcttgaacctgggaggcagaggttgcagtgagctgatatcgtgccactgcactccagcctggtgacagagcaagactctgtctcaaaaaaaccccaaaaaaccaaaaaacaaaaatcaccacccactgcagtaaatattgctaacattttgggtgtatccttacaggtatttccttttagtttcgtattttccatacttttagttttaatacaaatacaacttatttagtcggaagaattatcctacaattcactggagtttttataaccttcttgagaatttagaagaactgttccatggagtagagatgctacaagtcttttacaagttaaattcttgaccccggaatcagattgtcctaagtttgatcttgccttggctgtctataactttggagttactacttatcctctgtaagcctcagtttctttatatgtaaggggttaataataatacctacttcagaaggttgttgtgagggctacataaaacaatgtctataatatacttaacactgtttgacaactgagaatcaagcattcagtcaataagtggaacctttaaataattaccattatgtttttgttgttaaaattttgcaattttgtaaataatgcagatacaagcatttcatgcatatgggttttatgtatctgagattatttctttaggatagagtcctgaatactttaatggattttaagtgcatagttcaaatttatacccatttataccccataatatgtataatagtgtgagtattggatattaatgctaaaattaggtgtgttcatgtacactcttggatattttgtgctaactgtactttgttttaatttttgtttcatttctgttgaggaatattttcccatgtttttgttaaattgatttatttttacttaagaattgaatattagatgtatttacatatttttaaaagtatactcagtatttttcctatcaatactatctaccattattgcatagctgctcttttccaggtgttgtgttagacatcagtttataatcctcacagtaaccttgtgaactagacaatattatgctcattttaaagatgagaaaattgaggctcagaaatgttagtacttacccaagtctggtaagtagcagagccagagtttgaatcctgatgtgtcttactccaaagcctcccacactacttatatactaagattttgtctgttaaaaaatattgaagaacatactaactttctgcttttcacatgtcctgcaaatacttttcactcttttattttggttgttttgacatataaaaggtactgcttaaaaggaggtagtcagattagactctgagttggtgacacttatgctgctttatgctggcatgtttgctccctttattacactgtgttgttctctgagaacagttcatcctggcttctccatgcccctgattcttgggcattgtatggatgtgagtttgtttattcagtcattctctgcatttttattttctcctggatgccatactctctgctagctgctaaggatgtgatcatggacctgtcggagggtaatctgaaccttcgttttggacacttggtatcccctatctgccaggaaattcaaactttttgtagttttttcatccaggatttggctatacacaaggaggtcatccatatactggagtatactcccatttcttaattaattgcagacccctcagattcctctctaaggcccaggcaaagcaatgggggctatcctgaaaaccctgagggagaactgtccaagtgtattattgtttttctctggcattaggattttcccattcaaaggcaaaaaggtattgggattctggggccagaggaatggaaaatgaagcatcttctaggtctaggactgagaaccatttagcatcccttggcacctgagccaggagggtatatggatctgccaccaatgggtggacctaccagtgggtcttaagagcccaggggtaagtaataccttagctgtggatgcttggcctttccttgcttccagcttaattgggtattgtttttgattgggaaaataaatagctaggggtctttaagctgtattttggctggcactgctgttttagccttccttggttttccagtataccatgccagtgtgttaacctgtttattaatgtggtctgggacagtgtctgtatttttgactattagcaatttcaccagatgatgcttaaattgtagtagtgcccctattttaaccataatatctctttttaacagggggcctgggcagcttgatactactagaaattactgttggaagatttgtttctcaatttgacaaatcaaaggaggaataaaggatcttacttgtggctttccttccattcccataatggtcgtggactgggaggaaagttttcctacataagtagtaaggaaagaaactgaatttgtattgaaaagaaactgaatttgggtgcccatgacgtccagagttacctgggggctcctcagtagtaattacgatgttcctgaacaggggcagtgaggaagaccctgggtcgcttcagtcttcatctaatttctcttttgcactgctagagttttgccttattgaaccccttggtgggagcagggccagtcaatcttccagtgccaggggttgtaactgatgctctcgcatttttggcaggggactggcaggggcttaatatagtcctttatccaattctcgtttttcttgcatttgaagcaagagtctttgttgtgcagattatcagaggcaagccaaatcaaccaaattccaagtggctggtgtgctccatcaattcctgcaggcctgaaataggtagcctaggaattccaaataaatagaacacatgatgacttgttggaaattcgcaggaaacaaaataactattctcagaaccaaataaaagccttccactagaaactaaaaaatgtctatggttttatatatatgcatacacaagtaaaacccaaaggagaacaaatagcaaacaaatgaaaattagaagcaaaaacaaatagacaggaaaccatctctaaatttttcctacttagtctacccggggggctacagtgttacccagagccccccagaaaaccacataatgaatattttattcctgatacacaactcaatatccttaattccaccagtatcaccatacatactgtgcaatgaagaaattcactctaggcacatgaccagtaagtactccagtgccagcttgtttagtaaagttatacttaagtcatgtgaacttgaaaattgcttagacttatttacttaatttatgagcgctcctttaattataagccaatctgatagacacaacatataacagtaagtgtacatacaaataaacacatctagacatgtatacacaaacacaaatgaagatccaatagctttttaccttggaactctagccatgagatagcaatataagtccactggttttactgtttgacccaatgggtaatccagtgaaggctgtgaaccaaaatttcaggtcaagcagtttccatggtagtttgatttttaaaggccaaacctccccagactccaaacactggggccaaacagcaccaaaggagaacaccacatgctaaccaggccaaccctacttagaacagcagcacaaaagcctggatacatgcacctccatcccaccttcccattcaacagcaaactccagaattccaagcaatactgggccaaacagtattgcaaaagaatatcaagtttactgaatccttatttcccattactatatcaaacacacacaaacaatgactgcagcacagtccaactgctgcagcaacaaacaagccccaagagtgtccagactgtcccattgtcacctgtgagagaaaattccaaggaggcctttgtgctagacctcagaacctctgccgagggcgtcccctttggagaggttcaggtctggagttggattccccggggtgttcccctttgggatccaatcttagagtgtcagacgtctctgaccttagttaggcatgggtgctgctttgtatgttttccctccagaggtgatggcgtactatgaaatttgttttgtccctggatgaaagcctcaacttctagcatacttatgatttgataagaccatgctttcccttgcttcccgttccactagagtgttagccatgaactttaatgataggaaccggaggtgggtgcatttcttttgtccttagcaagtcagatagaataggagaaaggtcaaaactcctaagagacatcattgtttgccattactggttaacctataggataatttggcataagaaccctgtaggagaatttaacataagaaaacaaagtttaagtcacctgaaacgtgtgaattcaccctggatgagctgccatggccaactgcaacacacgtaaggatcatggactatagctggaaaagatagaaaagagtcctctccttccccctcctggtatgggcagctatcccccttggccttcaggtaacactggaaagtggccctggccagttgcccacaattatcagggagctactaggaaatggccactgaaagactgaaaaagaaaaaaaggaaaggactcaggcctctcacccaaactgggcggtggtggtcaggtgcttccacatagaaaactcttggtttcactggagtgtggccccggccagaaacctgcagttgcctctgtgcttaggcattgtgcgctgaagggcccaagttggaaagggaaaagagaaaaaagcattcccctgtatggagcagagaggaaaacgagaagaaaaataaatctccaattttgggcttacctcctggctggctttccaaaatacgttactggtggaggatgtccaggttcttggcattttgaacaaagaattggacaaaaggcacaaagaaaacaaggaaaaaatgaagcaacaaaagccgagatttattgaaaatgaaaaatgcactccacagggtgggagccggctggagcaagtggctgaagattgcaggttacagaattgtctggggttggtcactttccgcaaccaatcagaagctgaagttacaaatttacaccctatgcaaatgtctaattggtcatagaaagcaaccattcagaggctgaagtgaagttacaaagttatactcctatgcaaatgaagacttggcccatgactagcctgattggttgtgggaggggatcaatcaaaggtacttcgaattttttcatctgccacgcagaaaaggggcaggagggttgcaaagggagtggcttctggtccttttgttacttgggcatgggaagttggggttggggttttccttttgatttagttctaggaagtcagcatgagttggccttaggttccctgcctccagaccctattctgcctcaaaggaaagaaatggcaagctctggaatagaatatagtagtgctagattttttttttttttttaattaaatacagggtctcactctcttgtctaggctggagtgcagtggctcaatcatggctcactgcagtctctacttcccaggctcaggtgatcctcatactcagcctccagggtagctgggactacaggcatgcaccaccatgcctggctaattttttgtagtttttgtagagacagggtttcaccatgttgcccaggctggttttgaactcctgggctcaagcagtcctcttgctttggcctcccgaagtgctgggataaaaggcatgagccaccacgcctggctagtgatgctagatttaagctatattttggaagtaggatttgataggttggatgtgaaggatgaaaaaaaggaagacattgtgaagatacctcactggtttgtggcacgggaacctgggtggagggtagtgccgtttgctaagatggaaaagattagttttgggagccgacacaagaattcagtttgtgcttgttgaaaagctcaagaaactcaagtggagaactgatgactgttggatataaaagtcaggagttcagaggagaggcctggctgggttggagataaccatttgggagtcaccaacatataaagggggttttaaaaccacttagagattgagtagaggaactagcttaaaggaagggaagcaccattgtttcttgacagaagttaccaggtgccctgagatggggcaacccagggactctagacccagtctcttcaactttacagttttgttcctgtcacttttgttgtctttagttgacccttcctcatcctctgccaataccatttacttcctttcttatcatggatatgtgatacacactggtaccttacaaaggcaattgcctttatggatctttcatttcattttttttaagagaaggggtcttgctatgttgcccaggctgaagtgcagtggctattcacagccacaatcatcatgtagtacaaccctgaactctcctgggctcaagtgatcctcctgcctcagcctcttgagtagttgggactatcgtcacgtactactgtgcctggcccatttacattttaatacaaaatgttctgtccctgacatttgggttctccctcagtcttattttatgaagtagatgctggctaactcttagtagagtttagaataagatagaggtacatacctggtcaatagaaagggattcctggagaatagggtatctggatggagggtagaggttttgttggggaaaacaggtagtttcttagtatcctgttatttcatgatgtgaattagtgccagattgtttcattgacatcattcatcatacttcaccaggcatatactgattgtcacttgtgtgttacgcactgcgataaatgctggggtttctttttttttttttgagacagagtctcgctctgtcacccaggctggagtgcagtggcgcgatcttggcccactgcaggctctgcctcccagattctcaccattctcctgcctcagcctcccaagtagctggaactacaggcgcctgccaccacgcctggctaattttttgtatttttagtagagacggagttttaccgtgttagcaaggatggtctcaatctcctgacctcatgatccacccccctcggcctcccaatgctggagtttctaaggaatatgagggatgtgctgtaacacacaggtctatatcaataactaggcagtacagaggaaagccagtgccgaacgtattggcacaaccttcactttctgcaagtagtccctaattttctgtatcatagctgtatatttttatgtgtttgggtctaagctataaatccactcactgaccgtgtgctctgctcttggccttatttatttctggagattgctgacatttgcccttttcctcagatgctctatccctgtgggaggcttctcttttcctttaacactgctgcatactgcatagttattaaagacctaccccatcagactgttgatgcaataacacctctcatttgcccccctcctgcagtttgtctttgaatgtgacattggtaggtcttttttcttagacatttctttctctttaagttgttggttaatatttttcttttagtttccttaaacgtttattgaaatagtgtttgcatgtgttcattcattcattcaacaaatatttatttagcacctattacatgtcaggccctgttgtgagcactgaagacacagctctgatcaaaagcatttaaggataccagtcctcttggagcttatgttccattatggtctttacattctgcctatatgtcacctcattttttcagcagtgctgatgacctgcatattcatgattctttacttagtacaatttcaattaaacaactcaatgccagccacagagccctgttttaacaataggcaaccattaacttgcatccttgatatagaagaaagtgtgctgctgtattttgttgttgtttgttttgctatacctttttatcttgaaaaagaattaccagtctggttttaaaatgtagcagtcatttattagtactgtgtgattgcataattaggtaactgtgcttaataaatttttagtgatgtatatagattattttttaacagtcttaccagcagtacagctttggttagcacatgctataagtaggtttatcttactatggcagacataagcatagtctatgaatagtctttgatgtaacctctaggagaataaataactctaaggaaaatatatattaaaaaaaattacctgtgaataacttgtgatttcttcttgccttgtccacaaatcatgctgtaactttaaaaaagaaatgaaaagtaaatgctgctccattaaaatttgtaatttaaaacttagaaaagtatctggtagaatagcaattaatccaaaaccctaaaattttgaatctgtttgaaaaactattcaggagtgaaagtttaggtattcacatggaaataattacctttaaatacccttactggtaaattattttatacaagacgaatagattctttgtggttatcagacaataattgaaatgtttactttgtatgatttttattattaaagtctttgcttcctccctactaataacttgctgagcatcagtgcaataagatatcatgtcattcagtattaatctgaatgttcagcagacttgaaataaatagcaacttagatatttagacattttgttgggaataggcccccaaatctggccataaactggccccaaaactggccataaagagaatctctgcagcactgtgacatgttcttgatgaccatgacacccacgctgcaaagttgtgggtttacggggatgagggcaaggaacacctggcccacccagggcggaaaaccgcttaaaggcattcttaaaccacaaacaatagcatgagcgatctgtgccttaaggacatgctcctgctgcagatagctagcccagcccatccctttgtttcctgtaaggaatacttttagttaatctataatctatagaaacaatgcttatcactggcttgctgtcaataaatatgtgggtaaatctctgttcgaggctctcagctctgaaggctgtgagacccctgatttcccactccacaactctatatttctgtgtgtgtgtgtctttaattcctctaacaccgctgggttagtgtctccccaaccaagctggtgtcagtacatttttattctggctaggttcttagctatggaaatcctcatagacaagtcaagatcttactttatgaaatgtatgcaataggagagtcagtgggatgtcactgtgattgggaaaaatgtttacccaagactattatcttctgaagctgggcaccaatatatacttgaagaatatttataaaatcgagaaggatttaaggaaagtacaggcctacctcggacatattgtgggtttggctccagaccactacaataaaatgaatgttgcaatatagtgaatattacaataaagtgagtcacacaaatgtattggtttcccagtgcatattaacatgtttacattgtactgtagtctagtaagtgtgcaatagcattatatctaaaagatcaatgtacatactttaattaagaaatactttatcgataaaaattgccaacaatcatctgaaactttggcaagtcataatctttttgctggtggagggtcttgccttgatgttgatagctactgactgatcagggtagtggttgctgaaggttgtggtggctgtggcaacttcattaaaaaaaaaaaagacaacaatgaagtttgctgcattgatagaatcttcctttcatgacagatttctctgtagcatgagatgccgtttgatagcattttaccacagtagaacttttttcagaattgaaatcaattctcccaaaccctgccacttctttatcagctaagtttgtgtaatattgtaagtcctttgttgtcatttcacagtgttcatggcatcttcattagcaatggatttcatctcaaggatccactttttttttgaattcatagaaagtaatagattccatctcaaggctccactttctttgagttcttcaggttgcatacgtaaagagcaactcctcatccgttgaagttttatcatgagattgtagcaattcagtcacatcttcaggctgcacttctagttctcttgctatttctaccacgtctgcagttatgttcttctctgaagttttgaatccctcaaagtcatccatgaggctgggcatggtggctcacgcgtgtagtcctaccactttgggaggccaaggctggcggatcatctgagctaaggagtttgagaccagcctgggcagcatgtgagacctgggctctactaaaaatacaaaaaaattagcaggcatgctagcgcatgcctgtaatccctggggtggctgtggtgtgagaattggttgatcctgggaggtggaggttgcaaaaaaaataaaatgaacgaatgaatgaatgaataaatgaagtcatccatgagggttgaaatcaatttatttcaaactcctataaatgttgacttcttttttactgttttttgagacagagtctcactctgtcacgcaggctggagtgcagtggcataatcttggctggctgcaacctctacctcctgggttcaagtgattcttgtgccttagcctcctgagtagctgggattacaggtgtgcaccaccatactgggctaattttttgtatttttggtagaggatggggtttcgccatgttagccaggctggtctcgaactcctggcctcaagtgatccgcaccccccttggcctcacaaagtgctgggatttcaagtgtgagccatcacgcctggccaatgttgacattttgaaatttcatgaaccatgaacattctaaatggcatctagaatagtccttcccagaagattttcaatttactttgcccagatccatcagagtaatcatttatggcagatatagctttacaaaatgtatttcttaaataataagacttgaaagtagaaattattccttgatctgtgaggcacagaattgatgtattagcaggcatgaaaacaatgttaatcttttttttcctattttttttttcattatactttaagttctagggtacatgtacacaacgtgcaggtttgatacataggtatgtgccatgttgttttgctgcacccatcgactcatcatttacattaggtatttcttctaatgctatccctcccccagcttcccaatccccgacaggccctggtgtgtgatgttccccgccctgtgtccaagtgatctcattgttcatttcccacttatgagtgagaacatgtggtgtttggttttctgtccttgtgatagtttgctgagaatgatggtttccagcttcatccatgtccctgcaaaggacatgaactcatcattttgtatggctgcatagtattccatggtgtatatgtgccacattttcttaatctagtctatcattgatagacatttgggttggttccaagtctttgctattgtgaatagtgccacaataaacatacatgtgcatgtgtctttatagtagcatgatttataatcctttggatatatacccagtaatgggattgttgggtcaaatggtaattctagttctagatccttgaggaatctccacactgttttccacaatggttgaaccaatttacactcccaccaagagtgtaaaagtgttcctatttctccacatcctctccagcatctgttgtttcttgactttttaatgattgccattctaaatggtgtgagatggtatctcattgtgattttgatttgcatttctctgatgaccggtgatgataagcattttctcatgtgtctgttggctgcatagatgtcttgttttgagcagtatctgttcatattctttgcccactttttgatgggtttgtttgtctttttcttgtaaatttgtttgagttctttgtagattctggatattagccctttgtcagatgggtagattgcgaaaattttctcccattctgtaggttgcccgttcactctgatgatagtttattttgccgtgcagaagctctttagtttaattagatcccctttgtctattttgtcttttgttgccattgcttttgatgttttagtcatgaagtccttgcctatacctatgtcctgaatggtattgcctaggttttcttctagggattttatggttttaggtctaacatttaagtctttaatccatcttgagttaatttttgtataaggtgtaaggaagggatccagtttcagctttctacatatggctagccagttttcccagcaccatttattaaatagggaatcctttccccatttcttatttttgtcaggtttattaaagatcagatggttgtagatttgtggcattatttttgaggcctctgttctgttccattgatctatatctctgttttggtaccagtaccatgctgttttggttactgtagccttgtagtatagtttgaagtcaggtagtgtgatacctttagctttgttctttttgtttaggattatcttggctatgtgtgctcttttttggttccatatgaactttaaagtagttttttccaattctgtgaagaaagtcattggtagcttgatggggatggcactgaatctataagttactttggacagtatggccattttcacaaacagattcttcttatccatgagcatggaatattcttccatttgtttgtgtcctcttttattttgttgagcagtggtttgtagttctccttgaagaggtccttcacattccttgtaaattggattcctaggtattttattttgtttgtagcaattgtgaatgggagttcactcatgatttggctctctgttaatggtgtataggaatgcttgtgatttttgcacattgattttgtatcttgaaactttgcagaatttgcttatcagcttaaggagattttgggctgagacgatggggttttctaaatatacaataatctcatctgcaaacagggacaattttacttcctcttttcctaattgaaaaccctttatttgtttctcttgcctgattgcggctagaacttccaacactatgttgaataggagtggtgagagagggcatccttgtctcgtgccagttttcaaagggaatgcttccagtttttgccaatttagtatgatatcggctgtgggtttgtcataaatagctcttattattttgagatatgttccatcaatacctagtttattgagagtttttagcatgaagggctgttgaattttgtcgaaggccttttctgcatctattgagataatcatgtggtttttgtcattggttctgtttatgtgatggattacgtttattgatttgcatatgttgaaccagccttgcatcccagggatgaagttgacttgatcgtggtggataagattttttatgtgctgctggatttggtttgccagtattttactgagaatttttgcattgatgttcatcagggatattagtctaaaattctcttcttttgttgtgtctgtcaggctttggtatcaggatgatgttagcctcataaaatgagttagggaggattccttctttttctattgattggaatagttccagaaggtgtcgggggaacccgcccccaatattttaacgtaggttctttctgttttccataagtgtcatctggctgagaaataaagagaaagagtacaaagtgaggaattttacagctgggccgccgggggtgacatcccatattggtaggaccatgatgcccacctgaggctcaaaccaacaagttttttattaagggtttcaaaattggagggggtttaaaacagggagtaggtacaaagatcacatgcttcaaagggcaaaaagcagagcaaagatcacatgcttctgacctaacaggacaaaaggcaaaacagaactactgataagggtctatcttcagctttgcacatattgtcttgataaacatcttaaacaacagaaaacagggtttgagagcagagaaccagtctgaccacaaatttaccagcttggagtttttccccaccctaataagcctgagggtactgcaggagaccagggcgtatctcagtccttatctcaaccacataagacagacgctcccagagcggatgtttataggccttccccccctcccccccggcccccccaggaatgcattcctttccctgggtattaatattaatattcccttgctaggaaaagaatttagcaatatctctcctacttgcatgtccgtttataggctctctgcaagaagaaaaatatggctctttttgcctgaccccacaggcagtcagaccttatggttgtcttcccttgttccctaaaaattgctgttattctgttgtttttcaaggtgcactgatttcatattgttcaaacacacatgttttacaatcaatttgtacagttaacacaattatcacagtggtcctgaggtgatgtacatcctcagcttacgaagataacagaattaagagattaaagtaaaacaggtgtaagaaattataaaagtattatttgggaactgttaaatgtccatgaaattttcacgatttatgttcctctgtcatggctccagccagtccctccatttgggatccctgacttcctgcaagaagaaggaatggtaccagcaactctttgtatctctggtagaattcagctgtgaatccatctggtcctggactttttttggttggtaggctattaattattgcctcaatttcagagcctgttattgttctattcagagattcaacttcttcctggtttagtcttgggagggtgtatgtgtccaggaatttatccatttcttctagattttctagtttatttgcatagaggtgtttatagtattctctgatggtagtttgtatttctgtgggattggtggtgatatctcctttatcattttttattgcatctatttgattcttctctgttttcttctttattaatctttctagtggtctatcaattttgttgatcttttcaaaaaaccagctcctggattcattgatttttttgaacggtttttttgtctctatctctttcagttctgctctgatcttagttatttcttgccttctgctagcttttgaatttatttgctcttgcttctctagttcttttaattgtgatgttagggtgtcaattttagatctttcctgttttctcttgtgggcatttagagctataaatttccctctccacactgctttaaatgtgtcccagagattctggtacgttgtgtctttgctctcattgatttcaaagaacttctttatttctgccttcttttccttatttacccagtagtcattcaggagcaggttgttcagtttccatgtagttgtgcggttttgagtgagtttcttaatcctgagttctaatttgattgcactgcggtttgagagacagtttgttgttatttctgttcttttacatttgctgaaaagtgctttacttccagttatgtggtcaattttagaataagtgtgatgtagtgctgagaagaatgtgtattctgttgatttggggtggagagttctgtagatgtctattaggtccacttggtgcagagctgagttcaggtcctggatatccttgttaaccttgtttctcgttgttctgtctaatattgacattggggtgttaaagtctcccaatattattgtatgggagtctctttgtaggtctctaaggacttgctttatgaatctgggtgctcctgtattgggtgcatatatttaggatagttagctcttctttttgaattgatccctttaccattatgtaatggccttctttgtctcttttgatctgtggaaaacaacgttaatcttatacatctccgtcagagcgcttgggtgaccaaggcgcattgtcaatgagcagtaatattttgaaaggaatctttttttttcctgagcagtaggtttcaacagtgggcttaaaatattcaggaaaccctgatataaatagatgtgctatcattcagggtttgttgtttcattgaaagagaacaggcagagtggatttagcataattctcaagggtgctaggactttcagaatggtgaatgaacattggcttcaacttcaaatcaccagctacattagccccttacaaaagagtccacctgtcctttgaagccaggcattgacttctctttagctatgaaaatccaagatagcatcttccaatagaagctgttttgtctccattgaaaatcttttgtttagtatagccaccttcatcaatgatcttagtgagatcttctggataatttactgcagcttctccatcagcactttatgcttcactttgccgttttatgtactgagatggcttctcttcttaaacctcatgaaccaagctctgctatcttcagatttttcttcggcagcttcctcacctctgtcagctttcatagaattgaaaagagttaggaacttgccctggattaggctttgacttaagggaatgtcgtgtgtgatttggttttctattcagaccactaaaattttcttcatatcagcaataaggctattttgctttcttatcatttgtgtgcttactggaataacagtttacattttcttcaagaacttttcctttgcattcacaactaggctatttggtgcaagaagcctagctttcagactctctggactttcagcatgccttccgtacttagcttagtcatttctaacttacgatttaaagtgagagatatgcagctcctcctttcacttgaaaacttagagatcactgtaggtctaattttcatattattatgtctcagggaatagggaagcctgaagaaagggagagataaaggagaatgactggtcagtggatcagtgagaacacatacaacatttattgaggttactaatgtaattgtcttggggtgccatggcagaatgtcagaaggctgtggcaccccaagacactataacctcaaagatcattgatcagagatcatgataacagatgtaatagtaatgaaaaagtttgaaatattgtgagaattatgaaaatgtgattctgatgctgatagacttgctagatacagggttgctacaaagtttccatttgtaaaaattgcaatatctgtagggcaaaataaagtgaagcacagtaagacaaagtatgcctgtatctattaagtgttatagccctagcctgaagaaaaataaatttttaagtaatcatggacatgtggtatgattgtatatcttttgccataagtgatataaaataatatttgagtaaattcgtattatctccaccaaatataagagtagaaacaggctatgattgtgggcacagagggcagaggacgtatctgactggggattgccaagacctgaaccctgggcattcagtactgttgaaaggatcagagagacattagatgccagagtaggcagaacgtcagaagtctggagtatcggtggataatggaaggaggaaagatgtcatatgtcagaacctgctgtggagcaatgccaggctagggaagaaaatgggtctccaggaaaaggacaagtgaccaatgtcccatggtcagacagttgaaggcaacagcagtagctgttgtgacccacactgggaattagatcttgactgttgggacacactaggctaatgaatagcatggaggttaggtgggcagtgatcagggtaagcaacaggtatcgaaatgatttgttatcagcatgctgtgggttaaggcgactaccagcgtgtagatcaggcactaggataaagagtgggcctttcgatcgggagatttaggctgaagccgttctgtgctctgaattgtaattttgcagaggagttgacttaaagttttgggatgactgtgggcattgggcagcacctgagcttgaatcgaagctctaatgtcatgatgtttctgaattctaacatttagaactttatcaaatgaagctttcctataccattcagaagagtactaaggtgaagatagaaggacatggacagagtccagaacctaacaatgaatagctaatatttattcagcactcactgtgtcaggtactgttctgagtgtattacatgtactgcttcatttattcctcctaaaaaatccatttagggaatggacactggctcacagatattctatttaagtaataagacaataagaaggactaaatatgatgtggttaggcataagattatggtatgttccaaactccagcagttccgggtaccaaagtttatctttacccttccttattgttttatggtccatgaccatttgctgttgacgtatttagcacatgccactggtcatgcacattccttatggcttaggttcctaacacctgtctgtgcttcttcccagaccactcactttgacgggtctccctttctgactttccataggtcttattgtctacacgcatttagtcacttggttatattccttcttcctgttttatacttttacaaaaaattgtttagtatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgcctgaattgtggtagctgtgttaattccagaattgaagatttgcttaaaatatttatgtggagctcaatggttaacattgtatctacctgacattttcaaaggtatgattggggctaaataatcaaattgcaatattagtccacttattaccagttagttctcatgtatatttaacatcaagtcagctttctcttacagtgtgtgtggtcctgatattgtattaataacttctggattaaaacctgctgtgtactcctgtttctttggcacatagaagaaaacaaaataccttttcattcagctatttatttataaaatgaagacttgattttatgcttccctttggaatacattgtcattcaacttgtaatatgttttggaaataattgtaatatttatatataattttataagtatcttaatcttcatcttattaaatcattgatacaaaaccaattgttcttccactgtatgttttcaaatttgattggctttacttcatatatgtatatacatatatatttaacatatatctatatatacagtttatatatgtgtgtgtgtgcatatatgttgactatacattgggcttccaccttccacctgataatctgtagttttaaggttaaatgaaaaacaggttattttttagggagaagtgggagctggactaaaggatgattagatcttgatttgttttgaatgctacttgcggatgattgaactagagaagtaaattcaaacatagagaagggtgagttttttcttggggtcgataaaaactggttaggtacgtttatgagactagcattcagctctatgaataccccttattttaaagctcctgccaatttccacctacaccattctttgccttgcttactgtgtccttcgtgcttgcctcctttctgcttcacacagtctaaatccctttcctatttgtgactgttcccttagcttggaatgctcttctgatggcttacttactgtatgctgtgtctcaggaaaaaccacaggcctggaagtctggagcatgagtcatagttctgcctctagctttctgacttggccagtcaatttaccacttctctggtctcgttttcttcatggataaaacaaatgagattctagatcagtggttctttctcaactggggatgatcttagtctccactcccacaactctgtttacatttaacaatgtaagtgaagacactttttgttgtctcaactgtgtgtgtgtgtgtgtgtgtgtgtgtgtgtgtggtaactgtcatccagtgggtagagaccagggttgctgctatgtatctacagtgcacaggacagaccctcacaacaaaagaatcatctagtctaaaatgtcaataatgtagaagttgagaaaccttgatcgagatctatggtccatttatcttttgtgatttaaaatgtaaacatttaaattacttatttctcattgttagtattatttagagattattaaataaaatgtattatttaaatactgtttttcagtaatatttggtgaagatgttgcctttggtggagtctttagatgcactgttggcttgcgagacaaatatggtaagtaaatacctatatgaatagtattctgatagaacttttactaaaagatcttaaaaatacaaaatatgcctactaaattttttgtcatatccccattgtatggatgaattccttttcatttccaacgccacccgcagaatcctttggcctatattttctcaaatgtcttctagtatccctctgatctagttcatattacacatacagtgtaaatgattccaaaataattgtcattaaatgtatattatttattgtgtcattcttctgtccaagaacctttggtgttttattgctagctgcctgagccaatttcaattccattgcctccagttggagattctgcctgttgggtctttattagcaaactttatcttttcgggaagagagagagagagagagggagagggatttagtttttaaggaactggctcatgtgagtttagttttaaggaactggctggcaagtccatagggcaaactggttgacttgaaactcaggcagggtttctgttttagccttgaggctgaatttctttttgctcgggaacctgcagtcttttctcttaaggccttaaattgattgtatgaagcctacccacattataaaaggtaatctgctttattcaaaatctactgatttaaacgctaatcacatctaaaaaataccttcacaacaacttctacacctgtgtttgaccaaatattaataattgggtgccatagcctggtcaagttgacatataatgaaccatcacattatccttcttacatgttttatcccagctgatgtctttaattggcatgtgattgatttctgcccattgcttttattaatttcatttgactcagttaaaataatcagaatgcattttggtccatctttgaattcccactcttctgacttgcagtgtaaggaatgtgttttgacctcctattgttagggatacctttgaaatgcttttgacattttattttttgtcttagtcttacctgatttagaattcagcaaagcagttcacgtgagggctggcaggagctgatatctccctctcttctttcctttggcattgctctatattgcttgtgtattcatacggggcaagaggagtgagggtctttaaaatttttttttaaattgttgtctctttttctgttccactctttctgaggttatgttatacttaaatccaagaacccatacatgttccatctcacttattgggaacttccagcttagtcttttcttttccatttatagcaggttgagtttctggatccagtccgtctgctttctcctacttctaatacctgcttagagcttgaggtagttgggcaaaagattatttttcctgatcatttagactcctgctacaaacttttagatctttaataaacagttaaaaatctttacacatttgatttcaaaagtaatgcatatacattgtagaaaatttggaaaatatagaaaagcataaagaaaataaaaattgctcatgttttcagagataacttggagataaccactgtacacgtcttggtatatatacttctagactgtatttgaatatgtttgtatatattaactaatatttcaaacacagaattatacttctgtaactgagtcttctctgtatccagtataactatgctgtggagcagtgtctagacctcacaattccatcttgcctgactcagtgtagtagcatgccatgtgctttctgaatagctaatatttattcaactcactgcgtcaggtactgttctgagtgtattacatgtactgcttcatttattcctcccaaaaaatctaggggtttgtgtaggctgttgagtcctctgctgcctgtctgcccaggttctcatccataacactctgcttaccccttctgtctggggcattttatcgatgccatctgctgctcatacactggtgactcctgaatttctgtctctagttcagacttccgttctgagcttcagatctgtgtattcagtttctactgcacatcttcacctcagtgttccacagtcacttcaaactcagcatttccacacctaaggctgctacatgcacccagcaaatatatgcctcctagtgcatttcctattttggtgaatatatcaccatccatttagttacctaagccagacactggggaaattctaagtgtcttccttctttctagttccccacatccagtgaagttgtataattatatctaatctggcccctcctttccattcttactgccctgatacttaagatctttcatttttctctgcctgcagagttttatttcttttcttagcagtcaccactcctttagtcttaccctccctccaatccattccctatcttgttgccagtgtgatgattttaacatgcatatttcttagcaggacatacaaaatacttttttttttttttgagatggagtctcgctctatcgcccaggctggagtgcagtggtgcgatcttggctcactgcagcctctgcttcctgggttcaagtgattctcctgcctcagcctcctgagtagctgggactacagccgcataccaccatgccctgctaatttttgtatttttagtagagatggaatttcactgtgttggtcaggctggtctcaaactcctgaccttgtgatccacctgcctcggcctccctaagtgctgggattacaggcatgagccactgcgcctggctaccaaagactttgagaactacttaggtagctacctgacctcatctgcttttatttttattttatttattttatctattttttagtttttactctacagacctaggaacttgagctttttaaaatttttattaaaactaatgttgagttactggttgtttctcttaagccccctgttgttttttcttctctcttcctttgcacttgctatctgggtctctctaccctgtctgattacctggtagactcctatttcttcttcagaagattcccctgtgaaactcttccggaccctccaagcagactcaggcagttctttatcactattcacgctgcaccttttaaatcttgaaagttgtactgtaatccataactcccaccagaaagttgtcaaaggcagcagatctttaagctgttccacagaatggatccctaggacctaatattgtatcaggcagtatttatgaagtgcgtgctgttgagtgaatttaccctttgctctcacttagacagtgtcctactgtctcaggaaggggatttccctctctcacattaattatttaggttggtctgattttattttccttaaaaaataggttaaaatggggagaaactaactcttaacttgaaaaagtccagtgctcttagagggtacctgcaaatttatgtttcctgtcatggcaggaggctgagctaactaatggctaagtaactcttttagctttattgtcagcagctgctgtgaatttttacaatagttttagggcagtgaagttacactttattaatttcaggttgaggatgttgatcaagatgaaaaattaaatcgctgatactttctaatgagagtaagtgagcttctgttttcagaagtgaagaataaaggaaagggtgaagagaaatatattaaaatacatttttcttgcatatttaaaaagtaacatatacttaaaaaattatctgcccttttgaatatagggcaggaatttttagctatacagaagcataactgtctgcttaggatttttaaaggataatttgtatttaaaataactaaaagattatgttgatatagttcaatataacaatcaagtcacactgcattaaatgacatagcaaagaaaacccttgtgccagatcagttcgctttctggggagtgctgaatgttgagtgggaaaggatcaagtcagcaggtggcagcctaccctttgaaatgagaacatccctgttggcattgtgccagcacttgaactgctgcaaagcattttatattccatcagaaggcggaatttgaaggattgtgggttactgacatacgttgtaaagctgaatactacttgatatgacaaagaaggaattgcataattagaggcaatgctataagaaaaggaagagaggcatagagcattttgtattccagacgatccagatgagtgtggatttagtaccactaaactgcttctcttccttgtcctttgatagaacaaaatagtatgagtgctttgaaaattagaagaaagaaaatagtatgtcctcatcaacattgcattccaaatggcagctttaaccactgtacgtaatgagatgtattgattaggagcaacagctggacctctggggaagcagggagtgggagagggcagttaaaggtagttgatttgtagggtatgtgtgattttatgttgaatgccacacatgctttctttctttcttttttttttaagacagagtcttgctctgtcacccaggctggagtgcagtaatgcgatcacggctcactgtaacctctctctcccaggttcaagcaattctcctgcctcagcctcccaagtagctgggactacaggtgcccaccaccacacctggctaatttttgtatttttagtagagacggggtttcatcatgttggctaggctggtctcgaactcctgacctcaggtgatctgcctcccttggcctcccaaagtgctgggattacaggcgtgagccactgtgcctggtgtcacacatgctttcattcatataagtaatgagacagattcctcatggcatataaaaaatccattcgtattgtcattctctgagagagagagaaagagaaagagtgtatgtgtgtgtgtgtgttattaaaataagattttggtgtgtcaggtttaaggtatgtttgtaacattattctatactgatataacttgcctggttgtggttcttagtgtatatttggcccacttattggaggaaatttaggtgaggaaaggaatagctgaggacctcctgaattagtctacaggcctaaacatgtgccttttcatgggacttgatgtttttccattactgtatccattcctttacaccacaggtgtggcctgtcatagcagcttgggaaaactaatataaccacttacttgttttcttatgtaaacatcactgaaattgtataaccagatactttaatacactgaagtcaggttggaaaactaggacaggcatgcggtgaaggcaagtttttgtctataatatatcaatatttgggagttgactttgggcctcagtatcctcatcagtaaattgaagggaaaggactaggtggtcctctgggattcttccagagcatacatttaggtaagctttatggttttatttgtttttaaaaagaggaacacagttttttcatgctttgattccctttacatttagaggtttttttgaatatagttgttatagcattttggaaccatggggtaccttaggcatttaatttaattttttcttaagatgtcccttttccagcgttttgttttattttatttatttatttatttatttatttgagttggagtctcactctgtcacccaggctggagtgcagtggcgagatctcagctcactgcaacttccattccccaggttcaagtgattctcgtgcctcagcctctgagtagctgggataataggcatacaccactatgcctggctgatttttgtatttttagtagagatggggtttcatcatgttggccaggctggtctcgacctcctgacctcaagtgatccgccagccttggcttcccaaagtgctgggattataggtgtgagccaccacacttggctgcttttccagcataagttttaaatttaggggtgttagcaaaatctttgctctcttacatattttttgtgaattatgaaattaatgtctttaacagagaaagtgatcttccattatatgttcttgttgcaaagaacgggttatttgggtgatactcatactcttggatttagtgtcagggttccattgtagaatggcaatctgtgagatgggggtttggtttctgggttgttgaaactaattttatggaagaaaaaaacaggataaaattcaggaaaattccttagggaaattgaatatgtagaggatttatttcccctattgaagtatacatatttatgacatacaagcagattgaataccagatatagattgtgagatgtctaacaggaatttggagtgaaaacaggtattaataagttggtgtaaatctggtttcctaatatatttattaaaaatatttttaaaggattgttagtagctttaaattgctcttgatattacaaagttcttttgttttccaaaggtgcacatgttggcagaactagatgaacatgtttaatatgcctttttttccccacagtgcttttttcacaaacattaatttatttctaaaaattatggtcaaatatatataacatttactgttttaaccatttttacagttcagtgttattaagtacattcacgttgtggtgcaattattaccaccatccatcaccagaacttttttcatcttacaaaactgaaacactataaccatctaacaataactccccattttctctccaacagtccctggcaagaacccattctactttctatctctatgaatttgactgttccttatgtgagtggaatcatttagtatttgtccttttgtgactgccttattcatttataataatgtcctcaaggtttattgatgtttcagcatgtgtcaaagtttcctccctttttaaggctgcataatattgtgttgtatgcatatactacattttgtttatccattcatttgttgatggatgtttgggttgcttctgccttttgcctattgtgtcctaagactgctataaatactgatgtgcaaatatttggtagtgtcactgcttttttaattcagaagaacaaagttggaggactcacagttctttttttcaaaacttactgcaaagctgtagttatcaaaacggtgtgacagtggcaaaaagacaaacattgatgaatggaatagaatagagaacccagaaataaacccttgaatatctagtcattaatttttgacaatgatgccaataccattcaacaggggaaaggacagtcttttcaacaaatgatgctgggaaaactggatattcacatgcaaaagaatgaatttggacctttatttaacaccatatacaaaaatgaactcaaaatagatcacagacttaaatgtaaaactataaaactcttagaagaaaatgtaggggaaaagcttcgtgaaattggatttgataatgactttttaaatatggctctaaaggtataggcaacaataaaaatagataaattggactgcatcgaaattaaaaacatgtactttgaaggacactattaacagggaaaaaaggcagttcacagaatgggagaaaatacttgcaaatcatgtatcagataagagattaatatccagaatatatggagaacttctaaaactctacaaaaaaaaccccaatcaattaaaaaaataagcaaaggacttgcatagacatttctcccaaattgataatttatatataaattaccagtatataaattaccagtgaaaagatgctcaacatcatcaattattaggaaatgcaagtcagtatcccagtggaataccacttcgtactcattaggatggctgttatcaagaaaacaggaaataacaagtgttgctgaggatgaaattggaatcattgtgcattgttggtgggaatgtaaagcgacacagccacagtggaaaacagtacggtagttcctcaaaaaattagaatttccatatgatgcagcaatatgcctttctttttatctcatttaaaaaatccagctgaatgagttagcatagaaaatggaatggaaatattgatgcatgcttcatttactttagtttttcttatttattactttgatgaccttttgtgatttttccaaataaggattttagacactactaaaattagaatgggtacaaacggtcactgtattttactttctctaatttataacactgacctctcagaactttagttctatatgacgtggatatagactagataagaatttctcagcctgtcagcactatttatttatttctctatttatttgtttaagagtcagggtcttgctctatttcctatactggagtgtggtggtacaatcatacttcactgcagccttgaactcttgggctcaagcagtccttccgcctctcacagtattctcactgttggcttgttgaccagtggcttaacaaataccatttaagaaaataagatatttaatatattttgtaggatatcagagctggggagaaatggagggtatatctagtctagtggttttcaactgctggtgattttggcaatgtctagagatatttttggttgtcataccttggggggtaccactagaatctggtggatggagacctagaatgctgctaaacatgcacagggcagccccaccaaataactgtccgtaccaaaatgtcaatactgttgaagctggctgggcatgatggcttacagttgtaatcctagtgctttgggaggccaaggtgggaggattgcttgaggccaagagtttgagaccagcctgggcaacatagcaagatgaccccacccctacaaaaaattaaaaaaaaaaaatagctgagcagggtggcacacagctgtagtccacctgctttggaggctgaagcaggagagcccaggagtttgaggctgcagtgagctgtgatcataccactgcagtctagcctgggtgatagaaggagacccagactctaaaaaaaatagtgcagcgaggctgagagactctgatctatttccatgtaatgtggacactgaaattctgagaggtggagttgctcagtggcaagtggtctagggctcacgcttcctaaaacccagttctaggatttttgtactatatatttttccctcatttataaatgaacagctaatttatgtaaaaacataaaaataaggaattctttttttttattattattatactttaagttttagggtacatatgcacaatgtgcaggttagttacatatgtatacatgtgcaatgctggtacactgcacccactaactcgtcatctagcattaggtatatctcccaatgctattcctcccccgtcccccaaccccacaacagtccccagagtgtgatgttccccgtcctgtgtccatgtgttctcattgttcaattcccacctatgagtgagaatatgtggtgtttggttttttgttcttgcgatagtttactgagaatgatgatttccagtttcatccatgtccctacaaaggacatgaactcatcattttttatggctgcatagtattccttggtgtatatgtgccccattttcttaatccagtctatcattgttggacatttgggttggttccaagtctttgctattgtgaatagtgctgcatgtgtgtgaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttatagtcccagcaacagtgtaaaagtgttcctatttctccacatcctctccagcacctgttgtttcctgactttttaatgattgccattctaactgctgtgagatgatatctcattgtggttttgatttgcatttctctgatggccggtgatggtgagcattttttcatgtggtttttggctgcataaatgtcttcttctgagaagtgtctgttcatgtccttcgcccactttttgatggggttgtttgtctttttcttgtaaatttgtttgagttcattgtagattctggatattagccctttgtcagatgagtaagttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcttgaatggtacttcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatgtctctgttttgggaccagtaccatgctgttttggttactgtagccttgtagtatagtttgaagtcaggtagtgtgatgcctccagctttgttcttttggcttaggattgacttggcgatgtgggctcttttttggttccatatgaactttaaagtcattttttccaattctgtgaagaaagtcattggtagcttgatggggatggcattgaatctataaattaccttgggcagtatggccattttcacgatattgattcttcctatccatgagcatgaaatgttcttccatttgtttgtattctcttttatttcattgagcagtggtttgtagttctccttgaagaggtccttcacttcccttgtaaggtggattcctaagtattttattctctttgaagcaattgtgaatgggagttcactcatgatttggctctctgtttgtcttttattggtgtataagaatgcttgtgatttttgtacattgattttgtatcctgagactttgctgaagttgcttatcagcttaaggagattttgggctgagacaatggggtttctagatatacaatcatgtaatctgcaaacagggacaatttgacttcctcttttcctaattgaataccttttatttccttctcctgcctaattgccctggccagaacttccaacactatgttgaacaggagtggtgagagaggacatccctgtcttgtgccagttttcaaagggaatgcttccagtttttgtccattcagtatgatattggctgtgggtttgtcatcgatagctcttattattttgagatacgtcccatgaataccgaatttattgtgagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgtcagtatttttttgaggatttttgcatcaatgttcatcaaggatattggtctaaaattctcttttttggttgtgtctctgcctggctttggtatcaggatgttgctggcctcataaaatgagttagagaggattccctctttttctattgattggaatagtttcagaaggaatggtaccagttcctccttgtacctctggtagaattcggctgtgaatccatctggtcctggactctttttggttgataagctgttgattattgcccacaatttcagctcctgttattggtctattcagagattcaacttcttcctggtttagtcttgggagagtgtacgtgtccaggaatttatccatttcttctagattttctagtttatttgcgtagaggtgtttgtagtaatctctgacggtagtttgtatttctgtgggatcggtggtgatatcccctttatcatttttaatgcgtctattcgattcttctctcttttcttctttattagtcttgctagcggtctatcaattttgttgatcctttcaaaaaaccagctcctggattcattaattaaaaacccttcaaaaataaggaattctaatgaaacaaaggtcatgggttttgattagtcatgaaataagaggctagcgatcagaaacctatattaaaaagtttgaaaaaaatctatttttgtgattctcttgtgaacgagattttctgagtgcattaggttgttctggggttggagctacttctgtaaccattgttttcaatttaattgattacacaataaatgttagagctaccaacaggtgttctctttgacattttaagtatcagtcagaatgtaatgaccttaagccagtttttctcaatcttatttgacaatggcatgcttttaaaaatgttcaaatgtgagcaccaataggggcttggaagataggcttggattaaagtgaacaaggaaaaatgggattatagataattattgtcagaaagtataaaattgattcatgtatcttttaagcatcacaagaattagaaaatgagaccatgtgtattttattaagaacaatatgtattagaaaagtaaaagatctttgttttatattttcattatcaaatatgacatccacatcctcaagccacacatccacgtaatatgaaagatgttgctaaattagtttcccaaacctgattcttagtcttctgaaaattctcttctagactggtgcctttaacagggggaggaacccagacatttttttcccttcagtatttagaatttcttgaatgagtacaccctagatattttaattgttttatttttgacagctcagtttctaatttttgcacatcaagaccagtgaattttcatttcttatgtatttggagttgcttgttttttgattcagatataatttttggattacaagcctgttcttttgctttaaacttcccatttcaaccatagatcttgaggaaatctatgtacgtagttgaaatttattttattgagtaataagtgttagattataaaatcaaataaaatacaaatatatattgaaattttaagagagtttaacatataatgttatccactaaaaagatgaattatgttaatcctaatatgagttataaatactgtctatctattattgctcaggttgaatgtcaggtaatgtgtgacttgctgccattcctaggtatagctgacccatacgtaaaggtagagtagaacatagaactattaagtactatagctatatatttagcacttttctttcagatctaataataccttttagaaggccataggagtccctttgggacacaggaatgggaataaaaacatataaaaataatacaaagttggggatttttacacatttgaaaaatacagtagtgcttactctgactctctctattcatgcttttgattaccatgctgcaatattggctgtgttgggggaggaggagtattgaaaaacattttgcttttgtgtttctttgacctaactttaagactattaagtttatttatcttttgtcagagtcatttttcttttctaaagaaaaaccacatgcagtgaaggaattaaaaatgggcctgctgccactgctattttggagattcttagattagcttagatcagtccagttatgaaaaaatttttttctctttcaaacagtgccgcatattccttgatttcaatttctcagaagtctgggagattatcagtgtaacatttctaccaaatttctcaaaattaaaaagaaatccagtgaagagtatcaataaatacagacaatttagattcctaaaattatcagggctgaaaaaggatcagtataacaattttatggagcagttcagattggtcaatatctggggatgcttggattctcccatcctgttttgttcatcttaaaacagatcacaaagtccgttaaatttcaactgctcctctttctaggagttgcatgtgtgatagccatagcagctgtatggcaacttcacgttgacactgtgctcagacattgagttgatattgtcacttacctgaagtcacttaactgtctcaggaagtttgaatctaaatgtgtaggttattacacagcaatacattctgtgcctctaattctgtcttggaaatccactgttatcacctttaatgcagttataaagtcacataatcataaagttcactaggaaaagttattttccagtcagactaggaggagccaataaaaacagctctacgtggaggacagtattaatgtcatttgccagatatttgttgagtgagactgcctatgcaaaagtcatagagaattagagcacagtgctttgttttctgttcccatttaacatagatgagatttctcagttgctttgattggcagagttgatgaaggatcagttaggtaaaggttggcaaatgtcatgtgctaagaaatcacttgtgaagcttgttggacaaaaagttttcagtttcctggtgagcagctacacccaaaggcggctttagcagtgaaatgcttgaccttctcttgtggcatcctgccatccttcccctctagatcctctggccaccagccagaagtggtggcatctagccaatcataaattagtcagaggattcttattctgtaatactggctcttggaaactctagtatctttagtaataaggaatttcttctccgtttctgggcatgctgttcatttaacccatcttttctgttttctggtctttgccagcttggagtctagcagaaacaaagaaacttgtttctaagccaaaaggaaacacacaaacctagtagtatatccttaatcaatatcctatagacaatgaatttgagcatttctttctttaaaaaagtggatgttcctcaaaactcaaaaggaaactcaaaatcacttcaggaacatcttaattctgtattcaacggcagaaatacagcatattaaatggcataagcccactggatttattcagatctaaattaagcattgataggatggacctgaaaaggaaaacttatcgtgttcttaacaaattcataagtccagtaaggcaacttaggtatttgcatgaagaaggcactttttcttttgtcaaataaagattctgcaaagtttctgtccaagaactttttagcttttatagtatacaatatgtcagagaaagttacaactctgattacaatgcataactgtttatatgaaaagagaaagtttgatatcttgacatacatttaatgcactagttgtgttctctgtaatgactgaattcatcctgcagtttgatgaaggtgaatcgggaggggaacctggatcttgggaacttccaacctacccagcctcttctgatatctcttagacacttgtaagcagaatttgagccaaatagtctcaatgaagcattcccttcattcatttctggccagattaacttaattcacgctcatttctagctcaccctctttctttcttaaagcatgaagtagaaggtagttcatggctcagcttaaactcccattacattgaaagatttcagtaaagtaaaatttcagtaaaatttgttcccaattttaccagtctgagtgatcctaagctgcacagtattcattttactaagggagcaacagccaagttactgcacagtcttccactgtttaaattgtcttgtagcagtatagtgccactgctgttgttttttccatcccacgtttcattttccctagaatatctccatgttccagggaagtacaggatcagagaataggcagcgttctttctgagagttgtacgtagttacataacgtatcaggattttcttgttcagttttatctttgtagatccccttctgctattgtttgtgtctgttttggtttctaatttctgccaaactgctaagggatttgatccaactgttagcatttgatgtgttttttcccttccagatcacatggactctatctttctgttgtgaatctctcttgtggaggctttagcagttagttgggcagggtcttgccttgcctgtcctcttctttattgtgcacagccatgagtggactgttgtccatcctctggagcatacacacaaaagcctgtgttgatggtgcagtaacaacatatggatcagtggtccttgcctttgctaacattgtggtatcaggagtgcttgaggggactttcccccaaaccacctcatccatacatcaaatctaagtaaaaacaatgggcttgctatgaacatgtaagtttaacacaagcccactggcttttgtttccaactagaatggttctttaagctgctcttatagatattttggagcttctgctgcctggcaactcaactctgtcagtttcatttagttgggtcagttttatagtttctgcagaactggaagctggccatttaaaatagccttggttccactgacacatgtgatgtgattgctggaccaactgttcacaagttgtgaagagattacaagacagtagtgggctgaaatatgctcagtagagaaaggctggtgttgactgataccattaccacattgaccagtgggtacaggaagtaggtagttactgttgaagtataataaacaccaccaggctttgtctaggctaaggcacttctttagtatgccctgggatctcttgggttattttcctggttacagagaccaatttattagctctaagagcttgttggagatgccatcctaggaaggtagatgccttccagttgtgtgtatgtgtgtatatatgtggaataaatatttgaaatgggtttcagacagctacaacactgtttgcttcacagcactgcttccctaccttgcccatatgctgcaatactgacatgccagtctcaccccagagattaggagttactggtatggaatgtggccagggtgttggaggtttaaaaggtccccaagtgattcaaatgtgcggccaagtttgagaactactgctctggaaggtactaaaattttaaagatgtggtccctgcctttaaggaaatcatagtatacataggccaaagcaaaattacatggaagtaaaataacagtgtaagaatgaaataacaatataaaatgataaaaataacgcctggtaacttcgtttcttttatttaggctagaatttaaatgacagaattaaattgtgcattgagagttttgatagaaaatggcaactgagacttctggaaaaagaagcaattgaacataggcatctacttttgttcctcccaaaaccccactaaaatatcaagggatcttcttttgtcaaggcctaaatccgcagggatggggagaatgggactggagacaacctgaagaaaatgttggaagctggaaggtaaaggacttaggaggcttggaaaaacagaatctggagtgagcagtggggcagccaagaaccagcctggtttacattaaagaattgcccaaaggcttaggaattggcaacatcaagtacttctgggaatagggatgaatggagtggggctttagaatagggagaattggttgaaaatctttttaagagcccctcagatctctagcttccctctaccacctggaagaatctggaggttaattctccaaggagaatgtattaataaaatacatctagagagaaggaaggctgggaaatgtagtctttgttctgtgtggacatgtgctcagctaaagctctggggttctgttactgcgggagaaggggagaataaatactgggggacaattagcagttggcactatgcttacatacacacatacttgctacattaatataataatattgataatgatattgatggtgataatagtagcagcaaagtcttagagtgctttttacatgcccagcactgttcttagaactttacatatattaactcacttaattctcaacaatcctgtaaagttagttctattcttatcccactttgcagatacagaaactaatgtacaaagaggtaaaataacttccccaggtttcacaactgaaaccaggcctgagacctcatctttctgtgattaaacctgacattgtgattaagtttgaagaaactgattgctaattaatgttgttcattgtattggttttgtgttctctttgaagaaaatagtagtgatatatgtgctcaataaatataaggagttattgctatttttataaaattatatgtttgtacaaattcaagttgcattagattacaaataatttaacctttgatgtctattaactttttatgtttaaaaaaggttcatacattttgaagacaatcagagaaggtggtaagttgagtgattaaattgtaatttaaaacataactgtggtcacagtgtagagaagctgagactaaaagcagggagacgggggtgagatgatgcctgagtccaggcgttgtgaccttcggtgtgcgtcagaggcccctggaatgcttcttagatcatagaatgctggatttcaccctcaagatttctgatttagtaggtttgagatggggcccaacaatctttactgctaagaagtttccagaagcagcagctgctgcaggtctgagaaccacagcacctatctgagaggtaatgagagtctaaattgtggtagtggagggaagggataggtgatgaggcatcagtcagggagaattgacaggattgtgattctttgaagttgaggtgaatggagaggcaaggatccagagcagtggtgaggggttacacattgaatgaaattcctgttggttgttacaattaggaggccattggtacttgctgacctcaataaaagcaattttcatggaaaagtagggtcagacatagattagaaaactgagattttgaggagataggttaaatcctgtaatatattgtagaatacatttagatttctttagttctgaaatgcttgattatactctgtatcccagcttattttagcaggccatctgatactgaccaaactaatgcttccattgtcttcatgatactttctggctttccactcaccttttgcttaaaagtggtcctgacatttttaagaagtgtccatatctactttatttcaagtgaaagtcatccttctgcatatatgcttattagtttcagatcagtgtagaaacctttctgcttgcattttcttctgtatggtgacttttgagctctttctcttagatcctgcttttgggtcctcaaaacagctcagatttaagacgtcagagctgtcaagctctgctggttttactttggggtttctttcactattgttcccattgccactatcatagttcatgctcccagtacttttgatctgaatgattatagcaattatcatgagtctttgttctcactctccttcctagtcttatttaatttaaaaatatctgtgagattgattttccaaaataaagctctgatcataacacttctttgcttaaaatcttctcagtgtttaatagtaaagtccaaataagcaatggggaaacaattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaagcctaggcattaccattcaggacataggcatggacaaggacttcatgtctaaaacaccaaaatcaatggcaacaaaaaaccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaaagaactcaaacaaatttacaagaaaaagacaaacaaccccatcaaaaagtgggcgaaggacatgaacagacacttctcaaaagaagacatttatgcagccaaaaacacatgaaagaatgctcaccatcactggccatcagaggaatgcaaatcaaaaccacagtgagataccatctcacaccagttagaatggcaatcattaaaaagtcaggaaacaacaggtgctggagaggatgtggagaaatagaacacttttatactgttgctgggaccgtaaactggttcaaccattgtggaagacagtgtggcgattcctcagggacctagaactagaaataccatttgacccagccatcccattactgggtatatacccaaaggactataaatcatgctgctataaagacacatgcacacatatgtttattcacacacatgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccacatattctcactcataggtgggaattgaacaatgagaacacatggacacaggaaggggaacattacactctggggactgttatgggatggggggaggggggagggatagcattaggagatatacctaatgctaaatgacgagttaatgggtgcagcataccagcatggcacatatatacatatgtaactaacctgcacattgtgcacatgtaccctaaaacttaaagcataataataataaaaaaaaatagtaaagtccagttttcatagcttagtataagacttttgtttctagcttcaagttttttcccccatattcttggctgcacccacactacccaccagttgtccccagtcttctctgcctgtctgccttccttatgctgctctgtccctcagaaggccctctctttccacttcaaatccaacctctattctggaccctgctcatcttcttatagcccttgctatctagaattccttttaactattgtctatttccatctagtactgtacctgtaactcagtatacttattttcaaccatgtatttacttatatataatattcaccttcttgtctcccacgatgcccataatagtgccaaacacaaagattggttgaatgaatgaagaatgggaaaccagctaggatatagtgcaaataaaggaaataaaatgatgattcatttaactgatacagtaaatatattgcatatcagtgaatgatgtctaatggaattttctaaagctaatatgagtgacagtaggaacctcttttaagtatagtcaatcaagtttgtcatcttttttttttttttttttttttgtgagatggagccttgctctgtcatccaggctggagtgcagtggtgcgatcttggctcactacaacctctgctttctgggttcaagtgattctcctgcctcagcctcccaagtagctgggattacaggcgtgcaccaccacacacagctaattgttgtatttttagtagagatggagtttcaccatgttggccacactggtctttttctcctgacctcaggtgaccagcctgccttagcctcccaaagtgctaggattacaggcgtgagccaccacacccagcctcatcttttttgattgttcagaaatcttttttatttaacttcttagcttttaattgagtcctagatatttcagtgagctgaatactgtccttaatatatgtgaaatgtcactgttatattatgccatttttaataagcttgttaagcatcacttggatgatacatgtgcatatatgtgtacttattcacacatgaattcacatgtattttacctaagattaatatgggccaactgtgttttctatacaatggaatattattagatggactaatggattcactagcctgattaatgatctgtaccagttaatttctgcgttttgatacatcttattgatgtgttttctgattctatttttatttactcattggagtgtgaactagaaaaatactatacacaagtaattagattgtagaagtgatgtgtaagatttgtttgttataattgattttagatgcagaaacatttagagctagcataagaaaagttgatgtaagttatgaaaattagaaaacatttcagatttagaatataatgatattatttaatttttaaaactaactttttttttttttgtttttttgtttttggccaaacattaatcatttggggcttttaaactgtattgcatttgggaccgcctgtatgtgggcctttagttagttccagtagcagtgagactcagatattttgaaagaacaatatcagatatagttagtgaatattgcttattttcaggttaaaactgattcttcattctcttgagctttcttttattaataggtcctcagtttggacttagaattcatttaatgtcaaccttctcttgtttacaaaggggaaagctcatttatttttcatgctttgtcatattgttccctttgtttctgagaaaagggcaccagcctatttagatagagcagtttaggctatttataaagctaggcaggttaattgaaattgacagcttggtaatgtcctccttggtgaatgacgcacaagggttttagatgatgttggcatgctgttttcacttatagtcaggaatcagctggaggaatttgtgtgctttgagctctggtgttgacgtaggtactgggtacagatatgttttaggaaacatctcatttccatataaatgaaggaagattaaaaagaaaaatttcaatggcttgcccttaaattgaagctggtatcacaaggatgatgataatacttcttttgattttctggaaaaacagctttggttgtattcaagcactgtggagtcgttacaggtttattcagaaatatttttgtattcttttttttttaatctgtttattcagcatcagctatgtgtacattaatttgaaaaactacatttttattgtgtattcctccaaactccaactttaatctcttaggttttagattgctccatttaagaaatttgtacaggtacataaataaacttgattttaataaaagatagaagactgaaatagtttttctttcttacatgacaagactgttattctttcttttttaaggacatagtaaatatcagtttgcctgaaatgagtttttgtgtttttctcttcaagtgtcacttaaaggagaggctaacaagcttaaatagtcacttaaatgagagtttaatttaagcttaactggttatgtagtcatattccctgacacccaaacatttaggtcataatcatttgtttcattcatgacagggtgatttccaaagtacagacattttatctcagaatcacattgagcatgcacggaagcaaattttagcttacataaagttaagaaacactagtagttgatttattattagttgtaatatatcttctatgggcccatagccttatcaaaactagcactgacaattcctgaagatatctggggctcttggcatggtgagttggtcctgtacttccaggttcatgctggtacctttgtggatcatcatgtctgtcatatggaccttagtcaaatgttatggcaaacagcacacagcatatagctcagggacccttgagggggctagtgtagagtgagggcttttaagtggaggcttgcttgaaaagaactgtgatctcttaggatcagttgcccctcatttccaagcagtgcttggagggctttgggcccccttggttgggttcaatccttgacctgtgtagtctgtaagttgctgtagatacacagctgcagcagtaacattgttctttaatccaggagttgcctttgatcttcagcccttcattctcactcttggggtctcttttttgcagaaggtgagccgtggccaggcttcctgtttatagcctccctctgttcagtggtaaacctcaggatttttggatgaagatctttggatgtgtgcctccttggtgcccattcatggtcttgctaatggaacaggatttgggttcatagttttgaattgcctgtcacagccccgctgtcatggctgaacttccttccccaccccacccttcatcccagatagagagataatgcttattgttgagtgattcaaggtactgtagacatcttccagctggagtggatagagtttgaggatagtggatagagtttgaggatgagcacagtacatgcctagtgagatcttccagctgatggtctgggatccttaaagaccatgcaacgtcctcagtacttctcagtgccaattgtcaggggatttttggctgccacgtgcctctcaactaacaactattaagtcctgttggttctatagtgtttctcaaattctttcttcttcttattttcctcaacactatcctgataatagcattatacatcttataaaatgctttatggtttgcagagcacttgaatgtgctttatcttatttgatcctcagatcagctctgattgatagccaggttagttatttttatcctgattttgtggatgaggaaactgaagcacaatccaacaccacacaactggtaaatggtggaaccagatttaaacccatgtatcgtgatgccagagcccatgcttttaagcactgtagtaacttgcttatatacaccaaactttctatctttatctcccactactgtttttaatcctcttatacttcagccttcttggtttgcttcccaactcagagtttgcccttatttcctgcctttggtcacactttaccttctacctgtgcctgtcgaaattctgcccattcttcagtgcctaattcagtgtcttctttttcataaaactttgtatgagtcctccaagcccaaaagaattcccctctcctctaatagcattttatttgtatgtcattttcttacatcataattatatttgacttatcgcattgtaagttgcgtgaggacagatggtgttttatttatccctttatcatttgtagcaactaactacagtgctttgtacatggtcaagtacatatgaaacaaattatatcaagtgatattttttactgggtcagaatcagagcctctggtggtggcaagaggtgatttgagagagcttgatactatctcttacaacatctatctaataagattaggaaggtatatttgagagactattatcttcagtttgctccccctcctaggacacaactaattcattaaagatcttatctaagttgtgacaaacagcactttgttcatcttaagataatttcattccaatgttccatatttttagtagtctctaatctagtaattgataatagtaattgaatttcttggcaaacaaaagaagacctaaattttaggtatcaaaattatttttattttatactttaagatttcttttataatgtattaaaaagtaaaagtacttttaaaaatttgtgcccaacttcaagagcattttaatttttttgataactatgataattcagataatttgttgaactataagattgatatagtaagtttgaaatttcacttgaatctgaactgattcgagggcttctatctatttaattgtttcctttccccatacccatttctttaataagtggattatgtaaaaacagcttggcaccttgttaccagtaacatcttagttttacccacaagtttggagattttacactccctttttgagatagaaacatgtataaatttccacagagtaatagtggaacagtgttaacagtgctatcttgatatgcaatttattattaaatcaaagtttgaagtagccctttttaaaaggactttaaaaacatattcctgattaaggaagttttcctgatcatttttattcctgttttcttaacatgctttttattttatttcattgttggtagctaggtcatgcactgtgacagttttatagtagctatcttatttgcataggtttttggagaacatatgatggaattttaggacattgtcctcaaagacttattacattcagattagctatttaaaactgttttgtatttgtggctgtggtgccagataacaaggtctaatttaatatattttagcatttgtgacttgagtagtttgcaagagacaatgtaggaaataaatttctctagtagaaagaaagggaagcaattgttgattcgggtatcaagctgccagttactggctattgactttgggctaaccacttaagtaacaattcgatttccttatttgaagactatggggttagtgggaaggttttcaatagcactaggattttgtcattttgtaattagtttttctatgtgctcttttcatacccaaccatagtttttacagatcattgaattatcacattgattctatcacattaattcttttgttcttaatttacttaaagaacacgtttttaccccttgtgggattactggtaaatataacattgaatttctttttttccccaatagatgcaatataggaatgtacttatattctccttaatttagaaattcattttaaaataaaagattaatttacctcataataatgcaaagttgtttttttttttttttttaggttttctttttttgagtgcttggttgtttggagcttagttgtttttttggtgggatgcgtgagagatttctaaaatagtgcttttaaacatttgccacagctccatggatagtttgttttaaaaaatactttcccccccaacttagtcttaagtagaatttttcttctaaaattgaacagtggagtcaattattttatttgtccaccttctccctgcctggggtactgtttctttaactggtgttaaccaaccctctgtgtccatgaatgtattctgagagttctcacattttctatgagatttaaaatttggggttttactgtcaacgataatcttgagaaggtaatataagctttttctgggtcatctgaatcatttgccatgcaactagatactaccacatggtaaaattagtgttggtgtttattattgtgttcatggtaatgtgaaggccaactacttcatattatctgaagtgtatgaggctttcactgagattcaaataacaaacagtgctaggagcatccctgcttgccacacccaaaagaacctgcattatagagataacattcaagttgtaggcagaagaaagattacattttttaatagagcaacttgtaacaatcattagaagtaagtgtatcagtaagtacaaaaagaattttctatacttgcttctagtgataattgaataaggcacacatataatgcagaattcaatatggctgtgataccaaccatatctttaagtgacttccttaaattagtgttcaaggactgcttgttagtggttttgtttggaacgaggtctgattatccttaactggttaaggaagccatgaggttatcagtactgttgtgtacagtgcatttaggtgaataggtattcttttcattagaatgattaaagtaaaaacaaaaacagaaagagattaaatatattatcaaactcaaagctttgttggtgttgacatttcagcagaaaaccgttgttcattatgccatattttttactgttaatttgaatttaattggttaggtagttacttttgtatttaatttataaatttgttttggctttgtctttttatcagggtaataaatgctaagttttgttttgtatgtattaaaataacatattaaaagtggtttaagttggcattaggagtgtaagaacacatttttcccttaaaagttgtatatctagtacttggtttgagaaacctcagtctatgatactgaacattattgtatcataatcatgatagctaaccttcaactagatgttttctatttcattttctatgggttgcttaaaattgtgacttttctccttttctgtcattaaaaaaattaatttctctaatacatggctacctaaaatcatgacataatccactgatctgtgtgtgggtagttgcatattcaaaatattgttatctggcctgatttttagtttctgtgatttttgactgtcatttctattttaatattactattttgggttcatttttcattcattcatacattgaacaaatgtttttaaaattccactatgtacaagggattgttctaggcactggagattattgggtgagaatttttttttttttttttttttttgagatggagttttgctcttgttgccaaggctggaatgcaatggcacgatcttggctcaccgcaacctccgcctcccaggttcaagcagttctcctgcctcagcctccgaagtagctgggattacaggcatgtgccaccacacctggctaatttttttttgtatttttttttttttaaatagagacagggtttctccatgttggtcaggctggtcttgaactcctgacctcaggtgatccgcccacctcggcctcccaaagtgctgggattacaggtgtgagccactgcgcccggccaagaatctttatatttgggtgggcctatagtctctcttcactgtcagattttctaattgtttaaatgaaaaatttcatgtttatattacatagtacatatctatttcaactaaactaaatctgtcttgctgacatatctagatatcttagtacttggtgttaccacgtcatgattgccatagacataaatgtctctttagtccaaaatgatgggtcttttaagcttgttcattcaaacgatattactgaaagactggtaaattcaagaggttgtagtaggcactattggactactgatgaaatgaatgagacagtctgtgttcttagcagaggagcttagaaattttaatccagtcactgaacccttgaaactaatttgggctttgctgtgtgttgacattgttgtatctatacccagaattgcagactcattgattacagaggggcttttgcatttaataaacattcattcagtaagcatttactaagcacatacatttgtttctggttgatttttatcttctttaatttgtctcttagccattacgatgacccagatatcttgccttggagtgttcagaataatagggtagaatctgtaggacaaggttcacaaacagctatttctaaacaatgcttcttggaggtaacaatttgaagaatattgttgtaggataattataattataggtaaacttcctaaatctggaaaccttggaacctgtcatattctagaaccataaaaatagtgctgctttaaagcaaaagcagaattagatagagggagatgtccagaagagatgcaagaccaatgacagccttggccaaccctgtgggatctgtgcaatcagaatgactcttttgccaactagttgtccctagttgggctgaaatgaccaggcctttgtactctcacactgatcaatcagtggatgggagatgccaagcatgacctcagtctaggaagttcactgcagataaaacagaccctaaagggtgtgatagctgaagtgctgatatctgtcagccaacagatttcttagtaaccaaggcaacatggtgggtgatcttcacaaatgggtgatctgggcttcatgcatcatagtgttcaccctaggcagtaaactgtgacgattaccttgatgacaggattgcttattcagtgttctttttcattttctacctctggatcatgagtagcctaatttacgatgctaatatgtggtggattaggtgtgagtaaggggaacaccattttccctttactactttcaacttaggtgttaatatttggtaactctaataataaggtgactataacccttggtttacccaggttagtcctgtttgcctagaaatacccagtttaagcctgttgaaaatcagttagcttaggagaaatacctaatgtaaatgatgagttaatgggtgcagcacaccagcatggcacatgtatacatatgtaacaaacctgcacattgtgcacatgtaccctagaacttaaagtataaaaaaacccaaaaaaacaacaaaaaaactatcttctcaactagtacagagactagattaaaaaaaaatcagttagcatctaacatctgttaattatttttagtaactcctcacagtctcagaagtatcccagtttgtatcccaatacaagataaactgtattgtcattctacttagtaattttttaaatttgcgtgcatattcattatttaagcatttttctggcctgtctaatgaatagaatgttctgttttccattttttaagaggcagaaatggtcttctggattagctttgtatttttgctttagttgaccctaaaacaaatgcgttttatctttatcaaatttttcatcatcaagctttaatatattgtgaaatcacaacatattctatcaagtatactatgactgaaattactggatgtattatttatttctgtctcccactgttacaattgtgtctataatgacttttatttccctggtttattttgtagcttagtcacaaatatttatgttcttatttatctttctgctcagagactgggacctgagctgtttccctgatggagtcaatcattttccagaaggatattccgacctattcaaatctaggtcctgaggaaacacaacttgcttagaaatagacagttttaaatctgcttttacagaaatcttttacagaaatccataatggaaagaagaaatttaattttatcccagatagatttaataacttgcagatctactttgttcatagataaactctaaaactaattaaagcttctgaaaaatgtctagggacagaagaaacagattcttagtgattcctttaacctatcaggaggtaataggctgtcaccttaagtcatgctttttcgttttcttttttttttctcattctgtctcccaggctgcaatgcagtggtgtgatcttggctcactgcagcctctgcctcctgggttcaagcgattctcctgcctcagcctcccaagtagctgggtttacaggcatgcaccaccacacctggcagattttttgtatttttagtagagatggggttttgccatgttggccaggctggtttcgaactcctggcctcaagtgatccgcccacctcagcctctcgaagtgctgggattacaggcctgaaccatcacaccggcttctttttcttaattgtttctctgccctcttttccctatttttctggtctatagttgtggctgaatgttagatagggaatagggttcactggtggactcaattttacccatttctaattgcttagcaagaggagtcacctgctgattttaatatgaagtttagtattgtgtaatggacaatatctttaacagatggtgtactgccagtgatgtagaacttcttaatcatgctccctttacaaaagaagaacactattagaaagcgatggtatgattttatacttgatcttcaacaagtgagaaattgataagtcaaatatacagtcagccatctggcattccacacatgttttcattgacttgggagatcatggagttatacaaagcaggagtagcacaatataagaaaatggcatgttatagaaatatttatttcttttattttagttatctatactattgatcagcaacaagtttatcagaaattttcattttattcagctatctgagtttagaaagaagtaattcagatggtatttacttttttttgcccaatcaaagctgctaggcattgaggaactgtttcagagtgggcatagttttttccttcacatgaggtcaaagccactaaccactgaattaaacatttgctgagcttggtttgcagcactttgattgatatagattccttcttgcaacttctttgagcctccgaaacttactgtgtcattatagaccccaactgcctttaaaagataggaatttcaacatcctacaatttagtcatcatttggatgaatgacttaaattattatatattttaggaatattaattttttatactacctgagctaagctgtgtgaaattattatcttatgacatacacactatttaatatattgaatttcagaaagttggttccaaatatcaaatagctgagtagaaagtagaaaaagacaatccagttgctgagaatggggcagaaaaaaaaaatgtgatttctaaatccaaagaaactagctccccttatctaatttatcctttcaaactaaaaatatgttaaatgctgtcagtgtgccgggtaagtaagtgctaagcactgacactccccctccttgtccttatggacctcaggctgatcctctttgttcccagcctggctcactgtcactctctccagcattcctgtcagtgtccacatggatggtcttttcaatattctggcttctcagcttcttatccttttcttctctggtgatcttatcctccatcctacatcagcttttcattcttacagccatactcttgtcattagcaataacagtggtctctgcataatctcagtttgaagcatcctcaactctgattagcattttgaatctcactgtagctcactgcttctagtacctccattccaacaatcttttgaccttattgattcttaaaagccacggattttaccaccttgttgctgtctttcatttccctgattacctttctttcttttacatccagtttaaatttcatgtcaatatttgcttggcaaaatctaattctagttaaatccatctctctgtgtaaatcctgagctgaatgtcactggagcaaaacatgccatgatgcaactggtctttaagttcaaggctgggaagttccggggcactcatgttgcctgccatcatgctgcatgttccgggtccattcggtcttccattctcccagatgactatttcatacttttttccccctcctcaaaacagcttctcccatccttattgttaggtaataatttagttttgcattttactgaaaggatagatgccactaataagaacttggataagctcttatcactgcatatatccatgtaccaccatcaatgcccatatgccttctttcctcctgcactctgaaagaatgtaagggttcctatcaacccctccacagtagatcccttcttctcttgtcaccttttcaaagacacggttccagttattattccttctctccattttattaattttctcaaaataatcagtgttctcttctctactgatcattcccatcagcctgcaaatatgctgttattttttccatcttaaaaacctgtcttgctgggtgcagtggctcacgcctgtaatcccagcactttgggaggctggggcgggtggatcacctgaggtcaggagtttgagacaagcctggccaacatggtgaaaccccatctctacgaaaaatacaaaaattagctgggcgtggtcgtgggcgcctgtaatcccagctactcgggaggctgaggaaggagaatcacttgaacccaggaggtagaggttgcagtgagtggagattgtgccactgcattccagccgggtgacagagcgagactacatctcaaaacaaaaaaacccaaaactctcttgaccccatattcccctctagtgactgctccctttctcttctcttctctctctctcttttttttttaagacagaatttcactctgttgcccagggtggagtgcagtggtgccatctcagctcactgcagccttgacctcctgggttcaaatgatcctcccaccttagcctcctgagtagctgggactacaggcacgtgccaccacacccggctaatgtttttattgtattttttgtagagatggggttttgctgtagggtcttgaactcctgggctcaagtgattctccgaaagtggtgggattacaggtgtgagccatagcgcctggcttcttctctcttttatagcaccgtttctccatataattgtcactactcattgtcttcaatttctctgcttctattctctattctcacttgaagtcactgcaattaagctttttttttttttttctcttctctcctactttgcagaaacggtcatgttaaggtcaccaatgataaaatcctcagtcctcatctcactttttaatagcagtatagacacaagttaatcactcttttcttggaaacacttccttttgggacaacacattctcctcctggttttcctccaaactctggcttgttttccttctcaacttggctgatttatgtctcacctgcttgtcttgttaacattggagtatccaggctacaatcttagatctcttcttttctctctatttaaatttactaggtaatcttatcccatcccttgttattaaatgctgtctttatgctgaagacttccaacttatatccaacagtctaattgatagctctacctgaatatctgagggcatctcaaagtaaacatctccaaacctgagctgctgatctctcacccaacatgcttcttcacagttttccctttctcagttactgggaactctgtccttcaggttacccaggccaaaagactttgaatcatccttagtattgctgtgactcatactgcacatccatttcatcagcaaatccttttagctctatctttagagtatatccagagtctcacaccatttctccaccttctctgctattatgcattgttatctcttactgggattattgcagtagcagataatcaatcttgctgtgtccacccttgctattgacaggctattcaccaaatacgagtcagaaggatcctgttgaaatgcagctcagagaatggcatgaccgtactcaagaacttcctgtttttctcactcacctgctctctgactcgctctcacagtaaaagagggtttacaatgtcctccagggccctgcttgatcatctacccattccatcctgtaactccttgactttatctcctactactctttcttttactctagaccaggcaatctggactccttgcccttcctctgatatattaaacattttcttaccccatggtttttgtacttgatggtcgctctgcccagaatatttattctctcagatatatgcatggtacacatcctcatttatttaaaccctttgcttaactgtcacctctcagtggggtcttcccaatgtccttaaaaatcatagtagtttccctccctccatcacctactcccctggttcatcatctaacaaactaaatatttccttcatttattttgtttttattgcatttcttgtgactagaatgtaaacattcatgaggaatgttttcgttttgtttgctgctgttaggaaagtgtctgtataatattaagtagtttaaaaacatttgttgaataaatgtatgaattattatagtcttttcagtgttataatttttctattacacataagaaatggagccttagagtgtttagtaatccgtggaggtaacacttaaacccaggtctttcttggctcatagtgcagtcactcatgtattttttcatctatcaggacacttacagggtactacaggaactttacattggatgaattgcattataagatagaggaagtcatcaatattgtgtgtcttatttgtgctcttctcctcaatcagtatctgggagaaaatagaaaccgatttttaacagttcatgttgaagcactttttgctacatcatagaaacttgtcagagagacttgttaaactatttcctcaaatcaaacatgttttggggtaagagagttctgagaaactcacttttttctgctttctattggcaacaaggctatatttcttaccgagatgaaaaatatctaaatcccatgaactagcaaggaatcaataagaatgctgctagtttggttaaggtggttcaggtattccagggctgtgaattccatgggagacagctggaatttacgttcattttctaccactgagtttttggttcactggaatcatagattttcaaagattatcaagctactcacagtcaaatagggaattgatgaggaatagaggtcacaatttcagaagatagtcacagatcatgatgagtatgaatcatgctttcagtttttgcagctgcttatagcctggcaaactacaggatgtgtctggtcggcatttcccaacacctgccccatgtttcgttcatattcaaaggaaatgattaagctaaaagtgaattctatatatgaaaaagaactggtatccttggattatggaagtgaaatatgaataccaggtttctcccaaaacatttggttacatggccagactgtggctattgtctttgtccacccagaatcctgaaattataatttctaatgaaattctggcatgagctgagaggtggtgaaacgtcaagtgagaattgaattatacgctaataaaattgtacctagtggttcgaatggatcgtctaaagggtttatcaaacttctctaatttgaagggtctcaaactccaaaatctgcctccttgttggtgggcacagctcttttaactgggagagattatttgctgctgggcttttggagtgtcctgtgggcacaagtgttggcaaggatttgatcagtttttgcacagattttggggctcctccatgctgtgcccttcttttagggatttagtctctcaattttcaaccactggtagccacagactattttctgacacctcagatcaaccagactgagtctatttgtttgaattttagctgtcctgactcatagactggggagtccttttgcaggacaaggcttatgaacgtcatggtcatccactgggcttaatttctttcaagagtcaagactccagtttatgcctacttttggcccttcaatgcctttaaatagttgtttgttttattttgcccagagtttataatcattaaatgtggaaaggatagtctgaaaaacgcaactctgacattacgttcagaacctcaataagatattttgtatagttttttcattattattcaatttaaaataccactttctaattttcattatagtttcttctttgagctgtgagttatttagctatttattaaaaaaaatttctagccaggcccggtagctcatgcctgtaatcccagcaccgtgggaggtcgaggcgggtggatcacctgaggtcaggagttcgagaccagcctggccaacatggtgaaaccccgtctttcctaaaaatacaaaaattagctgggtgtagtggtgggcgcctataatcccagctactcgggtggctgaggcaggagaatggcttgaactcaggagtcagaggttgcagtgagctgagattgcgccattgcactctagcctgggtgacaagagcaaaactccatctcaaaaaaaaaaaaaattctaacataagaattttttgaatgatctttttattgatttctaacttaattacactatggtcagagaatatatgtaattttcatcttttaaaatttgttgagattggatttgtagtccagtatatggtcaattgatgtcagtgttttctgtttaattgaaaaggatttgtattctttgcttctgggtgcagtgtcctttgtatgtcagttaggccatgtttgttgaacatgtttaaatcatctctatttttcacactccctccttttttttggtatgccttttttgtcagttattaagactagtacattaaaaaatcatctcccactatgtggtgattttgtccatttgtccttttagttgtgttgcttttttccatttatttggagcccattgttagataagtatagatttagaattatttatttcttgtgaattgaaccctttaacagtatgcgttttccctctttatctctggtatgtttttttcctgaaagtctactttgcctgctattaatatagtgacatcaactttcttttggttaggttttttattgtctattttttccttcttttttcttttttttaacaacctttctctgtctttagagtttgtgtttcctttcaaatagttgggttttcctttcttttaaattagtgtgacagtttttattttcattgaaacattagattacttacaattaatacaattattaattggatttaaataattcaccttactatttttttttaatagagacaggttttcactatgttggccaggttggtgttgaactcctggtctcaagtaatcctcttgccttggcctcccaaactgctaggattacaggtgtgagccaccgtggctagccatactctttattttctgtttcctctacctgttctatacttctccatcccattattagtttactgaatttttaaatgtattatgcatgacattactctcatttgccacattaacctttttttcttttctattttaaggaaaagatagagtttttaataccccattgtgtgaacaaggaattgttggatttggaatcggaattgcggtcactggagctactgccattgcggaaattcagtttgcagattatattttccctgcatttgatcaggtaagtgaatgaacatttctaaggttgttcattcattgaaatattcaagtattgccgctacccttccacccacccttacctgcattctaaacattttattatccttttactaatgtattacaattataattttgttatgagcatatatttaaagatctaatagaatagtttaagcagatagattgggattgggtgaagtggctcacatctgcaatcccagcactttgggaggccagggtgggaggatcacttgaggccaagagttcaacaccatcctgggcaacataatgataatgagaacccatatctacaaaaactacaaaaattagcccagtgtggtggcacatacctgtcatcccagttactctggtggctgaggcaggaggataacttaaaccaggagtccaaggctacaatgaactgtgatcgcagcactgcactccctgggtgacagaatgagaccctttctcaaaaagaaaagaagagagaaagaaagaaagagcgagagagaggggagagggaagaagggagaggggagagaggagaggagagaggaagggaaagacaagaccctgtctcaaaaagaaagaagggaagggagggagggagggaaggaagaaaaggaagagagggagggagggagggagggagggagtgatgggatcctgtctcaagaaagaaaggaaaggagggagggaaaagctcattgtgctatgggaaaggaaggaaggaagggagggagggaggaaggaaggaagggaaagactcattgtgccatgggaaaggaaggaagaaaggaaggaaggagggagggagggagggagggacgagaccctgtcttaagaaagaaaggaagggagggaaagacttattgtgctatgggaaagaaaggcaggcaggcaggaaggaaggaaggaagagggggagggaggcagggagggagggaaagactcattgtgccttgggaagggaaggaaggaagggagggagggaggaagaacggaaggagattggaagggaaggactcattgtgccatgccccgtctttctttctgaccctcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtatgttcatttatgtactttatttgatttctatttgatgtttccattttgattcattctatttaatatctatgcttatctagaggaaagaaaacaaacaggattcttggaatttatgtgaacttaactgtatttaagaaggggaggttagcagttcttttaagtatgctatccaatgcccagttttacagcaagttctttttgaaggaggactggttttataaactctggcattgattaattttatagacttcaaagaataagaccaagaacatagttggtttacctcccctctctttcaaagctttatatttctttctaacttaagtctttctcacttaactgatgatggggtgattttaataaatcttttgtttagtctgtatttacctcaaagtcacagggataacacttttgcttttaatgtatttcttacttgttaaaaagactaagagaagactgttacctagattttttttttctgtttaaagttaggtaatacttgctcaaccaattaattttgaagcatctcctttttataacctgtctttcacaaaagcttaggtcttttgatggtaaaaatattttgagttttttatgtcttaattttttgtattatcttttctgtttctgtttactgaataagcttttcaggggatcattgtagaaacccatagatgtgtgaatccagagatgtatatttgttttttgaccacatgaattgattgtgagcatgtgtctatgttttattctttttttcttatttgttttttctaccagatcaaagttataagcttatcttagttgagtagatgttgcctgatttttgaatgtgagctagaagttgtagactgggaaagaagccatgtgcgaggcaagttatttttgtgcttgagctaaacattaattcacatttaatatttataacattatattgtttttaagaacagatcttttctgtctgtcccctgccttctcttttcctccttcattttctttcttcctcttcctttttcctttttttttcagctgaaatgaaaatatacttaaagtacaaaaggctaatatgaagaaagcagatgaagggaacttaaaaagtaggaacataagataaagacattgtgtgatatggttattaatgtgttcagaggtccagaacagaaaataaaattttttatacagaaaatagtgacatttttgctgctcttttatttttaaaataaaacccttcaataaaaatggcataaaaatggctttgaaagccaaatatagtttgcctcagggaatcttaagtctttgtggtaagttcaggtttattttaataactcttcctatataatatttgtctttaaacaattataatcatttaaaattagacaaagtttgtgatttaagtcaacattagatagaagttaagagcttgagctttggtatcagtgggaattgggtgagactctttgatcaagcaagtcgtgtgaccttaggcaagctacttgttctctctaaacctcagtgtctatttctaaaatgaggaacattataatagctacctagtggggttgctatgaacagatgaattaattcacagagtgcttggccaagtttacacgtgtacttcctactgtcattatcatcttccttgtcatcaccctcattctcgagaaggtcctggagccctttcctgtgagtggaagtgtggactatccacacttttgtttttgctttgctatataactggacactatggtgcctggactgtaaaactcagtggactaatttttcacttatgaaatgaagaccatattttttttcatgggaaaagaagattttgacatgttaaaactggagaagagagttgcatgtactttgaaagtagaaacagattattagtagaagagatttcttcatagataaacacaggtagatattaacaatattacagttttttgctttgatgaatgatctttgcatattctttttattttttttatataggcaagtttagcttcttaagagtagtatcttagttaacagaacatggtagacatctgataaatatctgttgaataagaggcatttttatttttatataatatgtaaacttaataagtgataattaggcttaaaataaatagccaatatctatttttaattagtaacaattgattatttaaatatcagcccttcttagcagcgagtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatttagtttgtcctcaggtgtaaattttatgtttgggaaaaattcatctagccattttatattttgattgtggaaacaaagaggaaatctgaagtggtagcaacaataaagggactatgtttaaccacatagtaggtgcttagtaaatatggattgaacagaaaagtaaatgagctcattttactaaatagtatatgtttccttttaactaaagtgaccataaaggtcttccttcatttaaatcaggatacctttgactgtgaaggaggtgctgttaacaattatgctgtgctgtcaggtctatgctgggatgactgtgtaaagcaaactaaggtgtttggtcatcctctttttagctcaaaatcctgattttataaacatacatctgtgactgctaatttcttcactgtaatggaaattttaaatagcaaatgatttttttctgtctaaagcattttaatcactcctggaagcttcttcctcactcttcacaatggatccattctccctatgccaaaaacagccactttctgattgccatcagattaggtgtacatgtgtttgggcttcatataaatccatgcacactgcatatgttcttttgtgtttgctttcttttactcaacctaatgcttttgagattcattcatgtttttgcttgtatcagtagtttattcacttttctttgctgagtagtagtccattgtatgaatatctgttgttcatttctattacaataatattacaattttgtacaatattagaacatttctacttagtaaggaacatggtcattatattggatgaatattcattgttcatttctattacaataatatcttacaactgtacaatattagaacattactactaaataatgaacattgtcattacatcatatgaatattcattgttcattgatagtattattactactaagtaataataatttttcttgttattcttatttttctaagtattctagttactaaggaaagtagcttggccctcttcatcaaggtaattttttgtgaatagtattagcatattgcaactatgtttctggagccagcctgccaataaatgcttcttggctgtggggaaaagaacacccaaaaatctgaggcgtgtacagtattgtttaataagtagcatttcattgtatgaatagatcacaattaattcatggcccatgcaactgggcttctgtttcaatgtatccattcctctgtgatgagtttttcaaagtggatgtgtcattttacactttcattggagatttttcagagttcctgttgctcttaagtttaaaaacagattttaaattgactctagatttatatggactctattatagtctgtatcccattatgtaataaaaatgaatgtaagaatttaaaattttgaagtgaataggaaaatatcaatgatatattgtgaatagctttttgatgaaaaggatttctaatactttggatatcctgtggctattatagttataatgccagccagctgttatagccaatcagtaaagaaattttgcagtatttaataaatggcaactgagtaagaaagatttgaaaaagtaatatttactttgctgcaaattttgaaaccagaattggtcaggcaaatacatttacaggattctagctaagagaatgcacttgaaaaatttgtcctaggcttggccctgggagagattatgaaagaccctgatgaggttcagtattcaaaaggtttccagaaatttccccatgcttgatcatgtatcatttcaaggattctaactctgaatcccttcttgactcccaggggctcaatagaggtcacagtgatattggctctttcatagctagaaagcttctctgcagaagaaattaggataggaaaaaagggctaaccaccaaagtcttcatattagtcttctctagatggttgtctaagttgttctctgggccagcagaataatcatcactgctagcttattagaaatgaaaattgtcagtttttatccaagacttgcagcattagaacctctgggagcagagcccagctctctttgtgttagtagccctatagattattctgatccatgctcaagtttgcgaaacactgcctgaggtcagttctgaaacaatagctgatgttgcctgtgtccatttatcttattttattcttagttcttatatagagaggatgcttttgacctatggttttcttagatttgacctctggttcagtatcactatgactatattttggtttctacttttcctttttttttttttttggatcttctgaccctgattctgtaattttctagccctgtgtctcagatgtactttacactggtggtgtaaactccaaacatacagttgtttggaatgatataaaaggaatggtgcattgtgattcagcatttgattgaggaggcctctggaagacattctgtattgaaggaatcaaagagacagttaaaagaaggtgctttacattcatttcaaagaccagagcagcctgacaatttctaagtggtagtatacttgcagtatccataagtaaaaatttaatagattgactttttcccctacatcccttctttttaaatttcttgtgtacatttgggaatagttaaaattgaatggatgaaaacacaaaattgtacatttaaagttttttagaagagttcatattgggactcataatggttcatggatggactaataaatatggatgtagaattattataaatactggctgacatttatataaaaataattgggagttaattgggagctacatttttacataatggtccattaggttaattatgcagtactatcgttcctcagtatactcaggggatttgttccagcccctctaccccaataccaaaatccagagcatactcaagtcccatggctggcctgtggaacgtgcatgtacaaaaagttggccctccatatatgtgcctttcataggccatgaatggtatattttccacccacatttagttgaaaaaaatttgcgtataagtggacccctccagttcaaactgtgttgttcaaaggttaactgtaatcttaaccaaatggaacatagtcaagtataagtaaggatacaaaaagaggtaagtgaatgccaaagctgggctttttccctaaagttatcttccaggtcctggacacattgatcttctgctttgatgattctatagggcactgaggatgggagataaagtacagagctcactttaggtagagactttgctaggagcccttgattaaagcctgtgggaccacatctgcagtgtgaggtgcaaactttggaatagtctaaggtaatatttacaaaatctatgcatttaagaccttgtattttatttatggaatggtatcttaaacacataaatacatttatgaattatgtaattccataaagttagatatgttaagttatgctaatataaggcctcaagtaatatggaaatttatttatctctaatataaatgtctaagttggcagtccagggctagtgtgatagttcctcagtcatcaaggtaccgggcctcttctctctggttactgtgctgtcttcaacatgtagttttcagttcctggtcctaggtagctgcaccagctcccaatgccacatatgtatttcagctaccaggaagggaggaggaggaaaggaaggtattctccttctctttaaagaataacttgaagattgcacacattaaatttcgcttcccacgggtcacatctaatcatatggccatgaccacacctaaccacagaagaggctgagaaagctagtctttggcttaagtgcctaactaaaaatgttattattacacaatgacaggaaatggatattgagggacaactaccagtctctaccacaattacttgcatggtttccaaaagaagctataaattttaaggagggaagagatctgtttgaaataattcagctgtttaccctttgactcatagtccacttctaggaatccattttggagatacattggcaaaaatttgaagaaaatgttactggtcattgcagtgccctttaaacgaacaagaactggaaacaacacatttgcccatcactagaggattttaggttagttgaataagctaagctccatccatctgatgggttacactgcattgtttaaaggaaggagacagatctctttatattgtggtaatagtcagggtttgattggagaccaaaactagaagaagcaaaactgaaagatataagaaatatattctaagcatctgaccatttgcagctgtaaaaactagttaaacagtttaagaaagattgttgcttctgtgtttgatgctataacctgaagtccacggggaagactgtgaggaaaggaagatggaaataaagtaggggggaacaagaacaaaatagaacttgctacagtggattggaacttaggtccatctctcaccacctccaaggcttagtgtaggaaaaacgttggctgctaggagaccgggtaggcggctgtttgaatagcctgtttatatgatatcatggagaaggcctggattagcagaaggaaatgggttagaaatttttttagattatatgaaatatttggtgtctaaatgaatttaaggaggggaaaggagaaggaggtgttaagagtaagtgtagaataagattttcttttctggtattaatggaggaatagtagattagataacctgaaataaatggtgtgtgattgtgtgtgtgctgattttaaatatatactgagctggcatgaaaattagaacgctgcagagttcaaaagcaaagtggagctcagaattctgggaggtaagtgaatgccaaagctggctttttccttatagtcatcttccaggtcctggacacatttaacttttctttgatgattccatgggggcactgaggacaggagataaagtacagagctcactttaggtagagactttgctaggagcccttgattaaagcctgtgggacccattcacagtgtgaggtgcaaaggtggcaggatggaaacttacctgtcttgctctatcctcttggagaagaaaaaaaaaatctcttctgagagtttttatcacaagatgaaccttacacaggattacaatttgagtatgtgctagtagtgcggtctgaaagcacttaagcagataattaaaagtgattctgtgtggatggtgtccatgaaaactgttggaaggaaacaaaatcctctctggagtcacttcaacttaggttagcaacaacccagatactcccacagataaagctccgagtaaaagatagaatccctttgagcggaaacaagaaaaggaagctataaacccatgtagactttaaatattaaaactattttataagaaatgcaaaatgaaggccacgtgtggtagctcatgcctgtgatcctagcactttgggaggctgaggtgggaggatcgcttgagcccaggagtttgagaccagcctgggcaatatggtaaaaccctgtctctacacaaaaaatgcaaaatgtagccaggtgtcatggcatgcgcctgtggtcctagctacttggaaagctgaggtgggaggatcacctgcgcctggggaggctgaggctgcagtgagccatggtggcaccactgcattctagcctggatgacagtgagaccttgtctcaaaaaaaaaaaaaaaaaaaaaaaaaaaaaagcaaaacatgggtttcatattaaaaaaaaggagacacttgagaatacaagaaggtgacaagcaaagttgaagaaaaacaacagaaggtttaaaaagaaaaatataataaaaatctccaatggtttaagcccagaaatttataaacagataacgggggaattgataaactggaagataaaaccaaagcaataaccagaatataatctagagagataaagagaaaggaaagagaggttgaatgtagagggatactgagaaggtctaaatacatctaaggaaacaaacatgagtgtttttcctaataatatttatcagcaaaattttgctgataaaaaagtgattccctggcatatttttgccattttgcctcatcagaactaaaccagtgcagtaggaaatatttcagggaagcatcaactactgcctgcttttccctcctgtagtactatcaaggtagagatgttattttctcaagtctggagtagtagtccatatataatctctaaaataaagtaggtaaaggatactaggtaaagggttccttaggaagctaaaggtaggcatcaacaagttaacttgtcaactttaaaaacaatttacctgtagtgtataattttaatctgtatccatatcatttatattactaaatcctgtttaagaatgattcacttacagaggtaaatgcaaggcttttgcttatggttgctgggcagagctctcactcactggttaacctgggcacctctgggtttcttcttttccttgtagaacatactctttccatgcttactgcccttatcttacccaatgtggttctgaaggggctgacagtcatctcatctgacctgcatgatctcaggacatggccatgtgcctctatctcagccattctgatttcttttctggtattttctacgtggagtcagagtttaactttctatgggtggtttgcctgggatgatgggagactggggctccaaattactcttactcctttaatcttcctttgattagtaagcttctttcacatctctccatttaatctcattttaagtttaacatactttgagtttcagtctcctgtagatgttactaataggtaattttgacgaatacataatcttggctagagaagagatgcctcttttaagatgaaaatatccttcgttaatagcacaataaactgcagctgtcatgatttaacacagatacttcttttgtcttaataggtgaagtaggaaccccctctatttactcataatcatatttcataaggttgctgagaggatttaagtgagattatccatgtgtgtacctgcctagtctttaagtaccattagaacacttatgtgctagacgctgggctatcttgtgtagacatggggactatgtcatttaattctcacaaccagcatatcaggtaaattctgtcattattgccattttatagatgaggaacctaaggattagggaaattagacaacttgcccaaagtcacacaaccaggattgggcatgtttggcacagatggtgacttttaagaaacttgctcaagctcacagaaataatgagcgatggatttaagttttaaaccaagacattttgacaccagaggctgccgtctttctaatactaccctattttgcatcccacctaattattattgaatggaggacataaatgaaatataacttcctccagtgtcctagtttcatgtcaggaaatagctgtctagtttttaaaagtttcccacataattaaaatgatcttattttttattttttcgagacagggtctccctctgttacccaggatggagtgcagttgtgtgatcacagctcatggcatcctcaagctcctgggctcaggtgattctcccatctcagcctttgaagcagctgggaccacaggcatgtgccaccatgccttgctaattttcgtatttctcaatttttttgagtttttgagaaactcaatttttgagtttctccatgttgcccaggctgataaaatgatctactttttaactgaatggaaatatatacagttggcgctttttatctgtgggttccagagccataagtttaaccaaccatagattgaaaatatttgaaaaaataattacactgaacatgtacaggccttttttcttgtcattattctctaaacaatacagtatagcagccatttacatagaatttacattgtattaggcattataagtaatctagatatgattttaaggataagggaggttgtgcataggttctatgcaaatcctgtgccatttagatcagggttctgagcagctatggatttttgtatcttcaagaagtcctgaaccaaacccccatgcataccaagggatgactgcactattcatagccatgacttaaggtagtacatccctatgtagtatatagtccaaggtttgaatatatatatattgcattaatttctccattggcataggattaatttgcttctttgaaagttataaaaactacatgtcacagtctggtctggttacaggtagggggtttgggaacctttgcaccttgtaatcattagtcattaagggacctagtcatatgtccccagatagaggcaaaggcagctgggaaatgtagtcttcctgcatttgggcaagaagagatgaggtcgtttggcccctgtgcagcattgtgccagtcacagttcctgttgatctctctgactccatcatttctgggcctgatctctctgactccatcatttctgggcctgtgctcataaactgctctctgtgcaaacctctgggctgtggtgactctcccacatgtccagcctttagaaatgatttctttcaattcaaccattaactttataaatcgtacagatgaaaataagtcatatattctttatgcagcaattttcttgaattttatttctccttattttgaatatgcaatcaatatatataaaactttaggtttcctgaacatagaaggagaaagtaacctaataatattttcgatttcctgattatttattgtaattatgacatttgagtgcaatgaatctttttagaaatggagaaggatgtttagaaaaggtagataaggcagaaaaatccagctggtgtaaaaaatgtacaaaatagtgatgattcaaaaagagtgagtcagtgtgacattatcacatataggcatcttgtgaagaagatattctttaatgtcttttggttttacttaattgaatgacacatgacatcagtgatattgaattaaatatgattttcatctgtgattcttctagtgggaaatcaagacagactaaaagactaaaatccttgtattgtttgtcttgtttctaggatttctggataatccaaaaatacgtaaaaataggacataatgatattgaggaacttttttagcagatgtactaattgtgtatgaattcatatattttgaagagacgaacattatttaaagtagctttttaatggtagaagacttaaaatattttttgccaagtatcagtgtacgtaaagagagaaattaatattttgtattttacattaagcagattaatttgtgcgggttagtatatttaatgctaggtacactcacaagagtaagttggatccattagtgggagaaattgaattcatttgttagatttttaaattagtttctaaattgaaataatacacataatttaaaaagtcaaatgatagcttctaataaaaaatagcagttccttaccttacccttcaccaaatccaagcatctttccccacaggcaacaactttcaactcttttagttgaaagagttgaactccagactttaagaaatgcattttatttataaatcatccagtcttaggtattctgtcctagcaaaacgaagtggactaagacaattaggtttgctaaatgtcagctggatccttaactacagtgaggtagttctgataccctcttgagtttatttaatttcttctttttaaattaaaaatgtatacaactgctgaaaatcagataattttattttgttgtacacaatattataattaaggcattggtttacaatggcttaccttattttcttaaaaatatttatttttctcattataaaggtaacacatactctgtctgtcagccatcgatgcttaacaggccactcctgaaactcagtggctaagtcaacaatgttctttatatagctcatctgcaggtcagcatttaggccggtcacagctcagcaattctggtcttgtctaggcttcctcataggtctatagtcagttgtaggtcaggtgtgggttggatttgctgattttagttgggctatttcaccagttgtggctgataggctttggtctatctgtccctttatcaccctgcgggctggctcaagcttgttcacctggtggaagcagaggttgtaaggcccttgaagcataggcttggagttgacatactgtcacttctgccatagtatgttggccaaaataagtcacaaagtcagcccaagttgaagaggaggacaaatagacaccatctcttcatgggaaaagatgcctactcatattgcagaagggtgtgaatacagggagatttggattctgtctattgcttaatcttttatatatgtttgtactgaaaagtacaaacaaagataaaaggaactcataagtccatcctctaactactgttgactttttgttttatatactgtaagactgttttatctatacttttaaacgtatattattaatttatttcagtttccatttgattacaagtcatgtttgtttatttcatatttcttctatgaagtggtcaagtagatttctattttgttcttaaaatcgcatggtagcatttcttgtaaatctacagttccagatatctaaagccggcaggacttcagctaataggcaattattctattttgtgatgagaaggccctgacttagtattgagtagcaggaagaatcaaaaggtgttcagtcaactgacagtgcaattgcctttgaatttgtttgtatatcttctgtgactgagttaataaactgaactattcatggaataggacccagtgggattttcttatgctatggtatatttttaatattattcacttttcaggctaagtttgaccgtaagcagatatctatttttgatcattagctttaaggtatttacattctcaatgactaagcttaagctatgtggtagagtgatttatttttgttcctgaataaaattttaataccatgagtcatgtgttttctttgtaaaaagttccagcatcacagaactatatagcataatatagtgaaagttcccttttcctactggctcactttgaactcctttccttaagcctttttctgtgcttttatatttacatacatatgtgaatatatagaatacatttacttccatgtaaacagattttgtgtgtgtaacataaaaatattgtattataaacattgttttgtaacttgctttgcaaattattttctatccatttagtcaagtatgtgagtgtataaaatgtacacacacaaataatacaaataagagcatgttacaaatattgtataacttgctttttttaccaatatatttttgatatatttctgtatctattcacataggcttagctggtttttatattcataaaaccgtattcattttatagtcataaaatttcttcacatgtaccttcacatgtatcctttccctattatggaacaacgaattgtttctaaattctggttattttaaaaaatgttgaagaaaacatctctgcttgtatatatatgtgtatgtagaagaagaaaattacgcttgtgttctttattgtaaatattctacaacctgtatctcttaatccctttcttgctttctctaagccccatatattcaatttagccctgagtaatgcatgattgacgaagccagatgctgtgtgtctaaacagcagttaatgaaaaactatggaaggatagggaatcattaccacaggtactgtggggcggcaagactcaataaagtaactgttactaaaatctaaaaatgaaaacaggaaatatttgtcagacatttaacttggcaattgtaagagtgaaaaccttgtgtttttattcacttgtgtatcagaatttgccgttttttaattaagagttattttttaagagcaattttagattcacagcaaaattgagagatagacatggagattttccacatacccactgacctcaaacaagcatagccttccccattgccaacatccccatcagagttgtacattttttacaattgatgacctatgttaacacattgtcatcactcaaagtccatggtttacatcagtgttcactcttagtgttgtaccttctgtgggttgtatgatgacatgtatctaccactataatatcttgcagagtatttccactgtcctagaaattttctgtgcttcatctgtttgtctcccctcacttcaacccctggcaaacactgatagctttattgtatccatagttttatcttttccagaatgtcatataattggaattatgcagtatgaaaccttttcagattggcttccttcacttagtactatgtatttaagattcctccatgtcttttcatggcttgataactcatttctatttaatgctgaataatactccattgtttggaagtaacacagtttatttattcattcacctgcagaaaggtatcttggttgcttctaagttttgacagttatgaataaagttgctgtaaacatccatgtgcaggttttggtgtgcaaataagtttcaacttattcatctggtagtaattgttttataaatttgggagctccagtgttagatgcatattatttaggattgtgatattttcctgttggagtagtccttttatcattatgtaatatccccctttgactttttaaattgttgttgctttaaagtctgttttgtctgagaatacctactcctgctagctttggtttccatttgcatgaaatatctttctccatccctttaccttaagtttatgtgagtccttaggtgttaagtgagtctcttgaagacagacagtagatacttggttggtagatttttatttattctgtatctcttaagtggagcgtttaagccatatacatttaacattagcattgagatgtgaggtactgttttattcatcatgttgttgcctgaataccttttttttaaagttgtctttttttaataggccttgtgagatttatactttatagggaggttctattttggtatatttcaaggttttgtttcaagatttagaactccttttagaagttcttgtagtgctagcttggtagtggagaattctttcagcatttgtttatctgaaaaagactttatctctcctctatttatgaaggttagttttgcggcatacaaaattcttggctgataattattttatttaaggaggctaaagataggaccctaatccctcttggcttgtagggtttctgctgagaaatctgctgttaatctgagaggttttcctttataggttacctgatgcttttgcctcacaactctgaagattctttcctttgtcttgactttagataacttgatgaccacgtgcctaggagatgatctttttgcaataaatttcccaggtgttctttgagctttttgtatttgaatgtctagatctctagcaaggacagggaagtttttctctattatcccctctaataagttttctgaactttcagatttttcttcttcctcaggaacaccaattattcttaggtttggtcgtttaacataatcccaaatttcttggaggctttgttcatttttctttgtctttcggttaatttgtaagccttgtctttgagctctgaagttctttcttctacttgttatagtctattgttgaaactttgcagtgtattttttatttctcttagtgtgtctttcatttccagaacttgtgactgttttttctttatgatatttatttctctgtataccttttcatccatatcctgcactgtttttttttaaattttctttaagttgtttttctaccttttctggtacctccttgagtaccttaataatcaaccttctgaattccttatctggcaatcagggatttttttcttcgtttgaatctattgttggagagcgagtgtgatcttttgggggtgttacagaaccttgttttgccatattaccataattgcttttctggttccttctcattttggtagtgtttcagtggaaagaactggaactcaagggctgctgttcagattcttttgtcctgtgggctgatcccttgatgtgatgttctccccttcacctggagatgggacttcctgagagagctggactgcagttcttgttattgtctttcttgctttagccactcagcggggctgctgggctctgggctgatgctggggaatgtctgcaaagagtcctgtgaggtgatatgtcttcatatctcctagctgtggatgccagcacctgctccagtataggtggcaagggagttaagtgtactctatgatagtccttggttgtcgttttgtttagtgtgctggttttttcgaatgctggttatgccagcagtgaagttgttatgtggacagacttagaacctctggttagtcaggatgttgtagatggtagaattagctgttttctccttttttggagcagggttattctgttatgtcttgagttggttggcctctacccaggaggtggtgcttttaaaagagtgccagctgtggtagtagaagggggatacaagtttgttctttgttggccaggatgagtacttgggttcttcaggcaatggatggggctttagagttctcaagggtttatgtattttggctcaggctaccagggtgggtagtgaaaaaccatgaggtgggggcaggcctaggcaggtctgagctcagactctccttgagcagggcttgccgaggccactgtgggtgatgttccggggcattacagctgcctctgctgtgtcatactggtcgccagggaaggggggaaagccggcagtgacaggcctcacctagcttccacgcagccagcaaggccaatctcactcctgccatgccccaccaacagcacacgtttatattcaggcagctggggagagcggatagatcttgccccagactacaagccttcctgctgagaaaacaagcagggctctcaggccttgcccttttccgtctgcctgcaccatcagctgtggcttctgtgcttgtatctgcaagttatatgtgcacttcccatttgccccctggactctgctcaggaaaatttgtactcagttgaacgtattatgaagttcagctagaagcttctttcatcctatggcccctccctaattccactggctgccttccccaaggacccctgtgagataagtcagggatggctttctctggtttgagccgggaactgggagtgcctacagggcgcttcccgctccttcttctactttgatatttcacttggctgcctaaatccattttaacttcagatgagattaaattcttctcctgtgatctggatttttaggttccccagtggggatgtctgttcagaggcagacttttcccccactcacactttgggaacttacagtttttcagctgtctcatggagtttgcagtgtcaagctacttctttcaaagtaagtagcctgtgaattcttttggttttcctggtaggttcctgtggtggttcttggaggaaaagtttacagtgtgagtctccacacactgttctgtctgtccaaatgggagctacatgttagtcctgtcttgtatctaccattttctccatgttggtaatttagatctttgtatttcctctagcttttaaaattttagtagtataaaattttctttgcagtatcatttgattaaatgtgttaatacatgtatttggaatcatgcctgacacatagtaaatgcttaatacattttaatggtgttattaaaagttgttgctattattatcatataaaaatctcctatgatttattttaatattaacacttaaacctaagcttttatttagaatgttgggggcatgagaactaattagaagaagtattctaactcagtagagagggtaggggtaagggtctgtaaaacattagcaagtggggtcagctgatatttagccagtttcagagttagtctaaaactaccaacagagtaaacaggcaacctatagaaggggagaaaatatttgcaaactatgcatctaacaaaggtctaatatacagaatctgaggaacttgaacaaacttacaacccaaaaacaaccccaagcaaaaaagtgggcaaaggacatgaacagacacttttcagaagaaagacaatcatgtagccaacaagcatacgagaaaatgctcaacatcacccatcattagagaaatgcaaatcaaaaccacagtgagataccatctcacaccagtcagaatagctattattaaaaagtcagaaattaagagatgctggtgaagttgtggagaaaagggaacatttatacactgctggtggaaatgtcaactggtttagccattgtggaaagcagttttgtgttttctcaaagaacttaaaaaagaattaccattcaacccagcaatcccattattgaatatatgcccaaaggaatatgagtcattctaccataaagacacatgcacgtttatgttcactgcagcactattcacaatagcaaagacgtaaaatcaacctaaatgcccatcaatgatagactgggtaaagaaaatgtagtatatatacaccatggaaaactctacaggcataaaaaagaatgagatatgtcctttgcaggacatatctggaggccattatccatagcaaaacattatccactatagctggaggccattatccttagcaaactaacacatgaacacaaaaccaaataccacatgttctcacttataagtggaaggtaaacattgagtacacacagaaaagagaacaacagacactggggatctacctgagggtggagggtggaaggagggtgaggatcagaataatacctatcactgaggttggtggatcgcttgagccaagggtttgagaccagcctgggcaacatggtgagacccccgtctctacaaaaaaaatacaaaatttagccaggtgtggtggtgtactcccatagtgccagattcttgcgaggttgagatgggaagatcactcgagcctgggaggtggaggttgcaagtgagccgagattgcaccactgcactccagcctgggcgatagggtgacaccctgtcttaaaaaaccctccaaaaccccaaaacccaaaaaacaaactaccaatcgcttactatgcttattacctgggtgatgaaataatttgtataccaagcccccctgacatgcaatttacctatatggcaaacctgcacatgtacccttgaacataaaataaaaataaaaataaaaaaaggttttctgaaaagagaggaattgtttttgcagtttagtagccattgatggggtggttcagatttagcaagagaggtggatagaaacagttgctgggtctgtggtcatatgagggccactgtggtacatttttagtctttctgagactcttacagattatttagaattatttacaacatattctaacatatttgggagtgtattttatcattttaaatcaagccataatcttccactttttgactacaggccattcctaatgtgtttctcagaatgtgtgcaaagtcaaatatctggaagtcaaatatttacttacatttaataaatagatttctttaccaagagagctaaaataaaattctatttaaacttcaccttttatacacggttgtcagtaatatagtttccaacattttatatatacctttaatttttttctttttgaattgatcagttcaagtgacttaaatgcactgagcatccagctgaggttaaaaatttactgtgtgcaacatagcaaataatttctcacttgacccttacttattctctttggtgataagagtgttttcacttttctgttttttacttataaagtattaagggcaaataagaattctaataatatagaaacattgctatacaggcagtgacattaacaatgcccaaactgaacacttgactagcagaaagggtgttgagcttccattcttacagctagcttatcttcagaatttcaaatttagaataaaaggcatataataagccctttaggagttttcatctacactatatatataactgtgtgttgagcataagttgaaaatatgaaaatttaggtctgcccatacttagaggcagataggtagaaaacactaaactcttaaggccattaggtatttagtaatttttatgtacagttactttttaaagctagaaataaagttgtaggcttataaaaattacagttgagaaaattttctcagtaatatatattttagaacatttattaattttattaataccctttcagcatctctcagtgttgaacttgaatttatgaattctagctaatttatatatctttagcactgaatatagctagggtatgaagtgattaatattggactacaaataatagtttctggctatgtaaataaacttggagttcttcattttttgtagtattaatgcatgatttaatatgaaggaatttatgttcaagaaaaatacagatttctaatggaggagtgatatatagtaatgcactgaggcagatggtggatgataagtatgtatagatcacacctgctttatggaatgtaaagcttgattcgtgtgtaaaaaattaatttgagaaaatggtagggaatggctgggagtctgtgagagaattctagatttaacactttgattagtctcaggaaaaacagccattatataatcttaggttatattttctatttttaaacaaatatggcaagcataacacctccctttttaaaatacacagtttttgcaatttttcaagacttagggaaaggatcaagcttgatatatgtttatatttaatacttctgaaacccattttgggcagatttctatctactataacagtggttatgagcttggaccgctgagtggccacactatctataaccgagttctttaatatgtctttgcctgttttctcatctgtagcattgggataaatctagtagcagtcacattgagttgtaaggataaaaggtgatactttaaaggtgcttaaacgtgcctaatatgttgaaagggctcactaaatattagcttttctcattattgttaatatattggagttttatttcataaaaggtgaccttttcatctaagtgctatttataatttaaatctctgttaggtctttgttagttgtctgtcatcctcacacttgcccttctgtgttttcttctgtaattcatgggttggaagcaagtaaactgtattttcctcacccctttgctagctgagtttcattagagggtgggaggaaggtagaaaggacgccactgaggtttttgaggcacctttggtagtggcagttgaggagacttcgctgtgttgcagtgaccgttgttccacagtgtagatggcagcgatgttggtggcagggcatttaatagggatgggtctgctcagcagcagccaatggtggttccagcactgatagtggctcctgtgggctgttgggtccagctcagagatggtagcagcttcctgatccctggtttgcattgtttaaccatttgttactctagcccttccaaagtctttgtaacagattccctgaattaaattaaatttttctggagaggttgccctcgagaagagggtgctcatcaataaaatcaacagttgtcatttaatgttagatatgcaataaggaattttgcagtctaataaatatagcatgtattccccgtatatctttcttacctgaaaataattgtgttttgtcagtgtgtcccagtgactttttctgtctcctctgcatttaggaagtcagtggacacagctagtgcttggtgtctagggggaattgttgctcctcatgggtaatattggatttatgaaaactgagggacttacattaccaaaagcatgatgtgaaaaatatattaaatatatactaatatttcaatgatttaaagtcatctacccaatagaagccactatatttcattgattctaagctaccccttccccccctcatgttttaatatctctggtattggattgtgacttaaaaacagtagcatgttgcagtcatctcatccagtggccagtagttgctgttatctgcttatgtgccaatataaaaatcataatacagcttagaataaaattccagagacaccagagaaggtgtctcttttgacaagttgaagactcttttgacaaggagatgctaaatggttgtggtgaggtagaagggtggggaagtgggaaatcacagtagtttaacaacccttggaagcaggagtctaaagtaggctgtgcctaattactgagctagcttgagagcttagcatcaatctttcaattttttaatgaattcatttaaaaaagtgctgcatcactgatgtgcttggtgacacagaaaatgagattctctggagaaatgtggacactgatatatgtcaaagagtgagggagaagaattacatttggatttcttcatgaattttaggaattgattaaaccaacttattttgcttatgttttgtttttatgtctgtgtcagtgtgatagataataaaaacccatatctaattaagtcttttttctttcaataagaataaaataaaagttctaaaaagtgtatcagtttaattagcagttttttttctaatggttcatacaataatgatgccctttattgaaatatttttttctatctctgtataattctttttgttaggtaatattttttcccttttaaactctatgtgctgatgtagaatggctttaaaatatcgcccttttattcagtgttcaattttttttttgcgccagttttccaatttaccttgtaaaattgacaccctatgaacaaagtttattctatatgtgtagctccttgctatagaaaatgcattggaaaatatttaccaaaggaattcaaatatattaaacatgaaagacaaacaattgccagtaaaactggtgataggagaacttttgctacactattaaatgctgcataccagagagtacagtatacaaacaaacaaaaaaccctaagggtaattgcaaagattgaacaagttgtgttataaatgtggccaaattttaatgtgttgtgtgttaaatatactgatgcatattatggaatatcagtctcatcaaagcttctttttttgtttacattaaatgagacagggaaatgtaatgaagttaatttggaaattttataagaaatatgaaggtgccttatcatatcattacttttgtgatttatatttgccaacttttttttttttttgaaatggagtcttgctctgttgcccaggctggagtgcagtggtgtgatctcagctcactgcaacctccatctcccaggttcaagtgattcttatgcctcagtctcccgagtagctgggattacaggcacgtgccaccatgcctggctaatttttttctatttttagtagatattggatttcaccatattgcccaggctggtctcgaactcctgaccccaaggtgatctgcccatctcggtctccaaaagtgctgggattacagacatgacccactgcacccagcaaatatttggcaactattttgaaaagattcctaatttatctcattatgcaaaagaactggaaatgtgagacttaccagttaattaattattgaagaaaaaaattagactgcatttgagtttaagtgggtccaagactttctgtttcaagttaatattgctgttcatttaaaaataacaggtgatttttttttaattttcagtgttactcagtgataataagaaaacattatcctctgaaacaataacagtataaaacatttacgaccttaaaatcatgttttatatgtacaagtatctcagtttaagaagtctcctggccaggcgtgatggctcacgcctgtaatcccagcactttgggaggccgaggctgacgaatcacctgaggtcaggagttcaaggccagcctggccaacatggcaaaaccctgtatctactaaaaaataaaaaaactagctgggtgtggtggcgggcacctgtaatcccagctactcaggaggctgagacaggagaattgcatgaacccaggaggtggagattgcagtgagccgggactgtgccactgcactctagcctgggcaacagagcgagactctgtctcaaaaaaaaaaaaaaaaaaagtctcctggttacatgaaagatattagctgattatgacttgatatatttagactgttgattggtcattggttttcatttagtggtcaagagtgtctagcaaaatgctgactggcatatgcagacactgaatttacatcttcacatattcatgtctctcaatattcagaactcagttaaatttatccaggaagataaggaggtcataaatagaataccaaatgtggttttgcttcttttacagttagagagctttgttaatatcctcattttcttcatttgtactagcatttccaaacagaatttgtttcacaaggaagtatcaatgtatagtgtctctgtcaggccttgcattaagcccagtttctcatagtcggttttcaatgacatttctaatttggtatactttctgttatatcacaacttattttcccagccatctaagggagacttgttaaggtgggtcaacctcatttttgtttttgattttaatattaaaaattttgttaaaatttttatttcgaaatagttcaaacaaaaagattgcaaaaatagtatgaagaattcatatgtacctttcactcagcattcccccatgttaacctcatacataaccacggtaatattgatcaataccaggacattagcatggatacaatactattaactgctctgttcacttaattccaatttcgttaattgccccactaatgtcctttctttggactgagattctatccagagtctatttatcgttctttctccttagtttcctttattctggggaagacagttcctttgtcttttttgtctgtcatggtcgccacatttggtcagctcttttgtagactgctcctcaaattggatttgtctgatgtttcctcatgattaaactcaagttatgtctttttggcaagaatattatagaagtgatacaagtgacagagtgtccatttcagtgcatcatatgagatgatgtttacttgtttttactcttctgttatgaatatgtaccccactgctaagaatgccagcttttagcctttgtgcagctaattatatttatttttcaagatttgcctttttaaaatggttttctttatttgctgcacttcatttgatctctcacttctttgccttccttttgccataatactcagtaaaaccttgtcatgcttatggcttgaaagtctatattgtgttgtgggagcctcacccactgttgctcccaggagtcctctctggtttattcccttgggacactgagacttattataccaatttattttgtccaaacatgctctcaataatcactgtgggttaagtactaccaaaggttggcacttaattattattttatttattgaaagttaattttatcttctaattagatggtatcttcttgccagcgtggacaattctacagattttttttttgattacttggagacagaaacaaatatttttaatagtatcttgatttagtctttctaatatagactgttaatctttagatttttcgataatttaaggtgaagggggaggaaaagattgggtacaactgtgtttagggaataatttaaaagtgattactagaagaaagtgcacttagttttcttgttcatatattctttcttatctctagcatcagtgctaaaagtaacagttggtatagaagtgaaaattgtcaaaaaaagactgattaataacctcaaagctgaaaggagattactaattcagaaaatgacagttgtaatatagaaatccaatattagtttatagttgattatcagttttatacagaaaataatagtgaaaagaataactctttttttagccttaatgactctgtcattgaattacttcaaattgtgatgatattttcttcctaagagctgattaatttaatgtgttcacactttgttccaataatggtcctaagattacaggtggaatactgggacacaaaaataacacaatattttgtcagagatgaccaaactcattagatacagagacaaagccagaattgggtttctggttgggtagatttacgcccctcctacctttccccattagactgaattttaacaaaccagacaggctttctcaggtatggagacttcaaatatgctgctgtaatcagacagcatgagctaacatattttaggaatatacttgacttcattttaaatagagaacatttatgttttctcactatttcatgtgtaatgcaatatgaataaagccctatccgagtttcatgtttgtggggaaactagcattactgcagattagtgacagggcagagaaatgaccttattatctctgtaatggtaatagtgtgcttcacagggaaacttgtgttgttaagagtgagttgttattttgttgcagatgctttctgcacaagttattaatatattgaatcagaaggattggaaagtgctatctagggacttaggaatataatttataagtttcagtattcacctttacttgaaatatgtaaatctgattttgtagatgtatacacaagcataaacatggtttcacgcttgtgtataccttttctttctttatggaatatactctctatttttcttgtgtcaagtacctctgtctctaagacccacagcagttgtatcctccgtgatgaaacctatccctgtaaccgagttgttgcttccctttagattcccagagcaatttgttcccattgctatattatgattttatttgttggcttataaatctatttccatctttgtaactcacagttgagcgtgtgcttctcaatggcaattcagtttttcaattcatattccagcatcttgcatgatgcctgcatatattgagtatgcagcaactattcaatgaaaaatgtatattaaacttggtatatatatatattatttacacacctcacctcttccaaaaatgtgtttaagatggattataagctatatagcaaattagaagaaaactgggagaaaaaaggaggaggatgggaaatagaatggggccaaggatgagcaaattcacagcatgaatctctaagtgaatgtgtagtatgaatgagtgcttttgcatgtacacggaagtgtatatgtggaaacttacaatatacattaaaaaaatctatcctgtttgatatttgcatttttacaattttggccttgaaaagatttcttatttttctgagttgttcattttgtcactatttatctgatgctgaagtgtttctctgaggaatgcttattagtcctaagattctaatgtaatcagcgtgtggtgaaatagagcggtgtcagttagtcccacttctgtgaaaataggaatctgtaatatgactctgtgtggtgctctttagcttctgaagattcgtgctctaactcctgtcacctgctctcttctagaaagcacatagccgtggggtaggaatgcaacaaagctaacttggaataataaccttttcctggaataaatatgttttaaattaaatttaactaagaagtatctatgaattctagcttctctcaggtgacttgtttgccaaatttaaataaatggacatattaaaattaattcttattctcctgttctcaggataatgtttaagcaaatctaagaggaggtttttttttcttattgtaagtatggtgtttttaaaatagagaataaaactttgtttgctttgttattccttagttaattgttaaaataatgaggccttattatttggggtaatttatttaagacaatagagcaattaattgctcattggcaacctgacaaaggaaatgggccaagatgccaacccatttcttgtggtctgccagcccttagaattgtgtgttccagggatttgctaatcaccagctggtaactgatttacaaggctggaaagacaggaggactcttgaatcatggccacttacaagtaagatggaatgtgtactggctttaagccttgtctactggcattcagatgttgctgccaggggaaagacttgatgatggcaaagagcctgtgtgctatctttggtgcatttttccgatgtcatcagcattgttcttgaccctcactttggtttaacaattaagacctgctaagtagaatatactacttcagtgatatgtgtgtgcctctctgtctatttgtccacccgcccgtccattgatctatccatctgttcatccatccatccatccatccatccatccatccatccatccgtctatgcatctatccatgcaatgaatactggggttaagccatcaatgaatgggctagaattaacctctgaaagcattgtttacaattggggctggcaatctttttctgtaaacgaacagatggtaaatattttaggtttgcagaccatactgtctttgttggaactagtcagttctgctgttgtagggtagaaacagccgtagacactgtgtaaatcaatggcatggttgtgagccaacgaaatgctgtttacaaaaaaatcaacttgcagctatagttagcccacccctcatttagacagtggaagtatccgactcaacatagtttgggagctacacaaaaacttttaaagaagtgtatgaatgcttataagttttctaacactgctttatgttccaggtttgttagcttaattattgtctattttgggatttatctaaaaaagtagttttatagattttactgttttttatttaaacatattaatcatttaaatgatattaagctctcactgacactgattatataaatgtcattggattggaaatctacaaaaaaacaaggaataaaattcaccactctatcacccataaagcacccattacatttaatagtttttacttataaacatgattttaaaaactactttgacatggaaatatggtcaagtatattgatgagtgaaaaaaatgcagattgtagaagagttctgaacagtgtgtacaatgtgattctatttgtgaaaagaaaaaatattatatatgcgtacactaacatacggtaaatatctgaatagatatggaatcagttcttagttttcaagcaaatgaaatcaactctccaatataagcggaagaaatttattgaaggataataaattactcacagatttctggagtccttgagaatcaggtttagaggccatatatctagaagcaataccccaaataactggttctgcaaagaggccctggcaactgtcagtctgaatccttgatactactaagcctagatgccggatttgcctccactgttagcagtattccagaatgaattctagacagttactgctcttctgtgtcatcagcttccaattcagagtctgctgtgggtgcattggattgccagagcccaagttttgtgccctggctgcagaggaaccttagcggggaagaatgtggaactcacttctgtagtggacaaagggccctgcctcctaaggtaggggatttaccaaatgtaggaagaggattcagaatcttggatgccagaaagagtgagagccgtccacagcagactcctgggaaattgttaacattggttacttctggacggtggagttggaagggctaactgggagccttccagagggaggcttttactttaattttattcttctgtcctttttgaatatacatatataataaaaaagtccatggggaaaatgaacaaaagggaacaacagttttttccagcatttccactgatagtattttcgcataagaactcaagaatggctaggcgcgatggctcacgcctgtaatcccagcactttgggagcctcggggggcagatcacctgaggttaggagttcaagatcagcctggacaacatgttgaaaccctgtttctattaaaattacaaaaattagcagagcgtggtggtgcgtgcctgtaatcccagctacttgagagtctgaaaatcacttgaacccaggaggcagaggttgcagtgagctataagattgtgccactccactccagcctgggcgacagagtgagactctgtctcaaaaaaaaaaaaaaaaaaaaaaaaaaggccgggcacatgcctgtaatcccagcattttgggaggccaaggtgggtggatcatttgaggtcaggagttcaagaccagcctggccaacatggtgaaaccccatctctactaaaaatacaaaatttagcctggcagtagtggtgtgcacctgtaatcccagctacttgggaggctgaggcaggagaatcacttgagcctgggaggcagaggttgcagatcacaccactgcactccagcctgggtgacagagtgagaccctgtctcaaaaaaaaaaaaaaaaaaaaaaaaaagaactaaagaaggcttctcagcataactgggcagttttatcaacttcgtactcaattttattttgaaattcagtttataattttctcccagattcagtcatctctatataacttggttgggcagagaagttcataaaatggttttctctcagataccagtggcttccttttggcttggtagagctgatttagtttatctttttgaggtctacagtattcagctttgaaaagtaaggtgttgtcagtgactctgattgatgaagtgttcatagatctaaggtgaaaaaatacaatctactttaaaatttttggccctactattttttccaaacccccataaatttgctactttctagaaaattgatctgagaacttaattcagtttaataaagttttatcacatgtaataacaatttttaagaacaattttagatttacagaaaaagtatgaacatagtacaaagttcttagataccacacacagggtttgccttattaacatcttacatacatgtaggatacaattattatagttaataaaccaatattgatacattcttattgactaatgttccttctttattacgatttctttagtttctaaagtttatttttttgttccaagatagctgatatgttttatacatttatattgcatttattcatctgtgcagtaatgtcatggagccatatcataaatgctatttctgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgctaatttcttttttccctcaactttattggtgtgtaattgacaaatgaaattatatatcttcaaggtatatatgtgatgatttgatatatgcatacattgtgaaatgattgccataatcaaattaattaatggatccatcaccacacatagttactattttgtgtgtgggggtgggggcgaggacacttcagatctattattttccctagtcactgctgtatattagatcctgagaacttcctcatcttataactgaaagtctgtggtacggatttctgagtgaaggtgaggtgtctatatatattaaaatgtatatgcatgtggtggccataaatatattacaacaatgtattaattagaaacacatatcttttggaatacatgtatacccatgttactttcgctgcaaatggctataatctttttcatcacatttcctgccatctctcatcattactttgctgctcacgtggacccatccactggtcaagcctcaaaattccatatcttcctttttttccagtgaccctctctgctgatccacttcattttccccccgacttgctgtcactttgctctacctcccaactttttctctggccacgaactcctatctcttctacttttctctctccttcttttacagatatggtcagttttaatttttctgtataaaggaaatccttattttaggaaatttagggcaatgcaatataaagaagataacaaaaatagttttcaatatcacaagctcctactctcctttccttttgatttttggcatggagagctagagtccttatggtttctcaccttcagtggggtaactctgctgcttggcgagttgtatcccattgatattgtccttggtgggtgtggcaaacctttttgctatccttctgtccactttttgatccacatctctgtggtcagctcatgaccttacttctctttttaatagggaggttagagtgtattaggtattaattcagataacttgctcttcctcttgcttctaattctttccttcttccctttgtcttgaagaagaggtgtctggtttacttagcaacctctgcaaatcagtttcagactgcgttccattttaccttctccaggactgtagtctattagctagtccatctctctcctgcatcttcagttttccatttcttgttgctcttatttaaaaagtatgtttctcttcactatttaaagattcctttctccttaaatacgattatgtctccctccttttaacactgaacttgaacaactgttttctagtgtctgtatttaatttcttaaattcattatatttttgtagctgtgagttctattcccactaatttactgtttttgtcaacattactgatcttctagttgtttaaattcagctcttattcctgctatggtatgtgatactggctgctatccctatgaaatcttttcctcttaagtttctgcaatacactgtctcctggttttctttctagctctttaaccgttctttttatctcctttttttctttccttccctccatttttccctccctccctccctctctttcttccttcctctcctcttggtccattttttccttaaatgttggtgatttttaccctttacttctccctctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctgaaacctttggccaaatatgttgtatatttgcaaataattcttttgaaattgtgagctatgtgagcattttcaattgatttaaaacttttaaatttgcagcatgaaagaaagttgtataaacagcttcatgctcaaggaaacaaatcactatagaatttatttttcctcctgtagtttcctttgtttaaaatattacaaaatggggtcctttatgcagtcaccttgggttgaattgtgtgagtcatagagcatatcaaggatgccgaaggcacctgtgtttttgacttcttattagttatggttcagtaagctaggtttaatttagtcaggtaaattaagtgatttggctgaattttcatttatcttctctccaaaagtaatggggatggattttttaaaaacataactctgtatatagtcttaatactgtggattacagtctaagggttatgtggagattctggctcctctaatttacagtttctatctaagtagcctcatgacctttggcctgattacattggtcttgtttttactattaagatttacatagccagttccctcttaagaatatagtttagctctcatttacctctttatatccagtatctttcacaccaatgccaagataatttaagaagcatctattttcatattgatacaaagaaggttaagcactctgtttgtaatagtcttatcaattaagtctagctacatgtaaattatatgtacctagtcttaatagataagtacaatagatatatgtacgattaatagatagatgtacaattacatgtaaaattgtaggaaacaatgacatgtattattttttcttgatatactgctatagtatagggcattttatatttaccacttttaagagctttggcattttcatagcttttacaggctctttcttgggttagttacatgaaaataacctgcagatactactgtaaaagtatagcctaggatgtttttaggtgaagagtgttttataatttagtagaagatgtaagatttgttatagtaaatgtttgtgaagactcacttgacaccatctaaacacttgacatgcttacaaatgatcccgagccattctatttgtagttgctgtaattaagagcaatatttcagattgagttattcatagcttcatgaaaataacgctttttgcaggcattttcaaatcaagtcagacaccgggttttctttcaaatagccagacgttccaaattatagttaaactagagttgtcttcttgtttgcaacatatatccaccacttatcctggggtttgtatttttagtgtagatggtgcttttgtatggggatatgatgttttatgatggcgcagtgcggagggcattcacatatggtcagggcaagcacttttagaactttatttacgtatctatctatatatatataaataataccttaaacattcaaaaagcatttgtagcagcttattgtaaagcacaagtatactaatacttcattttggcaaccgtggaagcaaagagagtagagttaggggcagaaagaagggtgaagttgtttatatttacatcgatagcagtttgcttttgcatcactgtgttaaatctgttggtcgcatctttgtctgatcctagaatgcagatccattttccttagggctctatcctactgggaaagatgaaagaggagacaagcgatctctactgaatgagaaagtgatgcatcagacctctgacttattagcgtcattattttgttttgttttgggatgctttcatccggttgtgacagtgaaagccagcttcttgattgctttgggtctatttgagactctcttcgttgctgatgatggtacctctcctgttttcttttgatgtatcaaaagaggtaaaattttgatacttagctttttcctgctaggatttagagatgattttaaagaagagggccctataaccaaa

SEQ ID NO: 16935 - DNA, 36618 bp, Human
tcttacaggtggagtgtggacacggtgatatccgtgtgaccgccattcccagctgaaggttatctcatctatgattttcttatacgtgactggcgccccctagtgaatagggacttaagttgacctccacggtagaagaaataccagggaaatacctgaagctgttttaacaatttctccttgtattaagtattatgctgcagttttgcgtgtgtgaatggaagtatgggtagagatctgttctccctaaaaactccaggattccacaatatagaaatagtaatcaaatttttaggtgaagctcgaactaatccgaactttgttagatcatcactgtaaatgaatgggtatttatccactccctaaatgaagagacttgactggatttcttttttttatatagctactagaatctgttacacataatttaggattgagacttgagaaattgtcattccaatccagaaaactttagatttgcaaatatatttgacaaattaataaattaacattttatttggttaatttcaagaatagggcatttaaagaagtctgtgtttgctttagttcggcaataaagttcctgccactcacaataatccttattattctctgaaagacatgttatatttttgtcatcataaatatttattaattactgtttatagcactgggttaggtactcatcaagcaaccaaaaataattcttaccatctaggatgcttccaatataaaatatagacaatatataaccaggtcaattgggaaatagatcatttcagtatgataaaagatagtattcacattaacagtgtgaaagggcaggaacaataagacacttgactcactggtctttaaaatgtagcatccaaaatgagcaagtggagaaaaggttaaacaagtaggtgacacatttaaaaaacaagtagatgaaaggactattctcaaaaatcttgttttatgtgagaaaccatcaaattatgaattccaagtactgtattttttttacttttcaagggtaggctctcctataccttatctaaacaatttttcaaaatagccacaattactttgttttcctctctacactaaattgccctttgcctcttgagcgattatctttttcagattcacctcaacttcttcaggttcaagcggacttcacctgtaagcccctctcggttctccctcttctctgaactactaatggcctaatttagcacaattatattgctttgttcattccatgtatagtaaaagagtctacaaaacacatgcaagcattcatgcaattatatgttgatttgttcatgggtcgaccccaaagtctattctccatcgctgaagcatggaagacaaatacccttcacttcttcagaggcataacacatgcacttctcttgtcatggtgacaggcatgtgctggtggaggtcaaagaaacaggaacacaagtgaaatcgaggtgagtgtcaggtaaggaccaaagcaccacgcctacctcatctttgcccacagaacacccattcttcccgtgtcctgtttcccaggacgtatccggggcggataagaaatcacccgtggggaggcggtgaactcctccgcaggggccgatgcccgggacaggggcggggaaggctaatgaggcgacttgtgcggggaggggccaaggaggagcccaggtgtcccgctcccgctcgacggcgcgcgcctgcgcgagcccagttggcgtcgcacccttgagcgcagcatccctacgccagcgagtcccaatactagggagggagggagggaggaggggcggccggccccccgcccccgcgcgcggccacgtgacgccggctgaggagattggaggggcggctgcgcgaggctgcagactggtgcagcgcactgtgctggcggctgggcctcctccacctcctcgtctttctcccgggaaccttgacgacgccttccgcttggccctgccttctgccgcatccccgccgccgcggcgccttgaggagcaggagaagacgcagccgggccgccgccgttagaggggttcccggccgccgctcgccccgtcggccgccaccgcctccggggtcagccctctctctgggtctccgctttctcctgccgccagcgcccgctcatcgccgcgatggggctcctggactcggagccgggtagtgtcctaaacgtagtgtccacggcactcaacgacacggtagagttctaccgctggacctggtccatcgcaggtaaagccgctgacttccccatcctcgctcggtcccccgcggggggtcaccggcccctggtctcgcagctcccgggcccggccccacaggcccccgcgccctgcggctttcggatgctgcggatcagcggaggggccggcgcgggcactgcggttgagcactggttaatctgatccgaatgttaaggcctcccctcccccgacactcgcagggttttcttctgagctccctccatctctcatcagctctcggatgcgggagctgacatatcagatggagcctgtgcagccaggagctcctcgcaggagccgccccaccctgtgctcccacatctcccgagctcgcctccctcttccccgtgcacaggattccttttaacatttagtcctattttgtatggagagcgggctggggaggaaggagggcttcaggggcagctgaaggtacaggaggtttcttcagcctcctggtcgctttgacagaaccctgctaatcttttcttctatctagctccttcatctatagtataattcggactgaaaagtaaaataatattgtttggctccttgaaccttgaagaatgttagtttccgaggcattttcaacagcaaatatgtttgaagtgattgtctataatggctttgcgcactgcagtgcagtcagggggagggggaggccaaaacaccggggaagaaatcagtctttaggaagggggtctctacagcaacacctagaggttgtcccagatgcctacatatatacagttcttaaatcagcaaacttttctttagctgttgcagttaatttggcagggctgtcaattgtttgatttatgcagctttcctagcgtccaactgtgatattatatttttacattgtactgtttatttcttcatttgcttcgctgcttttgattttaaagcatttaaaagtctttgaaatctaaaataaggtttaaaggatttcagaaatgattttacgaggtcaatttttctggtccttttgcagtatcacactgcatcctatcagtgaaggatattaacgttccatcttatgactctgccttccctacttcgaaatgaaaatgtactcctgtagtttttgtgttcattgttgttagaggaaattagacagtggttacagcatgaatgtagtccgatacatagggcttatgttttgggaaaaacgtatgctggaattatttttgtgagagacaaaatgattatttggcattaatactgcattcacttctttagaaaagtatgttctttttcagaagatctcaactttgacactgggaaataagctatttaataagccattacagctgaaaatggttaaaaggcagttttcaatggagtgtttcttcagtttttttttttgtttctatgcgctattacactgatgttacactgtacctgcaaaaactgggaaagatgtgcccttcccttcacgtctgtgatttcggttctttaaacgttgcatcagggcttcccattacacaattgtatagagctgaacatcagacaagttctttagcaggtaattgcacttcgcacacctaggagtcagacactgttgagatactccagtctccatatagccagagccacacccaggagttctcggtcctgtcattcctatcctatcccggagctttcccatctcttgagtctcagaaggaaaaattgagggcaaaggtagaatacacctttctgtgatggtgaattccttcctgatgatgtttgtgtaaaagaaaccacacacacacaaatgaaacaggaaattttgtgcagttgccgcatgtgaaagcttgctactaggcttcgaagggcatataaaataatataatattgtgggccaagcctgagaagtgagagtagccttagaacacaagtgacctctcactagcaggccgaaggaaggtatttgcctatgctttgactatccacttacgaaacctgagactgcttccttgctttctgtaatgagctaccttatgtaggcagatggtatttcttaaccaacagagaggcttagtggatatagtctgttctgctgtactgctgtgtgaggaggagtatttttcaggtccaggccgaatagacctgaagtctgtggtgtcccatttacgtttactctccctcattctatgcccctcgtgttccttttttttttttttttttttttggactcattcactctgctctgattccacctctcagcataatttgatgaaaatctgggtgggggatatcaaaatagaaaagtagcttataagatgaggttaaacaaaagttggtgagtcaaatgtttggaaagaaggggaaacagaaatgggcgggatagaaagatggtcttgagaaatagtgatgagtgtggtgaaaggatgcaaattattgagggagagcaagaaatgaggtaggctccttgtccttggctgctctcattcctagtgctgtagttacatgcttctttcattcttttattaattcattaaatgccattttgtgctattatatcaaatggtgctttaaatatccaaacatatccaaagcaatgtctgaaaactgggcttttcagaggcacatatgtagcaaatacaaaatatggtccataataatgttaacaacaaaaatgttacttttactacagtattaacactttgtacattggaattgaaagtttgaaagagctatacttttagaaaaacaacaaaaataatttttatttctctgtatttgtagacattttgaacgaggaaattagcgttggtttatgttaaagtataggctggtgtaggactttatactagttgttagtattagagtaggtattccatgtcatcatgttagtttttttcttctattctttcacttcatgagtacatttaaattattaggattggagtcctaggctcaacgtatacatctaataaaagttgtatatacattttttaaactgatgaatctaaatattccccaatctatgaatacccaacttatctacattattcatttattcatgcttttaataaatgtttaatagcttttttgcatacctgacatttagcatataaacaccctagagagttagtaggatgcttacggtaaagccaggtgtctcctgtgaggccatgtatcttctgaccatttgtttctaaatagctgttgttcacagggtatgggtgctgtctgttggttgggggtggtaatgattggcattggccctcttttcgcagatacagtaccccgcattttggtgaaaaaaattgtctacttggtagttgcagttagaacataacttgctgggtccttgaattaactttggaggggtcagaaagaagggatgagtggtacaggaagagggaggagagctgtaggatgacgaaatgtggaagccaggcttatgataccatttctttccgtatttacttgccatgtacaggcacagttctaggctctggaaaggaaaggaggacacttggtcactgccctcatgcatcttgcaaagtctagggggtcactgtcattcccctttccttgatatcatggtctggaggcagtgtgatctgtcagactcaggactagctggggcctagggaagatcagaaaagtccttccctgctcttctcatctctacttctcctaagtgaaaggaatatacagttgtttttagaatattttagctgtttcaccacagtttacttccctctacccttgaatgaggagttgatgtgagtactgtcagagtatttggagaggcatactagggcaaaaggtgtcaaaggcaaggggaacagcttgactgaaaaccatggaaactgggaaggtgcttaagggtcaggccagtgagtcatccaggtttgatgaagctgggggctagtgggaggggatgtttaactcagctcaaataagctgaagtaaaagcaggtttgtcttagggattgctaggtcccagaggagcatgtattttaagtattgtacagtatgcttacattaattttattattcgtcacagttaatgtttagtttttcatctatgttattatctaaaataggtttatttgtttggctaagcctggtaatgcagttttctttgaatgtttctttgagaaaagacattctgattccaagttgtaggcagctaattaaaaaaaaaaaagaaagaaagaaacatcaccagctcctaacatgggatctcccttggtcactgttttcagtgacgtcctaattatcctttactcataagctccttgaagcctctgggatgtccatgccattttatggttttttgttttggtttggtttttattgtcttttccttcaccacagtttgatttttggtggtagactgctagactttaatagctaatgctcttatccattccccaatgatagcataaagtaaaacatcctattgcagatggaattccaggagggtaaacaatgcaggttctaaaacgggtgtcaggacacagttttaactattttaacttagattctttggcttaggaagacaaagttttaagaattatgcagataattatatcagatggcacttttgtaaacttaagagccacagagcacttggtcatcctttaaaaattcaatttgttttcttatttttttgctcaagtcctgtggataatgtcacctgtaaatgatttaacattattaacgtaagtattttcatttgttaagccacttattattctgaattaggcatatattagcacaccgaaatgagtagtgtaacagtctatcttttttcactttagatgtttttttcgtcttcattatcaggacattttgcctgttaacaaacgaaggtactattgttttattttctattagaatatatattttaaaatcatgtgggtttggatttcagaaaggagatgggaggaaacacatggccttttaaagccaaggtccacattaactttctcgcttgatccttcagtattcccctgcccaaagacctgcagctctagccaactgggataactcactgacccttaagtaaaatgtgtacatgtccacctttatgtttctcatcccaccattccccttgcctttacccaccttttccctgtttacctctccagataccttttaccagaacccagtacaatagtcctcctttgcaaagcctttcttgtttatggtaccctggagcaagttgttgtctcacaggagctcattgtctttagtaattactcacgtatttcctgtgccattccttctatgaccctagtgtcaaactgtttaaactttcgttattatttaccacttcactcctttgtatctttctctccaacatcagagattatcacatatatttgttgatatgatatgtatcaggagatgaccctcttaatctagcataattttgaatcatgatatattgtggttgctaaacatgaataaggctttagaccacactaaattacagaaggtttttgtttttgtttttcatagagtggggatttcaccatgttgccctggctgctcttaaactcctggtgtcatgtgatctgcccacctcagccccacaaagtgctgggattacaggcacgacccactgtgcccggccagagagttctttaaaagaatgatattttttatgagttggtcattaattcagttgccgttcactaaatttaatgagtaaatcaggccattaagtcatttagaagcacaaaacagataaaaaatgaagattccaagacatataaaatcagatatgattgttctcttcattgtctgtgcagaagcattgccttgtgtggaagtgaggagggcagtgtggtatagtgaatgggaagaattctggactgggatttagatgacctaggttttagtcctggtctgctgctgatttgctatgagagtttggacaagttcctttgccttcccaattctcagcattgttctctgtaaattaagagggttaaattaggtaatctgtaaggtcctacctgactctaaaagtctagatatagatatcactttctttattcttggaataggtaaagcaatttcaaataaatatacatttatcagggattcagaaacctcattctttatagtaaataaaatttttttccagcaaaactgttatcaacactgcctaaatagtacaaataacagattcttatttagttctttttactttttaaaatttgctttataagaaataggtagaggaatagagcaacaaaagtatacagatatttaagcgtctgttttgaaataacattgcttttgttgctgtaacactatacctgtttaattatctggattccttgaataaccaagagccaactattttatcgaaaacagtagcaataatattaaagaataaaattatctcaattatatattacatttattttgtgatactcagcttttgaggatggcatattatgtcgttttaggcaagttattcatgactctttgggtctcttatttctacctgcgctgtgagagggttgaactacataacctttaaggcttagtttattgaatccttataacatctcctaaaacagcagcctagatatcagtctaaactcagtcttcatatttttccaatagaaaatgtgaaattttaacatacatcattacaaatgattttctattataaacactttatatatgagcattttttacttaagtttggaagtatggcttaagatttttgtaaaattgataaaaatgtgtaggtcttacagaagagaaaacaaaagaaactaaatggttttggtataagtatgttccttaactaatcaaaatacaaatttttaaaatcttttgccatatatttttcttcatgaaatattaccatttgtaaacaaataccttagaatgatgttttatttatgattatattgtattagagtaaaatttttggaatttgaaagacaaatgcattagtccactgaggaaatcagttactcactgtcaggtataatcacataaaagcatttgtgattttgaactgcagaattccaagaaacaagcttttctgttttcatttttattcacttatcaaacaaaaacttgagcacagatgtgtgtttttaactaattttatatattttttcacacacgtacatagcagcattattcacagtagttaagaggtggaaacgacccagatgtccaatgttggataaatggataaacgcaacgtggtatatacatacaatggaatattattcagtcttaaaaaggaaagaaattctgacatgtgctacaacatagatgaaccttgttactaagtgaaatagtctagtcacaaaaagataattatgtatgtggcattatggttccacttatatggaccctctactgtagtcaaattcgggctgggcccagtggctcatgcctataatgctagcactttgggaggtggaggctcaaggatcacttgagcccaggagttcaagaccaacatgggcaacaaaaaaatattaaaaattagccaggcctggtgccatatgcctctagtctcagctattgagaaggctgagggagaaggatcacttgaacctgggaggtgaaggcttcagtgaaccataattgtgccactgcactccagcctgggtgacagagtaagatcctggcccaataaataaataaataaataaataaataaataaataaagtagtcaaattaatagaaacagaaagtagaaagatgtttgctagggcctggggagaaggagaactgatgacttgtttaataggtatagagtttcagtttttcaagatagaaaagttccagagagtcacaacaatgtggatatgcttaatgatactggactgtacacttaaaaatgattaagatggtatattttatgttatgtgcttttctttttaccgcaatgcaagaatttcatatattataaaattaatacattagcacctgtagaaatgatctctttagtgctcaatggtaaaacagtcaattcttctttattttttcaatttaaagtaaaatgactttataaagagactatatagctgttggcttaaaaaaaatccgagtggctagaaagtagcaaataacaagaaagaaaactttagctttgtattttgctttatggttttacaaacaacttcacaataactctgggagataggccttgaaggcattttttccatatatttagaagtctttgagatttacagaagttatgtaacttttgtaggtggtcactatagtgcaaatgaatgtgcatgggttgttttgtccctagcccagtgctcttgtcttcccgtcacactagccaagcaagaaagaaataatcaggcctgtaatctgtgtttctcttttattttaccttttcttttattgttatctacagagtatcactgtttagaatactaaatctgaacaaagtcataatattaccaaagatcatctaaagaaagacatctaaatattcaaaggtgctataaaggctggtgtatgagattaaactacaaagtgatatttattcatatactatatacatacacaaatatgtgaatatatgtagaatacaaaatgcgatatttagcctgagaagatggttaacttccatatgacggtgtaggattgtttaaaaaaagtgtattcaaagtgaattatgaaagtatttgccaaattgcataatacaagagctagaaacttgttagtgaaaggataatgaaattcattcaggactaaccgtattttacccagtggctattcaacttatagaactgttagagtcaagggaagattttggctaaagttcccattaactcacacactcacacactctaatggtatcttccatcttttttgctaaagggaaacaccatttcaattttcttaaagctttgagttcattggcagcattgggtggatggttgaacttggaactcccagattaagttttatgactactttttctgagaagcccagcaaaattggaaacaaggagagaaggaaactacttgtattctgatcttggcttccaggaaacgaggcaacattcttcagctctctctctcgagatatattttctcccttgaaattgtctccttttcccttatgaactggcttttatgaataggccattttctgaagtcatgaatttggacatcacctgcacttgggcatggtggctcacgcctgtaatcccagcactttgggaggccgaggcgggtggatcattgaggtcaggaatttgaaaccagatatcgtctgcacatgatgaaactcactaccatttattgagcatttagtataggaccattttaagatgctgtagtactgtatttgatacaccttatatttaattttcagatcatctctataagttagatattatttaaccatctatagatgaagaaatagactcaaagctacatagctagaaagtaacagagttggaataggatcaagatctttctccttcccaacagtgacctttttataatgcaacatagcctacttatttattcaataaataccattttattgcccagtaataatagtgaacatttattggatgcttactaagtgtcaggcactgtgtccagtgttttatatgtattatcacatttagtcctcatattccattgggctcggtaccgttattatccccattttccaggtgagtaaactgactttccctgaacctgattcatctaatactaaccctgtcaaattaaatcccagggtaaccagccttcagctcgaatcacacattgattctctcatctgtgttaactgtcttttctcctttacagcttctgaatctgttcttattttttgcttgctctaggaaattttataatttctctcactttctaccattattatgatctctattcaggcaaacttgcaatgaaaattctttttccctctgctttttaactctgtcctccattctttcaggctcttgggtaactgttatagaactgagttagaggagacatcttgttttaaccctgtgctgaatgactctcagggcacctgctccctcataccttgagacattgcagctttcccctctttcactggtgaaggtctctgttccctcctgtctgcccatcacattctgacttctttgccattttttagcccagcctctgccttatctacccctgcattctgcaaaagctaccctttcctcccattcatccaggtgctcttccaaactcaaaccttccatcctcttttttgagtacataggggttagaacagaaattttccctgctaatcatgctgactatacaggaaactgatcatgctattcttcacccaccaccttcaggatctgtttgtttctagagtgtgtctcagattgttcattacctgcctcatttgtccagttgtatttgaagggcccttctcttctagttctgcctttttcacctcactgatagacatggcttgaggaatatattaagcatcacattttagatttgaacctaggagaggcctttaagatgtatagagtttactccgtttgttagaaataagctctttcccagactcttcttgacaaccgttgtctacagttttcattgaaaatttcttttaacaaatgttttgaagactcttacatacctgacattgttaacagagatacagcaaggaacaagggctgtagcattggccctcgtgacatttataagaaatggaggaagacattgactatttccttaagaaaaagactacagttaccctttggggtacttgcagtgtacagtgtgacatactaataggtaacctttttgtgtaatcagtaaaggcaaatggatttttaatatcacttagtatattagtggtgatcagtagccagatgtttaaaaaaaaggaattaatttgcaactgttggttttaacaaattaaaggatggatagttttagggaatagtatagtacagacttcttggtgtcttgaatatactcctgaagctgctcaatatttagcgattgttagacttgtgttcttctttttttatggtagattaaacaaatgtagatggttttagaagatgaggaagtggctgatttattcggatagaatctaggaagaaatcaagtcaactttattttgtgacttaattgcctgttaaagtaggctcacatttctgagtagaccagagcagtgctccttagactttaatgtgtaaagtcactgtggaatcttattaaaatgcagattctgatttagtagttctggggtgaggcctgagattctgcatttcttgtaaggttccaggtgatgcttttctgctggtgcatggactctactttgaataacaagggaatggagtattcctaatttgttttgcaatctactgctgtgtactgttatggaaaaagaagaagttttaaacatgcttaagttattaatgtaaaaatcaaatgctagatgtatttagatttaattattttttatcctaacaggaattttgtgtgtcttctggaaccgtattatattgatcagtaactgttgctcattttacctgaatcaaaagggccaatgatttggttaatcttattatcaccttcactttacacatgcgaaaatagtggctctgagtttcaggttcatcatcatggggctagaaaataaatgacagagctagaatttaggtttttaattcaagtcttgtccctctccctgtatcaagctgcctctactccatgtgactccccttgccatcatctaagatgatttcctactgtattcttgtataccttttctttagttcttctaggggtttgggtgttctaaaatttttttaattactgttttttcttttgggagattatagtaaaactttattagcttagcttacttggggaagatagttcattctgactggtggagatcctgatttgcaaaaagctttaaaagaaatcagaaaaaaaattggtctattagaggtttttaaggaagttgctttaataaacatactgataatttgttgtaagtattaattatagttgtttgtatattaagtagaagttacctgggttagttgaaaactattagattacaggcattttattatttattaaaatctggtttatattgtcatgaaaaggagtttttaaaaatagcctctctaaataattttaaaaatcagagtgagaatttttatgtattttatctcctgaataaataaatacagaattataaaatgtcttctcagtctatgtcataaaatgtttttttattctcagtgtaaactcttctaagtttaattattcatggtaatttttatttaatttggtttaacttttctctttgaagatagaggaggatttagtggttgatcagtgtcaataataatgaaatgccaaaaattattgaactctgacactgtgtcagatgctgtatacatgttgttctattcctcacaacagccctactatcatctataaggccaggggcactaagtaacttcttgggtttattcagctggtaagtgaagagtctaatgctggtaagtctgatttgagagtccatattcagaatatagaactctctaggttgagaagaaaaatcctggaagacattgaggggcttgacttttaaggggaggggctcagattatctctgacatgagacatactttgtgaagatgtaaatttgggagagaataggctgcagcagaagggaatgcatgacgtcgtggtatccatgtgtgctaggaaccttcgcatactttggttcatttagttatcacatcttaaccctatgaagtaactatttcctcattaaaaaaagaaaaaggaagaacagttggttttccagctatagattctgttctgcaccctttccttttggaaatttctcggtctttgtgacatggttttctcttttcctgcctctctggcttatttgctgccatttcacccactcatcttcaactgtcctcagagtcattcctttttcatgttattctctcactgtacatgctccttcccttgtgacctcaaactctggtgtgattgtcattgtcagtgacccctctgtgtgtccacagccctggcagttcctctgcagctccagaggctactggacgcctccacctagctgtcccaaaagtagctcagatgcgagatgttcaacattcacctgatcagtttctcccagatctgctcctcttcctttactctgttatggatcatgacttcactgtctgtgttgccagatagaccagaaatctgggagtaatcctgaacttttctttgactctcttctctcacatccacaacagtcgtggagtctgtagattttacccacgaaaccttcgtatctacctatcctgttcattgccagcgcagctccctaacccaggtttccatcatctcttatgtcctagtggtctccaagtctgcctgcctgtcagaatcacctgggggagctcagatcatagtgtccagtcccacccgcagagattttgattcagtaggacctgggaatctataattttagcaagcacatgattcttacatgggtagtctagtggtagacaagtattgagaaccactgatgcagttggttttcctgcctcttgacatatccccttcccctcagtccacaccccactgcctctaccatgatcttttgaaagccaaaactggctgggtgtggtggctcatgactgtaatcccagcactttgggaggctgaggtaggtgggttgcttgagctcaggggttcagggccagcctgagcaacatggcgaatcctcgtctctacaaaaaacacaaaaattagctgggtgttgtggcatgcacctgtagtccaagctacttgggtggctgaggcacgaaaatcgcttacgccctggaggtggaggctgcagtgagctgagatcatgccactgcattctagtctgggcaacagagccagacccagtcccaaaacaaacaaacaaacaaacaaacaaaaacaatcaaatatctcttcattatctacatgataaattccagcatcctcagtgtagtttgtaagacctcctaggggatcatcacagtcatttcctgccctcttcctttgtatatatcctcttcatcatgtctgcttagtttccagattgttttatttcttgcttctgggctgcttatacattcagttctctcagggtattcagatattctcatttgcttatatcttgtcattgtactaagggaacttttgtaggtctttctaattctgccccctgaaaaaagacttttctccctgtctgcttgtcaaattcctcttctttgaaaaaaagttcaaatgtctgtgtttataccctgccttctccccttttctgtcctaccactgttcataagacactcctctgacataacactcatcacactgcatagcagttgaattctcatgtctgtctcttcctctgctagttgagcattgagagatcagggaccaagtgatctggccaaaatcactttgctgcaaaggagtagtatatgactttggagtatatgacttaccatctattccaccatgctatgtgatcttaagataaaaatcagattaagaataaaaacttattggtggaagatattcaagggaaaccccatttcaggtggactctatttttttttttttgagaaggagtctctctctctctctctgtcacccaggctggagtgcagtgcgtgattccagttcactccaacctccacctcccggattcaagcaattctcctgcctcagcctcccgagtagctgggattacaggcgcacaccaccacgcccagctaaattttttttgtatttttagtagagacagggtttcaccatgttggccaggctggtcttgaactcctgacctcaagtgattcgcctgcctcggcctcccaaagtgctgggattacaggcgtgagccactgcacccggccccctcattttttataaaggaataatacgcaaatagtaaaattgactccttttagtgaacagtttttgaattttgacaaacacatagttacataattattacgtaaccttttaataaagataaaattgtatgattgctgaacacattaaatcagtccctcttggcataagctttaaaaatcagtctcaaaatattttcattacaaactatttattaactctttaagggtccgcaagggttaaggtgtaatgtgccttagtaattctcataattaaaataaaggcttttgctcctgagctcaatttgctatgatatttggctttaggtttgcttaaattttgttcaaaactatcatgggaaacccattaccaaaggagacaactccttctgtgtacaaaagggaaagacccactggttagaaatttcctgaattcaggtgaaatttactttcctataacttctgttggttctaattcctctctctgaaaatggagattaaatctgatttctcataagttctcttagtatttgctgaggcctctttctcttttccaggctttagtctttagtctttttcccttattctgtgtcatggctttgaagcattcatgatcctggcccaagtctgccagatgctgcacctaatgaagtataagacttggctcctttgagtaactcttgtcattctttctattgagggaacttttaaaagtctgtcttattttctttcccttgaaagaatagtcttaaaatatagcatttgtatctataattcagaaaaaaatcgatgggaaattctctcccttaagattaaagtacatggtgattgagtagtgcctacaacagctgctaggttacatgaggctcttgctttacgtgcagtggcaagtctcttgacctctctgaatctcatttttaagataaagggatcatttctaaatctaaaattttatgattctagtttaggtaaaggtttacatgacaacgtgaaaggcttaaaatggttaataggctcaaaataagagcaaatttattaacacatgaaggtacaaacatgttaataagcatattaatagtataaaatataaaaataatttgataaacaaatttgataatttgataaatttgacgagtccatttatatttgtgtcattttttccccctccaccccaccaaaactttctaaagagaaattcccaagaatgctacataaaacatatttggatctttgtactatttggcgacagggtttgacttcagttggtggtaggagaggtaggattttagtcgaagtttttcagtcttttttcttaatgaattaatgacatggaatcccactgataactgtgtaggattaggatgttgacaacataatagaaatgtatctcctgtcacactaatatgtataatctacatttggattcaatacatagcccaaatgagaggatttaatttagctgtaaaatattaatatatatttttaaacattcgagttaatgaaaatatggataatttaatatatttaaagtttacataaaatacatgaagcattagtattcatgattttcctttactgttttagccccccaacctttttttggtttaaaactcaggtggaactgttagtaatgatgaattttcatatcgttgtatggcactattgtgacacagccctttttagtggaaaaggaaacatatgaaagaaatatagaatatttgcatctcatcagaagcactaaaggaaatattaatgcaaatacatgcagaaaaacaaacataactagtatagtattataacatgtaaagacatggaggaatttcatccaaatattattaaaaggttgggaattgttatgctgtggattaggggttgacagttactgtagcttccatgataatcctgggaggctgaatttttgaaagctctctgaccctgctgaactagaagggctaatttgagaagggtatggtgtaaaatgtggccttttataggctgaaaacagggatttgttaagtggttgttgaatgaatgcatgccttgcattgttgggcaaagaagtgagggcattgcttttttcccctggagtaaggaatgaagtaaaaggtcattgagctttgtagagcacatatattcactaaatactaggttgatgagttgttgacttgaggataaagttattatgccaacatagaggaggatctgggaaaagctctaggaagggttcttggacactgaggaaaccttgaatatcaacaaatgtgcttttggatttggcagaaaggatagagaatagaggaatagtgtgaaaaaattatctactctttatttattcatcaaatatatttttaggtactttgataggccttgcaatacaagaatgaaacacccagcccctcttttcagggagaaaacagtttaaaagaaggtcactggacagtgtaatgagtgctgtaatggaatagtaacatgtgcaggtgctctggtcatgcaaaatgcgtcccctgaccagttaaaattttcttgatccagttttcctcaccattagtctattcttcctcctaataattatttttaaaagtaacaattttcagaagttaaaataaacctaaatgatcatgtagtttgttactgctcaaaaggggatggtccatggaataatggcatagcatcagttagagcttcctggaaaatgtggtcttcttagaaatgggctgcatgggctgggcatggtggctcacgcctgtaatcctaacactttgggaggccaaggtggatggattgcttgagtttaggagtttgagaccagcctaggcagcatgacaaaatcctgtctctacaaaaaatacaaaaagtaatagggtgtgttggcgtgtgcctgtaggaccagctacttgggagtctgaggtgggaggatggcttgagctcaggaggctgagcctgcagtggacggagatcgtgctactttactccagcctaggtgacacaacgagactctgtctcaaaaaagaaaaaagaaaagaaaagaaatgggctgcatatctgacccactgtctcaaaatctgcatttttaccatgcccacccgcccccctccccaacctggtgattcgttttctcattgaaactggagaagcactaatctggttcacctacttcccatccagttttacagatggaggaaatgaagatagattgtgctcctaaggtcctatgcacagtagcagagccagtgttagaactcagccagtcagctggtcatggtggcttcttactagtgcctctttccttctctcttttggaaattctctgttgaatgagagaacaacagtgcaccacactatatataaaaaagaatgaacatttttatttacttataatttgtggcatcagcaactcaggaggctgaggcaggtggatcacttgagccctggaggtggaggctgcagtgagccatgtgtgcaccactgccctctagtctggacaatagaatgagactccatttcttaaaaaaaaaaaaaaaaaaaaaaaaaaaacccagtcaccagtctacttactggtagggtcttgtgtgctttctctgatgcctctgttatttcctgtttctctttacttttttactcttctattggcctctattagtgtttcatattgtaagatcttcagcttctcactagtgtctctttccctctctcctgtggtagtcctctctttaaatttctctgttgaatgaaaacgatacagcataccacactgtacatcaaaaagaatgagcacttttacttactcttaatttctggcagaggtttggacctatttctttaattttttttttctacccgctactcagaactttctttgaagtcagtaggaattctgtgtgtggtaagggtgagagataatctatgatgttaggaattaaaatctcctcacagatacatttatcttcctttctttgttacatggagtatggcattaatcagagtacttttgctctttgtataagtctcatgggaaaaacagcgcctgccttaaagttggtggaaaagaacaggataccacagcaactccttctctgtgacctagaacagagagtttgtctaaatgtttcttctctaatatagggggtttgtctaaatctttttttttctataatatagaaaaagaaatacctaagtagatgcacacctcatgttttatagggggcctttagcatagaaagatatggtcatagaatgataatgaacataaaatgataaaatgccattaagaaaagtgaacagtcactgataagaccttcgtggcacaacgcctttttaacaaaagtcagccgtgctatcttttaagtcatttcctccttgtgagaagtttaccatctctcctgtggttcaaatatattggtttatttttaactctgaaatgtgtttgatttgagtgatatagccataatctctatgaatagtagacctccttttaaaactatgaaataaaatcagtttttctgttttcctggttcccatatgtgtttttctttcaagtcattatcacctttttttcccatatctcgagtcatcaagcaatagctcaccttcttaacaactctgatttcattaaaaccatagttgtgtcatttcctgactttgcaaattgtttgattaaatattgtgtttcgtatcttgtatcttactgtctattgacagtatatagacacagattaattttttaagtaaggtattttaatacctagttcactaatccagaagcattttgcatatacaggctttagtaaaaatgacagtttaaatagggagttattatgatcaacaattaagttaaattcatttaggttggttctaagaagttgaattttcttttactactttaaaaatacattatttcttcaaaatacgacataaaatgttttgcattgccaagaataaactagaaattagatttgcaaccttcaactgttgtttagcttttagaaatataaaaattaatattaatatatttttataatgtgttaaaagatgaatttttgttaatcccatccatatttcattatcatgcttgtttcagaaatgttttacttgtggcaacattccattataaaattgatttatggttgtgtatttgaatatgctggacaatcaattcattttaagtaaaataatgtgttgcattttatatatatagttacacatatgtaagttatgcgatttacagctctagagaaaaacattcaagttagttattcatgggaataaaataggtgcatgttctcaatgaaaaagttagaaaaatgtcttgaatatggtgactgtttacattatagaattgtaattaaccctaacttaatctctcagtgcccctgtactcttgtcttcagtgtctcgagatatttcagcaaatggctaccatcgccccgtacgtacctctccagttacattcttgcctgctttaggagtggacacacagagcagcctccaagctgccctgataaatttcacgtgtataatatggaagacaaatgtttccttaacatatttattttctgtgtatgaagtttttcattaacttttcatcccaagataaccacctctgtttttagtgcgctttatttcttgtttttgttctgtagggtctctgtaaaacataatgtgtgacataagtaatgaagcataattttcaaaagccacttgcaggagtcagtattgtttctttggtttttataccatgtattttttgttgggactcaaaggacagtgatccgtatttagtcaaattaggaaattaagttgaaacatcttgattcctaaaaagtgtattttataaaacatttactgattaatgaattttatggtattttgttctctctatagataagcgtgtggaaaattggcctctgatgcagtctccttggcctacactaagtataagcactctttatctcctgtttgtgtggctgggtccaaaatggatgaaggaccgagaaccttttcagatgcgtctagtgctcattatctataattttgggatggttttgcttaacctctttatcttcagagaggtatgtttttaagatcactttaataattttccaaggttattggaaatttaaaaatgagaatgtgtaaaaccatcattgtaatattttacccagacataactgttagctactctaaaagtacatttttgacatttttcacttttgaataacaaaaatattaaacatgaggtataggaaagttgtttaaagtggaattttgaataagaccaactggattctaaagtaacccttattagctgttctggcattgaaagttatttaacttttcttagcctcgttttccccacttaaatacctaccatctcaggttattatcggagtaaagtaagataatttttgcatagtgtttggcacgtattaagcactcagtaaacagtagcagctatttatttataattcttattcagtagtttctggtttggtaactgatcaaaatatgccaatttcaagtaaatcctattacataatgttgtattttgggctggaattaaaatgaattaactgccatatagctgttgttactaatcattatatacttttctgggcactagcaaattctccacaacattttcaaaggaaatcctaaaggctagattgacacagccattttttaaattgcatatgtataaagaatttgtttcctaagagactcattaaaattctgtatgaagccagagaactgactagtaatgctaggaaaataaacaataactcttcttagaaaaagaaatatttctttacttgaaaacttagcctcgagtctcaacttcatgaacactttaatttatttggatacctgtacctaatttgttagatgcaaaccactctggatcaaacatagaaaccagttaaggtaggacaactttgaaatctgagtcctagcaataaaaatttctcttaatactgtgaagtatttaatagatagagtcaatgttcagtataaaatttacatgtgatttttaatttagattttaattatagaacaaattaatgcacagtaacttctagcaatcggaatgcatgaaatttttaatgcatttgaaatttttaaagaaaatattgcgtttaaaataatttgaaaggctacattttgtatataattgtgtttttaatgctgtgtttactaaaactttactacaaatattattactctttttccagttattcatgggatcatataatgcgggatatagctatatttgccagagtgtggattattctaataatgttcatgaagtcagggtaagtacattaaaaatactcttaatcagtaaaagtggtttgatttttataggccccagtctgtgaaaatatagaatgtacttttttttaagagacagtttctttaacattcatttagagacagtttcttgctctgtcccccagactgaagtgcagtggtatgatcatagctcactgcagcctcaaactcctgggctcaattgatccttctgcctcagcctcccaagtagctgggactacgggtgtaccccaccatgcctagatatttttttactttttgtagagacagggtcttgctatgttgcccagtctggtcttgaactcccagccgcaagggatcctcttgcctcagcctcccaaagtgctgagattacaggtgtgagccaccacacctggcaaaatgtactttaatatgatagtgaaattatactagattgttatgagtcagtaaaactatgcttttttaaaaagtacttaatttaaaatttgtttttgtatctcaaaaatgttttttattttgcagcatgagtgaatatgcattgaattactagaatgcagtacttgttaaagcaaagaagtctcatgtttattttaaagacattattttagatttttgtttgtttgtttttgctcaagagtagaaactcttagagtccaagttatgtgttaagaaagtgaggaaaagtaaatgttttgtgaagtgtggaatatttaggaaattaggcatagaacaatttgtattggcataaactcagtttttttatatttgcagaaaaataaaacactagtaacaagatgttatattttattttccattcacttacatgagtaaaattaacattaagcaaaagaaacaacagattaccttattctattacgtatttattgaactcttcttatatactgtggttcatactagaaattacatataaaacataacatgttttatgttacctatagtatatgtagtaataatatctagtggcttcccttgagaaaaatagtttcctggcatggggagtggacaatatataaatatcagtattcatcaagactggagacaaaattggtttaatgtacttaacaattttatgtacgtatcttcatttccctattagaagacttatggactgatgaaaaatcacctgtcttggttgtcatgttggttttatttattcattaaatatgtattgagcatctactatatgttggtactggggacaggggtgaaaagccctgcctttgtggggctggcattttagtgagggtgagaaggcagacagcagccatgtaaacaaatgactaaggaggaaataaaacctagaatgtgactgagagaaaatgagagactactcagatgtattggctatgaaaaattttcttctgataactattgccaaagaatctcttcagttggagggctgacttcttgcttgccgtagggaagggaacagggataagtgtttgactgactgacttctgggagtatgcatagaaaaacccttgggtggggcaacatattactatttttaggataaaggtttaaaaataccactctcacttacagatgtaaattttcaagtctttaaaaaatgagctattatgagaactgtaatctaggaggataaagaacctgagatttgcaacagatttcatttgaaatcttcctcgtgctctcttctcctctctaatatgggatgcaatagagtgaatattttacgcagagactcatttctgtattcattgttacgtagccaagaagtatcactttttggtgtagtttatttaaagatatctagtgcagtttgcaaactaagcagacttatttgttgttattttatgtgaattgtggcaaatgtagaggtccagatagaggagaaataagagattgtatctttccttctagttaaaggttacgatgccaaaatggtgacagttactttattttaaagaactaatataatagtgaatattaactatagtgttgctgggagtagttaactatttcaagcttattttcaaccaattcatatcatttttaatgatatttttcaagtaaattcagtaaataattctcagtttgtaaatactttgtttcttatatgctttctgtttcttctttccccatactttaaaattataattttgtttttcaaatgcaaaagccaaaacaaacaaaaatctcatgacatataccaggtgcaggtataaaatgcaaagggatccttcaactctaaaacacctaagcctgtctgtgaatgaatctgacagggccctaacacatgaaagcttataaatagattttagttatgtactgccttaattgttatttgcacataggatgcttatcatagaaaatacttgacataaaaaattaagtttggtttactgttacagtaggattcttgtaaaacattttaaaacatacagaggtcacctctcactggatccttaatctcagtatgtaatgtaatctttctgtaccatctggtgccttaattagagcccaggaaaagaaaagacttattcatgtaagcaggattatatttatgacctgggaaatatttgtttgttcattccaattttttattttaaagatttaatacctaatacaaactgctgtgattggatatttatgttgttgcacatattggtgcagtcggagaggtgagggagagagggaggtgaggggagagggtgggcagacaggcagacacttgtagagaccagttgctacatgaacttacttgcaagtttttctgaggtagtataatgtaggctaagcatgaacaactaaaatcattttacaaagtaaacatcttagttcctctaccaagttgaaaagcacagcagtctgaatgtgcttccagctctgtattcagcagtttgacactatgtaacatctacctatggaatagacagaaaatgttctctaacttattggcactgtatagatagagctttggactctttcttttctatttttccccatggagagatgcttaggtttttcaaacctacttagccattaatgattccatgccttgtacattttgtgcaatatacaaatgtttattttggacttacttacaatgagtataaacccatacaatagtgtcattttggtgtttataacacgctttccctttttacagatagctgctgctctgtggtggtactttgtatctaaaggagttgagtatttggacacagtgttttttattctgagaaagaaaaacaaccaagtttctttccttcatgtgtatcatcactgtacgatgtttaccttgtggtggattggaattaagtgggttgcaggaggacaaggtgagcattttcaggaatatactgcttgcgtttaattgcatatatgtgttcagtggaaagcaatgagaacctaggactttgacttgatctaccatttaacttgctttcatggttaatcatttccatgttcatttctttttttttttttttttttttttttttttgagatggagtctcgctctgtcaccaggctggagtgcagtggcgcgatctcggctcactgcaacctccacctcccgggttccagcgattctcctgcctcagcctcctgagtagctgggactacaggcacacaccaccacgcctagctaattttttgtatttttagtagagacagggtttcaccatgttggccaggatggtctcgatctcttgaccttgtgatccgcctgcctcggccttccaaagtgttgggattacaggcatgagccaccacacccagccatcatttcattttttaaaaaatttgaggcaagtataacttttgctttttatctgtgactactttaatacctaaagatttgccccagagatgagcataaaccaagactaaaggtagaaaacaatattttgatggggaacgggtctagtagttctgatccaaagaataccaagacacagcccctcaaatctgaagatttccatcttagcccatagctcactcctgccctaatacagattgaacatccctaatctaaacatctgaaatccaaatgctccaaaattcaaaactttttgagcaccagcatgataccacaggtggaaaattacacacctgacctcatgtgatgggtcacagtcaaaacacaagtgcagaacacactttattcagtatacctaagggaaaaaagaccctcttagcccttttccatgtacagcataatgttgatgccaaacaaccacagataatgtccacacgggtgacatctttgctttctgatgttcagagtacacaaactttgtttaatgcataaaattattttaaaattttataaaattaccttcaggatacatgtataaggtgtatatgaagttttggatttagacctgagtcctatccccaagacacatcattatgtctatgcaaatattccaaagtttaaaaaaatctgaaatcagaaacacatctggtcctgagcattttggataaggaatactcagcctgtataggtcttgttggttcttattcaaaggaaattttatatagccttgttaatgttaaagaggatctaaattcatagcttggccaagatctgcctcctgtcttttcagatgcctgtagattaaggatgattcacattgttgagcttgatgcagattattcctctgaggaggatccagggtacaagtcattatagtatagttcaccttgctgctttccattgtcatattatgataattggcagcttaggaattcatacatatattattgggggcccagtttaaaacaatacagttaaaggcaacttctgtaattttaaaagaaaattagtaaatctgaactgacttagatcactttatgacaaaaattaattattattacatctataccttgattaaattaatattctgaaaagaaagaatgtcattgagtttgactgactggaatatctctgtagatttatctatattaaatgaattattcaatgtgtgtagtgctgtcatattttaaactatttagaaacctaagaaataagtactgttttgttgcagatatatatattggcacatctaaaggcaagaatagtagaattaaaagtaacataggcaacagttctaagggcctatttaagctcactggagtactccatttgaaaacctacaactgtgaaagtcctttgcatttgaacatacatttttatttatatggtaaaacctcaaatctaaactttaaaaatatctagcttaatctgaagggaaaactttttcattagtactactttatatttttcatttctaatctgtactcaagattaaatattaaaaaataatgtgtattcatttattgtacatctcagtggcttactgcctaataaaattttctgtatcttgtaattacctgttgtttttctaaagcattttttggagcccagttgaattcctttatccatgtgattatgtactcatactatgggttaactgcatttggcccatggattcagaaatatctttggtggaaacgatacctgactatgttgcaactggtgagttaaatgcttccaaagtttcttctggtaaaatactgaaattgtttaaatttgattaattttaaagtgcaatgtcattttagacaattttctattatgaaattaactttatcctccagctatatcgcagttatgcccacttgactctagatgacctattcatagacttattggtcccagcaaatctttgtttttataatatgcttaaaagactagacatagcccttactcctctaaggaaaacattctctaaagatgtttgtggaaaggatgattaaagatctaagcacgctacaaagtacgtagatttatgtatgaatagaaaaataatatgtattttttccctacaggtgattttcttaacttaaaattttattacctctcttcatcttgtccttgcttaaaaattttgttttttatttcatttttcagtctttaacatatctcatatatttagactaaacagctgaaaagaaagcacatagccaaggaaggggtggggcaaaggaagggaataagggcaagagaactccttgtaattctctaaaacactgtccttaagagagcagagacagatattttcaaatggtggtctttagtccagacagttttcagcacatcccgctagtaagactgtttgtggcaatctgagtgtgtgcattagtgtacctttcagatgctaggcactagcctgtaatcaaactggaaattcaaagccaacctggtaactatttttcaagctttagaatttattataatttgctttaatcatagcatgtgcacaattttatcagtggaatcacatttggaaataatattcatctttgctttaagttgctaaacagctggctaaccaaacaggaagcacaacttttgggaaatgctgggtgcgaaggattcatttgtaaccggagtggtataggaagcttcctccagtttttgtgtaaaagctgttaacacagtttgtgtaattcatttctctcagtaagtagtaaatggacctaagaaaatgaagaggtgatcaaaatcatgtgaattagtcctatctggtttgttggagcctacacctggctctccttgagtgatgccatacccaatcacacccttatacacaccctttttggtgatgcagcttctaaaaaccattgtgaaaccacaagttcttcaaattaaaatatttgccaaggaaaattataaaagtttaatatagtataaatttttagcttacatggcatacattattttaatatttaaaataagtaatactgattattttaatcaataattaatattttaagaacaatgctatccttaaaagagaaaccacaattgtccatttcaaacaggatgttgagtttgtatttccaagccagaagttcccacaacagttagtcatataagttaattgtataaaaagttaacccttgttaacattatgtcttgacccattcttttattgatacatcagaatctatttcattttaatcatctcactttgggcttttttccttttaaaaattcttaaagttgaaagtgattctttttgtatttattctgaaatatctactaaattttatccaaatattatttttttctttttttgggacggagttttgctcttgttgcccaagttggagtgcaatggtgcagtctgggctcactgtaacttccgcctcctgggttcaagctattcttctgcttcagcctcctgagtagctgggattacagtcatggaccaccacacctggctaattttttgtatttttagtagaaatggggttttaccatgttggccaggctggtcttgaactcctgacctcagttgatccacccgcctcggcctcccagagtgctgggattgcaggcatgagccatcgcacctggccatcaaaatattagtttttaaaggatagtgttcgttcaaataaaaatttacctgcctactatctgtaagaaataaatgagccattttgataagctcattttaagtatgtgtatctgcttgctgacaatttgatagaaagaaaccaatgtaaaatgtgggaggaaaacaaaattgaagagcctacaatactattactttactctcctaggccattgattccctttcatcagataacattattcaacacatattcattgatcctgatgctgtgctgaggactcaagaatcaccgatgggcaagacaaagccctgccttctagagtcattttctagtggaaagataggcaataaagaaataacaaatacagaagacaatttcaaataggtataattctccttaaaaaaaatgcagaaagctctttggttaatgggattgggagggccaattgaaattgaagtcttgtcagagagtccttactgaggagatggcatttgagttgtgaatgaggagctagccatgggagccagaaaacaataaattttgcacagtgtggcaaaatttgggcctgtgatagctatgtagaagatgccgatgttgttaaaagttgtttactattcagattaaatgttttgtgctgtcatttctgtttttcagattcaattccatgtgaccattgggcacacggcactgtctctttacactgactgccccttccccaaatggatgcactgggctctaattgcctatgcaatcagcttcatatttctctttcttaacttctacattcggacatacaaagagcctaagaaaccaaaagctggaaaaacagccatgaatggtatttcagcaaatggtgtgagcaaatcagaaaaacaactcatgatagaaaatggaaaaaagcagaaaaatggaaaagcaaaaggagattaaattgaactgggccttaactgttgttgacagtgaggaaaaactcccatatcatataaaatttcagggaaaacagaagcaaaggagagcttgggggtggggagaaaagacaaatgtgctctatgtcctagtaactcttagactgagtaaagtgttaataccatacccagatgttttatttatgaagtttttattttaaacattttttttaaaaattagccttgatattctccagaccaaagcaatcattaagtgactttggggattctccccctgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatcaaggagtcttctaatgtaaattttaatgttaactttcaaatccactagtattttttttgcttttatgacaaatagcatacaccaaacatttctgtgaaactatccttctctttcaatgtgtttaattttggagtaacgttttccttgtgactaagttgcaagatcttatttattaactaggtatgaagtataaacccattttggtgcaatattcttgactccttggtgctaaagattgttaaattcaatgcttgatgttacaaggtgttgttaaaacacaaaatgaataaaagtgagagtagtcagaactataacattcaatttgctatttacaaatgaagtatttcatgtaatataagtgaacaactggaaataaagtaggaaagaatttgtatcatgttttactacataggttaattttttaagggatgttgcaaagggattactagagaaagacaaaatgtgaccaaaaaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgagaattacagaaaatttgcaacatataaagtagtttgatctaagaggattcaacacctttgttttgttgctcagtgtgtaatgactgagatttgtaaatctttgtgaacattctgtactggttcccaagagctattcattccctgctacctgatttcagcacaataaatatacttctgctgtgggaaaaatatgatttttttttgttaatcagtttattataatgtaaactgtctgctagatgtttatttgatttagttaattctaaattgttttctgctgctaatttcttatatagaaaaaatcaaactagaacttgggtatctaccatttctggtaaaaagcttattttctatagtagcatatttttactttaaaaattagctgcttttggaagagcttttcattcagacataaaacataccattttcttctaaattattcttaacataaatggggaagttcttgtattctttcatttaaatcattcagtccttactataagtttctttatagaagatgattataagatgtcataaatacagccttttccagtagctttcataatttctctattatcacagatatgttgcatgccttatatctagaaactgatgaataaagattgtgtctcctacttggtaaaactttgtcactaactaaagtaacattttcttacatagaagacaaggaatttgttaaatacttacaataactagaaatacctgagacatgtgagttttcctctataatagatgaccatagctctttctctttcctttgttacttcttcattttttggtagaaatgagatttcactatgttgcccaggctggtcttgaactcctcaccttaagcaatcctcctgccttggcctcccaagtctgttacttttgactgttttgctgatggaaactaacaaatgactagttttagttttaacattattaattcattctctttctcttgttgtgcatgctctcaaggtattcaaaaatattttaacatggattattatgtttgtactttagaacatggaatctagcagtgcttttagtttattaggaatattttaatttacaggcttgtttcatatatgcaactcagctaccctgtaaatgggaaagagaacatagaggtataagtgatttttgttgtattatctatttgacaatacaagtcagatactatatattgactattggagcagaacttttgaatctctctcaccttcagaatgagacaccacactgaagagttcacactctcccagttctttccttgttatagccataatctcagccagctgtactcataacaccgtgcttactaagaaaaaaacagctacagctaaccaggatgtgtgctggctggcctgctcagcatggacctgggtggcagatttcagcatcctgccagatggtaaatagggcagcagaggtgagagactgatactgagctctgtacacaggcacacaacacacaacatctgagcagtaatcataaaacctgctgaaggaaattggtcacctgccactcagcgtgcaagtaattttggcaagtgaccttagcaagtccttattagtggtgtaatttagaatccatgcttagtcttttgtattttaggcagataacttctgaatgacaagaatatttgtgaaaaggaagagaagtagaaatggattccttttttgttgtatttttgcaccaacctaatatttttgtttcaaaatactacaaatcatgtaagtgttagaagttagttttcctataaattacagaggggaaggcacagctgtgaattgaaaggcaaagatccttttgaatttgttttcataggaggctgtgaatcctggaggagattaaaaaacctaaatttaaaataattgatatatagaaccactgccacatgaagattgtaagattttagaatgtatcactggaagagccttgtgacttagccagaaggggatccagagctgtctttagatgatcaatgggaatgctatgagtcagtcaccccttggtgttctttcagacttagaaatgtcggttttgctgtttcctttgagaaattaaactttcttctatctttttcttttaattagggtgttgtttttttccttttccttttttttcttgtctttttcaatttaccacacaaagcatgtttacacatcaatacacatga

SEQ ID NO: 16936 - DNA, 51589 bp, Human
tgtaaaaacattttattcaggactattgtaataaggggaaagagacctcagtatagaatgggactcaactcccaatgtcacgtggaccagtggggatttacagccaaggagcagggtgatgataagtggatggaaaattactaagaggaaacatcaggggtaagggagattctggttaaactgacctaaaaggattcttgctgaaggtaggccaagttgatcagacatcctctggggcatggtgaaggatgaagaacccaatcagatactgagagtgatcagatatggagatggaggattctggctaaaccaactcagcagggttcttgctaaaactggtttacaagaaagtgcgcagaagggcccaggagaaagttcaacactaaagtttggtcgagcaaagaagcttcgtcagtgctactttctagaaattttacttcctccatcataatgtgctcatgttatcaatatggtcccatccttttcataactcagttgtagtcagttattaaattcagtttgaggtcaaaaggaaacagaagaaatttactgagtgtaagtttcaagtaaatatgtcaatagctaaatttatttgagaaacctcaaggggagctagaaatgatgacataaaaataacaataagagaaatgaagcctaatgattatcctccttgaaatattagcctgagttccacatttgtacttctcagtcaatgcatttttaatttttctctttgttcattaaacaaatacttagcaaataactctgtctgctaaactgatgtaggacataatctcatggtttactgcaaatggccaatgactatcatcttctcaataagatgtcttgagtagtctctatgttatgtctgaacaatgatcaggaataaaattcaaggaatcctgggcctctggaaacaggacatggtttctgtgaacagccatcagtggatttttatcttgaactcatgaccctacttccagtttatctcattcatagagaatgaaattactccaattaaagccttccaaatcaaaaaggctagggactgggccatgtctcctccctgagatatgctagaataatcaatgccattgtcattctttgtaacattgcaacttctcctgtggctgtgttaaaataataaacctcatgcctgctatctccatctctcacagctgtggtttctgggtttctgtttgtgaataagcatttcagaattgccatgagatggaggaaatagcatgtgcagagtatttcccaggcctagttgccaagaatgagctaattgtaagcctcccttgaatgcaagtcacaaaaacttcaaatacaagccactctaatgatccacctttccacatgaatgttatgctttcgttgtagaaccttgatctttcagaagtatactaggagtataattttaaattatgtcataagattaataaactattgaaccatctttttgtgctttttatgttttatagtgattagatacaaaattgatgtttgtatttaagagaaatgtcaaatgtgatacaggcttgctacattgcttacggaaaatttgtctaaaagagattgatagtaatctgtcctccataaaagaataatattgattttttttaacttactttttttatgtttaacagggcaaatttgatactttttaaaaatataaaagtaggaattgcaaatatatttcacatgacacatcattttccaactaattggtaatggctatgtacatgttatgttaaagattctgcagctgagtctggcttagtagaaaagactgctgtcattggataataatgttttccaaggatgcaaattaggaagtggccatgtaagtcctatatttgcaatccttgcgtaatcggacaaagagttaacatttaaaatatcttttcagagattactagaaacatcctagtatacattaaaaatagcacttaactgaaaaacaaaggccaaattaacacttaccattgtacttatcctgtaggtcaatgcatcacgtcaagaagccaaattgacagaggagtgtgatcttctcattgagatcattcagcaaagacgacagattattggaaccaagatcaaagaagggaaggtatgatttctagggcagaagatttcatattctctacctggagaaaataaatcctaatacactccagggactttggaaatgttgagaaccctctttttctatacattctataattccctcttaagtctttaagacttagttaaaaggcctttgcttggcagttttttctccatccttttctttgtactatggtctcctgtgaagacctgtgatacaagggctgctccattgcccagcgccaggaggtagcataaaggtcttgtctatcatggccattgttttctatctcacttgtctatgagaaggtgggttctgtggaggcagagtttattttgtattcattgtgatatcctagaaactagcatagcattacataaattaaaaatgaatctgactttatttatagaaattatgaagtactttcccatgtttttgaggaaatgtatacaggtataacttcatggtcccaaaacccctggggtttcactatatcatatactcctttgtggatatagtaataatacttcttttctaatgttctaatgtttctatgttttaatttcctattgttttacagcaaactatatttttaagataaattgacatacattctttatagctgctttcttatttattcaaaattcattcacaaactgttggtcactttataatccatcagtttattctattttaaaattagtcatgtttttattgaaatacttatgatccttttaattttacccaattctctgccacattcagggataatttttctttcttttttcttcttctttttttttttttttttttttgagacagtctttatctgtcacccaggctggagtgcagtggcacgatcatggctcactgcaactgccgcctcccgggctcagacaatcctcctgccttagcctcctgagtagctgggactacaggcatgggccaccacacctggctaatttttatattttttgtagagacagggtttcaccatgttgtctaggctggtctcgaagtcctgggctcaagcaagtcacctgcctctgcctctgcctcctaaaatgctgggatgacaggcacgagctactatgcctggccaaggataatttttctatggatttttaaaaatagaagcgtttatttatgatccaataaattcatccatttctattattattgttcatagttgtactttaaaacaaaatatatataattaaaacatactagcaagttttaagtgaaacacagagataaccgtggctaatgtatgtggttttctgtgttttccacaaaatttaacaggtaccttctaatattgtacaatgttttagattactctgtctatatagattacaaaatatttatacacataaattattaaaatgatctaaaaaatagtgaaatcaaatagttattgatgctggtatagtagattaacagattaacatgaaattattccctggccaaggactcacatgtgccgaaaagctacttttccccacatacgaattgtccaatttagaagagcactgagtgtccatctggaatccttacaggatatatttcatcttccatcatcatcgtgcatcataggtgcacatctcttaattctggaagtattccaggttctcagacacatggccacctgaagtacagtcacaattaattattcatatgcatacagaaggtaatttgctatctttacatggttgcatgcagagattagctctcagtacacatattagtttattttcatttttaattttaaattgacaaacatttatatttatggagtgcaaagtgatgttataatttatggatgaaatatggaataactaaatcaagctaattaacatatccatcatctcaaagccttttcttgtggtgagaacatttgaaatttacttgcttagtgattttgaactgtataatacgttattatttatttgctgttttcaccatgccatgcaatagatctcaaagtaaaaaataaataaataaataatttttttgaaaaagcacttcctcttcctctctaattgaggttttgcaccttactcttactagtttcttattgctgcaataacaaattaccttaaacttggtggcttgagacaacatagatttattatctcagtgtgctgaaattcggaaatccaaaaatcgatctcactgggttaaacaaaatcgacagtcaaggttttggcagtgctgtttctttctggaagctttaggggaaaatccattttttcttgccttttctagctcttacaggtagcctgcattctttggctcatggtctctttgcatcaatctgacctctcttcccatcctcacgtcttctctgacacaggccttcctgcctttctcttataacgacccttgtgactacattgggattacctggataattcagggtaacatccccatctcgtgatccttaatcatgtctgtaaagtcccttttgccatgtgagtaacatattcaaagattcctgagattaggatgtgggcagcattgagagcccttattcagcctgcaagggcactccaccacaacttcctggctagcttgccttcccttctcttacttagcttggacttcccaccaccagggtttctctcatgagctagatcagagtagtgcaggtgtccccaagttccagccatagtgatgcatggagtttatgcttcggtgcactcgttctaccccaaatacatgtcagtaataaagaacttaataaaatgcaaaagcaaagacatatagctgaaccaaaaacaagataaacatctccacaggccagaaatgagacaaaactgaaaagccatgactgtggctgaggatacaggctactgggatttggtctggaagaggccaaagtagctttggctttagctcctgtggataaatagttcttgaagctttggggaaaggacctagaagtgctccagatgggatggggaatggaaatcaggctcattatttaatgccatgggctatagaaggcttcatgcttcagtcaaaaattattgccaacctttccctcatatcatagcttttagcaaagtcacattgttagcttgaagcctgtgttcacactgtttctgatacccacacagaacaggagcacagagataaggatgggattcctgaataatgacctcaagggccaggtgaaggcaactggaaaactatcagagcagggtaggctgagcaaggagggtgagagaggaaagaattataaattacttccctttaaaactgaaactctaagtttaatttcaaagtatataaagaaatcttaaatttctaaacatacagccagcaaaatcagcagacaacattatcttaccccagataaaattaattttataggaaaataagaaaaagactttaaaagaagtagtcttaagatgttcaaagaaagaaatgaaggaataacttctctttcaaaagagcaaaaaaagtgaagccacaaaagaaggaaatgaaataaaaaaatagataggaaagcaacaaattagcagttttggagggaaaaatatagatattgaaattagaaagaaaactcagctgcagtggaaatttggaaactgagttttggtcaccaccttgggaatgccataaaacgcattcttttacgtctgagtgacattaaagtttgacaaatgccgactgagtttgaactcaaaagataggaaagtatataggaaaacctacacatggggcatttttaaaataataatcatgcacttggttgaaagcaagtatttcagcaaatttcaaaaactgaataccatagaaccctgcctctaagaccacacactgtatctcattagatattatcaacaataaaataatagtttctatagttttttgacactaaaatctattcatatataaatatatcttcacagtaatattttttaaatgtagaagtaaaccacagtaaaagaactataatatatcataagtagtaagcagcaaaaaagtatctgaaggcaaacttacaggctttaattcttttgaaaaagaggctgggcatggtagctcacacctgtagtcccaacgctttgggaggccgaggcaggaggattgcttgagtccaggagttcaagaccagcctgggcaacacggcaagaccctgtccccccacccccaaaaaaggtaatactaaaagtaaaaaattagctttcaaataaagctagaaaaagcacaacaggataaacccagtgaaagcagaggaaagaaataaaggaagaaaagtaaatgaaagaaaaacaggaaacaaacaagaacagctgtcagcaaagaacaactcgcagcctaattttgaaacatctgtgaataaaaaaagtgccttttcccccatttttaaaaggttgttaaaaaaaataaagaaaaacaatatatgtgtgacagagacagtatgtggtcttcaaagcctaaaatattgactatctggtcctctacaggaaaagtttgccagcccttaatcaggaggagttttacttgtaaaaaataatttaaaagaccaatctgtagttaaggttgatgaaggaaaaaagagtgtggggccccataaacaaatataccataaatacagtagagacttttttaaacataagaaaattgtgtaaatgtcttcatgccaataatttgaaaacttacataaagaagtagcggaaaacctgaataaaccaaaaatttaaaagcagaagacatttaataagtcattgaaaatgtccgtcaacttgcatttctgccccaaaatggcaccagcctcccacagttctatagcttactttaacagaagttccaggaactaataatctcattctcatataaactacttcagaaaatagaaaaaagacattttatgtagagtgtatgatcttgataccaaatacatacaacattaaaaaatctagagtgagagaatatcacccatgaatatagacacaaaaattttttttaatatgagaaaatgtaatccatcagtgttttattaaacacatcaaaatagcctttattcttataatacaaggatggctcaactacagaatatctgttaacagaaccacattaacagaaaacatacatatgatcccagagtaggagggatttttctttttagaccaaacaattttaaaaaaacaaccataaagcaaagactgaaacatctgacatagaataagatcacaatacaaaagccaatttcatttcaatatattagtaacaattgaaaattgaaatttaaaaaaagaaattccatttaaaacagcctcacaaatatgaaatacttagtgataaatctaacaaaagatgggtgagacttgaaagaccttgaaaactacaaaatattgctgagagaaattaaagacgactaaaaaatgaagccatgtatcatgttatggggtaaagactcagaaaagttatgatttctgttctttccacatcaacctgtagattcaacataatctcaatgaaaattccagcaggttattttgcagaaattgacaagccgattctaaagttcatattagaatgcaaaggatatagcataatcatttaaaactttgaaaaatagaccgggtgcggtggctcacacctataatcccagcactttgggaagccgaggcgggcggatcacgaggtcaggagatcgagaccatcctggctaacacggtgaaaccccgtctctactaaaaatacaaaaaataagccagacatggtggcaggagcctgtagtcccagctactcaggaggctgaggcaggagaatggcgtgaatccgggaggcggagtttgcagtgagccgagattgcgccactgcactccggcccgggcgacagagagagactctgtctcaaaaaaaaaaaaaaaaactttgaaaataataacaaagttggagaactaacatcagctgatttcaagatttattataaggcttcagaaatcaatataaggtggtatttgtataaagatagacaaatagatcaaaggatcagcaaaaagacttgagaagtagattcatacatatatggacaagtgattttcaacaaagatgcaaaggcaatttcagtggagaaaggattgtctttttagtaactggtgctggagcaattggatatctgtatgtaagaatatgaagtttgatccatacttcacattatatacaagactttactcaaaattgattatatatctaaatgtaaaaggtaaaagctgtaaaactcctagaagaaaacgtggaggagatcttgaccttgggttaggcaaagattctttacatacagatgacaaaagcattatccataaaagaaaatatttatatgttgggtttcatcaaaattaaaaacctcttcagaatgcactgttaagagactgaaaagaccaaccacaaactaggcgaaaatatttacaaattatttattttaataaaggattgtatccagaatatataacaaattctcaaaactcattaataagaaaacaagcctttcaccaaaatgcataaaagatttgaaaactttaccaaagaagaggtgtggatgatgtattacttagggttctctagagcgacagaactaataggatatatatatatagagagagaggagtttattaagtattaacttacacaatcacaaagtcccacaataggccgtctgcaagctagcagggagagccagtccgactctcaaaactgaagaacttggagtccgatgttcgagggcaggaagcatccagcatgggagaaagatgtagacggggaggctaagccagtcttgccttttcatgtttttctgcctgcttatattcgctggcagctgattagatggtgcccacccaattaagggtgggtctgccttccccagcccactgactcaagtgttaatgtcctttggcaacaccctcacagacacacccaggatcaatacttgcatccttcaatccaatcaagttggcactcagtattaaccatcacagatggtaaataagcacgtgaaaagatggttcagtatcattagtcattaatgaaatgcaaaataaatttcaatgagatactgcttcctacctactagaataattaaaattcaaaagatggcgcataccaagtgttggcaaaaatgtgaaggaaccagagcctctcacaaactgctggaggtgggaattaaagtagtacatgctggaaagctggcagtttcttaagtaagcatacacttaccatatgatccagccatttaggtatttaccaagagaaaggaaagctatgtccatacaaaacttgtaggtgagactggtcacggtggctcacacctgtaatcccagcactttgggaggccgaggcaggtggattgctttgagctcaggagtttgagaccagcctaggcaacatggtgaaaccctgtctctacaaaaaacacaaaaattagccaggtgttggtggctcactcctgtaatcccagctacacaggaggctgaggctggagaatcgcttgagcccaagaagcagaggttgcagtgagctgaaatgatgccactacactccagcccgggtgatagagtgagaccctatccaaaaaaaaaaaaaaaaaagacttgtaggtgaaatttcatgttaattttacttgtaatagccccaaactagaaatggcccaaagtccatcaacagatgaatgggtaaacaatttgtgtcataatcacacaatgaaatactctttggcaataaaaaggaataaactagttacactagttataatgcaacaacatggatggatctcagtataattaaggtgcgtgaaaggagtcagacagaaagtagtatattctgtatgagtagattcatatgaaattcgagaaacggcactttctactaatctacagtgacaaaaagcaaatcaatgattgcttttagggatgggatgacaggaaaggatgggcacagttaattacaaaggggcaggagtaaattgtggggcatgatatatatgtttattatcttgactgtggtgactgtttcatgggtgcatacatatttgaaaaagtgtcaaatttgcactttaagtatgtactgtttatgatatgtaaattctatctcaattcagctgtttattagacatataaattgtgtattatataatgaaaaagtcttcagaaattaaaattaatgaactagggtgatatgtattagcacggacaaatcacaaaaacagaagaaagttatataattatttgtacaagcattatataaaatttaataaactaccaaaaaatcccatacattgtttaggtatgtgtacataaacatgtttgggagtgatcagctctaaatttgagagggtcttttcttctggagagagacatgagtgagattataaagtgccacacagaggctttaatgctatcaataatattttaccaccaggtgtggtggctcatgcctataatcccagcactttgggaggccaaggcgagaggatcacttgagcccaggagtttgagaccagcctgggcaacatagtggttccccatcactacaaaaaataaaaataaaaataaaaattagccgggtgtagtggcatgtgcctgtgatctcagctagtcaggtggctgaggcaggaggattgcttgagcctggaaggtcaaagctgcagtgatccgtaatcatgctactacactccagcctgggtgacagagcaagaccctgtctcaaaaaaaaatcttttttacttccttttgaaaactctgaagctcatatgatgaaaatactgagatttagtaaacctggtactatgtacaggacagttcattatattcttaaattttttgtatgtatggaatgcttcactttttaaaaagtatacatttgctcagcaacattatctcagaaggcaatcttagaaagcagatgttacttgggaaagatgagggccgcactccttttctcttgagctagtactttggcacatgaccaaggactagttcattccaaaccctgaaactcacagtgactcaagtccctagccagggcatattgtgtcagaggcctgtttttaagaggaagggtgtgaatgccaacccgtggaaatctgaggtgccagacagggagggcaagtgtggacttggggttcactgggggacttgggtccctgcaccccaggatggcagtggcaactgagggcattgagtctaaagaacggatggtggggccttctgacaagcaattggaagtgggcaggtggagcaagaaccaggcagaattgtggagatcacaaaagtgagtttcatcaactgccttattttgcccctgtctatctctgacactagtcactcagctgtcaaactcacctcaaattctgcaattgacgaggtcaccaagcaggtgatattattacacgttagtacctactgatgattcctgctcttggaccattgtacattctctgaaacaaattaactcgacagcctttataggtgggcggactggagagtcttaagccatgaggctccctggaaaagaattttcttctttttttcagtagtcggggataagtttcatgtcaacacacaaagagctaaattcagattgagttcattcatttaatgttcagacacagagatctatggtagacttctgaaggccaaagctcaacaaaataagggtcccttttcttcactgccttttatgtacactaaatcttaaaagtttaagaaaattaacttggactaaatgttgagctctccatggccttaaagagatggtgagaacaggcctcattttcagttcagatacttgtgtgaattgaggatgcattgtttggacctaattgttttgggttgtgtatcctacatacatataaaaagatttatataaaaataagtgtttaaaacgcatttcaagcaaaataaagcggcttttaaaagaatgtgtaaggtataataaacagcaaataaaatgatataaacagccctgtgtccctgctaaaaggagattccagcaggcaaactatttccatgactagtagagagtaaattccaaaagttgcaatgtggtaatctcacttcccaaaggaaaaatgaagagttgactggaaaatatttcccttgcagcattaaggcagacacatacagaatctttttatgtgtcagtatctaatttttttaaacatcaaattttattcaccttgtcaacttttaaaaataatacattaaaaagtgttgtctaatagaaaactaagtacttcgctccatgctgggtgtctgagtttgaagtgctgtgacaagtaggacagtgtttcagagtgtgctgcaaatcagggccatctgactgtaatcatttaagccaggggttagccgacttttctgtcaagggccagataacaaatattttaggctttgccatacggtctctgttgcagcaactcacttctgcacaacattgtagcaagaaagcagccatagattatgtgtaaccaatgagtgtggtagtatgccaataaagctttatttacacaaacaggctgtatgctgatttggcccacagatcacagcctaggaacacctaacttagagcagtgtttttcttttttctttttttttttactgtaacccgcagtaagaaatatatatgacatcacaatacagcgtgcacgcatgcacacacacaaaaggttttacaaaacccaacttgccttttctaccaggaatgcactctgctatttgcttttctcctcttctatttggttttttaaaggctagtcctgactgtcctaatgattcatcacctgcaggcttaaaaacatttgttgcttgttgaaatggaaattcctcctgctctgcgaattacaactccttaactcaaatattggagcgtagacccaaacatctactgtttttctttcaaaatgatgcccagctgattcttttacactaggtttgcaaagctcaaatcagatgtatcagatgaaattgtacactaacctataactaaaattatgcccaaaattgttctctgtagaacattccgatattttcacaggcgactctcattttgtcttgctttaatttttgcatgatttagggctcttttattctttttcctgttatgtcacttttaatgttcaatatcatgatagaaaaagaaaagaagaaactggagttcaagcatcatcgcatttgaaatgtgtgtggtctttaataggcatatctaaaggataagtagttgtcatgaagttattctaaaggaatattttgaccttattttcttttgctggaattgtattaaacatctgcaattcggccatgtaatttaaatgattctttatgctgtgtgattaaatattccattcacttggtttgtcctgtggactgtaaattagttttccttctggaattttccttcctctgacagtttcttatgaacatgttctaatatcctgcgcgtactggatgccttccttagctttgcctccagatagaatgatgccagaggctaaattctatttggtgtaaaataagtgttattttattccactaatgaatacaattaatccactggggacagtaactataattataatgcattaagtcttttaccaggctcacgatcctatattatttgccctaaagttttgacacttcattctctgactctttcaggaatttttttcacccttgcctgaaatcttgtgcctgctgcttctaattcagtatgaatttcctttgtttgcttatagtacatacttggaattggatgttccttagaggcctcaagttctgacatctctttccttccttttcttagattagagttatacagggatggtaatgacgacttggagaaagaaagaatttcttggaattagcaggaattctggagagagccttgggccagccttgtctgtaagacagattgactggtctcctccgtaccctttcacccagggctattttccattccagaattatcataaagccggttgaaacctgtccctgggtgtgtggttgggggcagtaggcacacagcaattccaattagctgtctaattttaacttggcttctggctagaggacttcatctcacagcacatttcaaacacaagagcgaacggtcaagtgggttaccttggacttatcttggcctgccccggaggttatggtcaattatgtttgagggacattttcaagcgagacagaatcaggaattggaatggaggttgtgaagcaatcatgcgtttttatcccaactgggaaatgcttatcaaaatagttcctagttatcaagtaagcacaaagtgcctggaaatgacgttcccagtgaggggaaatggcccagctgtgctttttttggctttctctcatctgctcaacaggaaaaatattaatcaatgggaaaaatgctccctttctgttaatttaacacatgagttttaggtagtgtgggaaatagtaacacttaatgctttccattctcgattttattacatgaattacaaaaaacactttttagaaaatggttttcatttaaaccatagattcaccacctataaagatgttttatcttcttgatgaaaagaagataaacctgagatagagaaagttccagggttccctacagtcttgcagtcattgtgtggaatagtccagggaagacgtctggtgaccctttgtaagttgccactgggcaacacctttttttcccatcaacagggaagcaattcacaattcagtgtttcctcgtaaaacgaattagcaatgcttctccaatgagataaggaatatctaaaccagagtcccataacggagctttccatattttgatatatctctatgcctactttttgaacttttatggaaggataacacaacaaaatgaaggatccagcctgatgccttttcattaagcaagaccacccatgtaaccatctctctccatgcctcttttgttcaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagaggtgagtgcaggggcccctgggaatttctcggctgctgggctcttgtatctgcgctgtgattggttggtcttgccctcgccttgcttttattttcattttcaaggctcagtaccagagagaatagaggctttgagctgttttgttccagctaaagatgcttccttttgacatgtgaaagccctttcagtaacagcctggagtctggagttcaaggcctttgaaacaagagtccaccagttagaaagaataaaatcaacctgcttttggacgaggggggagcttatgatggcacaaaaacagcatttattgtgactctcagatgtgatgttatcgtacacttgataacaaagagtcaaaatgaaggcaaaaacattaaagggaatattttcttccatcacagggctcatctatttttttttaaaatcacacaggtgttgttctctgttaggcccattttcatttggttgaggagcttggcctcacctgaaaaggtcaaggccaactcacgcaggagagaaaggaccaaactgtcaacctcatacgggcttcttttaaaatactctttattctcaggtagggagctttaatgtgatgttatctgaatggttggctcagcagtaaaactggcaaagataagtattttttcggcacacatacttggttggtataaaaattgctcatcttcactgacacaaacacctatagcaattctagtggatccaaagaaaagcactagccgggcacggtggctcacgcctgtaatcccagcactttgggaggccaaggcgggtggatcacctgaggtcaggagttcgagaccagcctgactaacatggtgaaacctggtccctgctaaaaaaaaaaatacaaaaattagctaggcgtggtggcaggcgcctgtaatcccagctacttgggaggctgaggcaggagaattgcttgaacctgggaggcggaggttgcagtgagccgagatcgtgccactgcacttcagcctgggcaacagagcgagactctttctccaaaaaaaataaataaatgaaaaaacaaagagaagcactaggctgggccaggtacagccaatgccacataaatgacatctctaactcaggctaatggccttgacttcattcattctaattttcagagtcaactgccctttatccaaagcaataatagaatcctatctctagaagaccccagagagctcatgcatgctgatcttcatcctagagcagagatcagcagactttttctataaaggatcatcaagtaaatatttttccgctttgcaggttgtaaggtcttggtcacagctactcaactctgccattgtagctagctctaaagcggccatagataatatagaaacaaatgggtgtggctgtgtgccaataaaaccattacaaaaacaggcagtagaccatactttgccaacccctggcctaggaaaaaaaatactcgccatcttatgactcaaatttattcaaagaaagagaaaggaaactaacatttattgagtgcttgcttgtttcggaaacttgtgctaattctcaaaatatcgcatagaggaggagtgattgacatctccattttcactcttcttaaagagtaatgtatcgtgtttttacaactctggtctactgtccaatcggcttgactgtattatttcttatatttgaggaaaattccttttgtagctgattagatacttatctcttctaaaaggcatggataacagctggctatcatccctgttatgtacttaagatgctctcctccttactctgagaggcccatttctttcctcctgattccttggttccaaatgtttattttccctgggccatatccagttgctcaatattcaccctaaagttaaaaactgcaaatagcactaatactccagtgtacctaggacactaatagatagcgtttacacttaggtcacggtttccaaccggaatccaggagtacttttctccatctatgaactttgagatgtccagatgaaatggctattatgaactgcattcctcatcaatccctgaagattcaaccaagtgtcacatgaataaattcttacctagtgaccagggatgatgtgaccccataacagttattgctgaaagaagatatgcatctgaagtatagcacaggtgtgggaatgcccacatacaatctccctcagttccagtgggacgtatctgctcccattcagctctctctataacaagcccaactcatcaagagcaggaacatgactttgatttctctttctacaaagaatgtgcttctgtcaagtttgaattcacagagcctgtaaaaatttgccaagagccttgtctctgtttctgcagtcccctctcctcccatcactatttgtcaatcctcttggctaattcctgagcctttctatccttccagcagctaggatatagaaaaaggacactgggcttagactagaagttggcagacctgggttccagtcctagcactgccactttttaactatgggtctttgagctattttctacttagaaaattgggttcaggaacagtttggaggttcctcaaaaatccaaaaattaagctatcatataatccagcaatcctactgctaggtacatacccaaaagaaacgaaatcagtatatagaagagatatcctcactcctgtgtttgctgcagcacttttacaatagctaagatttggaagcaacctaagtgtccatcaacagatgaatgaataaagaaaatgtggtacatatatacaatggagtactagtcaaccataaaaaaggatgagatctagttatttgcaacaacatggatggaactgcagatcattaagtgaactaagccaggcacagaaagacaaacattgcatgctgtcacttatttgtggaatctaaaaatcaaaacgattgaactcacggacatagagagtagaaggatggttaccagaggctgggaagtatagtagggagttgtgggagtgggggtgggtagggatggttaatgggaaaaaagaaagaatgaataagacctactatttggtagcacaatagggtgactatagtcaataataacttaatcgtatgtttaaaaaaaaacttaaaaatgtaactggattgtttgtaacccaaaggataaatgcttgaggggattgataacttattctctgtgatgtgcttatttcacattgcatgcctgtatcaaaatatctcatgtactccataaatataaacacctactatatacccacaaaagaattgtttttactaataaaaaaattatttaaaaaaattggtttcagaatagctgtcactgttgtgatgacattgctttaagttcctaagaacaggtcattagcattatagctactccatgagtgttagttggatctctgttttcacgtttcaacatgtcagtctagcccgccttgtgtgtcttttttccaatgctactctctgtctacctgcccctattcatcaacctgtcacttaacattcttctctaggacatgacttcttttttctgtctcctattgtgcctgccttgggctttggctcctgtatacttccaaacaatctttattcttcaattcaggtgtggagcccagaacaaacttttaatcccgcaggcattcttgaagtgagacttagatgagattttctgcatcgttaagcgacttaaagtggatatgtcctcctacaagctgaatcaaaactgtaaatttttctttcatttcagaaacatcaaacaactccaaaaggggagagagcctcaagctttacattgtaggagatgcttttgctttggaaccggttgtttggctctgtgctaattgcttagtaattatagatagcattgaggctgctcattaacattggctaattttgctcatatactccaagtaggcaggtaccctagccaccttgtttttaccattatagccccagcacattgcgagctgcctgacatgagtgaatgagtgaatgaatgaatggatccataaatctgtaagacgggactaattattcctacctaagatggttattgtggggataaaatgcaataatgtagtaaaaacattagcctagtttctgtcacaagatgaacatgcaacaaatactagttctcttccttcccactcactagatgaatgcaaatgtataatgtactatattctcaagctacactagtagataggtctttggtgtgattgtatatgcacctttatagcattattttaaataagcaaagctattcactaagtccaggcataagaaagttggtctgcttatgaagaatctagaattaaaatcccttatagcagtaacttatctgtatcaagaaggtgataaaaagaaacttccctctgaatagtacctattgttcaaagcacctaggaggttctcagactcctcaaggtgatccttctgttcctcactacaataggcagttcaaggatcttttccagaatacaaagccaagaactccagttgtcaattctgaaaagatgttgcttggttcaaagaattagagcatatctgatcagtggttttggaagtgtgtctgcagggtgttcataggcattaagataactgcacgttttcaaggccaaatgtgtttgggaattcctgggctgaccaaagtaaacctatcttgttactgtgaggcctcactgggttttactttggtgatgcacattgtttggcagaagccttgtgagcagcatagctccagacacgtccaccttctggaaaactggccccatgtgtcccagacatggctgtaaagcaagaagttgagaaagtggcatagcgctaacagccctagtggatttggcaacttatccaaaaggccagaagatgggcaataaggatttgggaaataaaaacatggcctaaaatgttgaatttggcagatttccccttgcctgtcactccaattaggaatttgaagttgtagccaaagataagtatctttccttccatcaaaaaacaaatgtgtaggtgttaaaagctgcagtaatctccactgattcttgctgtcagcctttacctcccaggctaggaactttgatccttttggttcccatgtaacaaagttcctaccatcaagatggtagacattattaacagtgtcactcaatttaaaatgttttatttaattgtttgtagaccatggaaccaggagaaacttgggaacaaaatctattttggatgagactgaataaagaggtttctgccagtgggcagggaaactgctaaagccagggaaatgcaattgcaagtttggtgcttgtttcccagtagctcagaacagttctccctgccagacattatgacggagaattaattggcgtttcactttgcgatatcttttaagggttcaaatggcaccttagcatttcttttaacttttctgcatcgaatgcatatattctgggctctttggtgtgtagcatagtttaagggcttcataaatatttgttgagaataatcctaggacctctatgaagtttaaggactttttgtgttcatgggtcataaggaaagcatttttaaagtataacttgaccatcaatcaaaaatgcctagcaaccatctccgtatccatcagtctaaattagcagctgttggtaacaataattagcccaattccccagggtgcaatatttagtcaacaaaagcactcaactctgctattcactacttcttggtgaaagggtcaggagatgcagttagattctctaccctcattcagacacttgaaactcgtttccagagcttagacctcttcacttgcatctttcaatcccagtatcattacatttatgacattgttgattaggctctctccttccctcctgtacaacactgaaaatctgccagaaatacaactatagaaactgtatttctatgaattttgagcattttacaggtatattcttttttagatgggtgaaatttacacaacataaaattaaccattttaaggctgggtgtggtggctcatacctgtaatcccagcactttgggaggccaaggcctcccaaagggtgatcgcttgggcccaggagttcaagaccaacctgggcaacatagtgagactctgcttctgaatgcacgattcagtggcatttaggacattcacattgttgtgtagccaccacctctatcaagttccaaaacacttccatcataccaaaagtaagccttatactcattaagcagttactccccatctcccctcccctcttagcccctagcaaccaccaatctactccctgtctttatgaatttttgccttttttggacatttcatacaaatggatcatacaatatgtggcctttttgatggcttctttcacagagcataatgtttttaggctttatccacatcgtagcgtgtgtcagtgtttcatccctttttatggctgaataatatcctgttgtatagatatatacccacagatgtaatttttagagccaagatatattacatttgtaaatccaaagctttaagagccattaagagactcaaaaggacatataacccttggagtaactggcctgaaatttttctagatgaaacagaagagtacagatctgaaattctcctccttgctgctgccagctagctttgtggccttgtataaatgagcatcaattttcttaattagaaaataagtaactagatttagtactaaattgtttcaaggttgtttctttgctcaaaaattcccagcatcctacgcaatactccgcatataatagctcttaagagtgttgtttatggaacttaacaaaataccaaactcaacaagattactagtccagcatcatttgatatgctcagaaatggtatgcttcatgccacaattctcttgtttttaagagaagcacttgcatttttgaatcaaagtgttcattattaataactgaaccttccaaatgaacctgagagtacatagaaggagattgagacacaccagtgccttgctttttagtttatacatgagaactctaaccagaaaacctaaatgaagaagagaaatagtgcatccactggggggatttgtgagaaagctcatgaatattttccacagcatctgctgggaatatggtgcaagaaaatgaatacaaagagaaagaaaatgagccagacaaaaaactccctttttaatgtttattttagagagaggctagtaattgattaaactaatccaatatctggaaacattcttttttaatattcactttgccttttatgcagtttgaaattttggagactctcctttgaagtggatcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagagggcaagccattttgttgttttctccaattccttcacttttttttaaagcttgcattcatttgttttatgttactgtgttgtgacattttgagatgcctcttaaaactcatgtgtaaaaaagcactttttaagagatatttattttccttttctttttcatttctatgcagtgatgttgaaagtcatcttgacatttctgaaacattgttttgtttgcattacagagtctccatggcaactgcatcctcccaggttctaattcctgaaatcaacctcaatgacacatttgacacctttgccttagatttttcccgagagaagaaactgctagaatgtctggattaccttacaggtattgtcttttatgttctctttaatattgtgcacacttagtgatataaacactttgccaccagatcagttattccccaataaccagaggaatgggcttttgacctaggaatggcactgatatttccataaacaatttctgtgcattgccctttgttttttcatcaaaacaacacagcccattactaaactggggacaggagaaaaaggagaatctcaaccattaaaagcatacttaccactgtttccctcactctcaaggtgtgggtgctaaaaatagtatctctctgtggtatttttcatatcatagtagtaagcaactcacaatacattggcagagaaaaaattggcagctaactgattggttgtctgtactgcttcatctccttgtatttgtgatcttgttttaatttgcacaacatcgagttgaggtaaagcattataatccccattttgcaaatgacagagatcagccgtcttgctggaaatcaggtaactagggaatgacagaattagaatttggctgggacctgtacaaactccaaaaacttctgctctttctagtaaaagactgaattttatcttggcaaatgtcaccatggcaaaggtcacaaatttacattggaattcctagtgctgtgtttcagtgtgcttcctggttggtgttttgttttgttttgtttctcccttggttgagcttaaaaaacaaaaacaacaacaaaacaacaaaaacctcaggccactcctattcctaagcatgcttctaaacttttctttgctgtcaacttctaaagtaggaactgagaatattcactggtagaacctggactgtttagacaaccttattcgtgttagccaaagccaccagtgcctgcgacttcaggaaagcacaatgtacacagtgaagccagatgtgcgctgcacttaagacatacagccttcaagagaccacgtctctaacttagcgtgacatgagcttctcaattccaattctgtgtgtacatgtttgtgagaaagcgattgaacaaggtggagcaggagaaagggaacattgtgtgatgtttgtttttacagtctgtggatagaaggccaggggttctatattcagggagcattgtacccagaagatgagcattttttctttgcgaggacccaatgtgccgtttttagcctttctgcattgtcaagcaaggcaggcaggcattccacaaacttcttatcttatgtaactctctctttcaaacataccactcctattaaggaagaaagaaattgactaaaaaagcatttaccgtatggaactaaacttggtttcaaatatttgtgtacataatgccctcctatttaagcttttaactctgagatttatttaaactgacactatccaataaaactttctatgatgatagatatgttctatatctgtactatccagcgttagctgcctcccacatggggctattgaaaacttgaaatgtggctagtgaatttttacttttatttaacttcaactaaatttaattgaaatttaaaccaccacatgtagctcgtggctattgtattgaacagtgcaggtctagactttctccagctaagctgtttttcacagtggcatcctgttaaaaatctcctttttcttatatcatttgcgaatgagtttagttgcaagcaacaaaaaatccaactagcagtgaataaaaccatcaaggagtgtttgtattacagtcacagaagagaagcctgtgttccagggctgggcagtggttcagtgacgacctcagaccccaggctctttcttttttcctcctctgccgccttcattgtgttgcctttttgccacatgatcacaacatgactactccacctccaagtgttgtgctcaagctctaggcaaaaagaaaggggtggaggggaaacgatggacaaaatgctctgccagtgaagtttgtttatcagaaaaacaaaaagcttgatcagaagacccgcctagcaaacttccacttatgtctggtgggctgtatctgtgttacaaggtcatgtccagggacagaaaagactggaaaattaagtatttgcctaggcacatggccattctgcccagaatcagtcttattgacaagaatgtgcccttgccatttcccaataattatttcatagtatttcaacaacatatacccattttaatctctataggaatgcaaaagtattgattaaaggggaaattgtgaaagtagtttagactgaattgtaacatacaccatatttcatcccgatggctgtttatttcaaactaaaggccatatggggtacctgctattatgtcttctgagctgtcaaccccaaatacaaattcagtccatttctagacataacatcgatcctgaccataacatatgatgcttggctgatactgccaagtccaaatagtttatgacatttgtaagcaggaaatgaagtctttgtggagtattagcccaccattccttgggtggtgtttgtgacagagacaagaaaataacacttctggtactgattccatgagtattgaaattggcagcatgctgctgttctcatttacactaaattgagtattgacttctcaggacaaactcattgggtttacagtcaaaataaggttagcctgtctcattgtaaaaacaagattttttttttcctatgacatgcctctaagtggtatatcaagttaataacccatagaggtgacatttccttcctgattatggctactaccatgtgtctcacagctacttgcctattttgaacatacgttttctttctatttaattgtatattgcaatacagaacaaaatttttctacaatggttgatggagaaataattcaatgaactgtttaaattgtgagagagtaagtatttcttcactggtccatgcaggagtgatcccacaccaacagggaccacacagacaataataagcacattttacgatgcagctggacctcctccgtggaatgcatatcctgattggtgtcactgattcatgcacatccaagtcataccacatgacactaaatctcacatgtgaatacttcaggagacagatgtacaaatacatattccagaaagaatgctttaaaggttatgtagaacccttctgtcttaatgcacaatttaatgccatgcctgtcacgttggaggtgctcaacaatgtttctggaattcagaaccaatagataaagctaagctaattgacttaataccgtagacttgcttctgtgatacttgtcctagaggtatattcaaaaagcaaagtgaagactactaacgcagagtttaaatttacagtttttataaacttttcttcctctttgggtttgcttaggactcatcaattctaatcataatttagagcaggaaataactctgaaatagtacaagcaaaggttgctcctagtttgtagagtgcaggtatgtttctccttttgaagtgagattctagtgggtagaagagtggaagtaaaggccctggatcaattctctaaaccagaggtcagcaaactttgactgcaaaccaccagatagtagacactttaggctttgcagtccatatggccacaactactcaactttgctgttgctccaaagcagccatagacaatacataaatgaatgaatctggctgtgttccaataaaactttatttacaaaaacaggcagtgggccagacttggcccacagtcacagtttgccaacccctccctctaaaatattatttacaatgcaaagcactcattttctcatattttccttgctcacatactcttctcataaaaccagttactgaaatcaattcagtagaagtcattttaaactcattattttggtaggacttagacttctctgctccagaatgtgttaaagaaataaaacagcagccttctacaatgataaattaaccaaatgccaaaaaaaagttttttccttggggaaggaaaatgtaccttttagatatgattgactatgaatcatggtcttctgaatttgaaatatcgcatgagttgagaaatgagaagaaaatagggctggactagtaagttcttttttttatgtaagtcatcgaaacatctaatgaaagaaaaattcaaacaattatgtggctgattttttgtaggataacaaacataagtattttttcaattgggtgcctaaagatataagtatctggcaccacgtattaataggtcaggggttggtgaactttgggttacagcccaaatctgaccctctacctatatttgtaaataaagttttattggaacctggccatgcccacatgtataagttgtgactgttttcatgctacaatggcagagttgactagttgcaacagagactgtatggcccacaaagctggaaacatttaccatcaaggcctttactgaaaaagttagccaacctcccaaagtgaatgcagctatgaaactttatcttgtttactttttatttgacaagttttccttcatgcacaagaaagtattatttgtttaacctcccaaacatattctcatgatctcatgataaacacagaaagtccatactggctgactctagtcacactccttattaaaaacaaaagcaataaccagccaatcagatattctttagattggggtcaccatctctaggatagtagtcctgatggacctattgagaaggacctgcttaactgtcaaacatctcctctgaaatggtatcccagttgtgtgtgcttttccactgataagcattcttgacccccacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctggtgaaaccccatctctacaaaaaatacaaaaaaaatacaaaaattagcggggtgtggtgacacacacctgtagtcccaactactcaggaggctgaggcaggaggatggcttgagcccaagaagcagaggttgcagtgggcagagatcacactacagtactccagccggggcaacagtgagaatgctgtctcaaaaaaataaaaataaaaagtcaggatgatggctacctccaggattaaagggcaagtggcaccactggaaagaaatatacaggggttcttggggttaatggcaatttctaggtgaaagttacatgctttagtcattttatcatacatttagttttatgtactttcctgagtgttacttcacatattttaaaagaaaggatttaataaaataaatagccaaagaaagttaaatacctggtcccattcagaggagagagctgggcccatcacttaaaatgttagtaactggccccacccgggaagaatttccaaccttacctgaaacattagaggtgccccctctcactgaggcctatttgatatctggcatcagagataacttggtgatttcaaatagcagtagtagcaggccacagagatgataacagaggaagcagtcctccaacccacagagttatttaaattgaactgggcaaatggcaatggaccagaagacatggcttttcacgggagcaagcttgaaacttctttaacaaagaaaaatacaatatgtcaaaatagaacagaatagaatagcagtcatgtttcaacaaagagatgttttgaataaattcatatcaatttaatgtgcttttattatataaaccttttctctcttaactacaaactgctctttcctagcacaagtaattctgagtcatacgatgcttaacatagaaatttgatttaggattaattaaaagagtgatgcagaaatacaccaagttctaagggactaaagtataaatgacccataccaacaaatggctccccctaccttccttatatccactctccccaacttctccaacttcctctcctcaactccctcaccttctaccctataattggcctgccgtggaagcttttattaaaatcttgccatttaccaagaatgtgtaatttttaaatgaaagtggagaaagtcatgcaatgtcaagaacagctctggcaagctgcctgagtcagtagggaatatagaaaggtcagaaatggtgagtgggacaaaaatgtcttgggggaagttgtggttaaactaagtcttgaaaaaaagcgggtgcattttagcaagttaaggctgtaccggacagctatgtcatcataagcaaatctatcaagatgtaacgtagcagggcatagtgggaggtcttgcctaattaagcctggctggtaagtgaggaaagggagacagtgagaaatgaagatagagaaatagaaccagggctcaaacctatattggcctagctccaaaaagcacatgttcttaatccttaatcctcagtcacctaatcctaattcacaggcaagagctagattgcagagggctacccaggccataccatgtttggattttaccctgtgggcttgagagtcatgcaggacagtaatgtaatcagaggtataactagaaggtgactcaggagcactgtggagagtggagaggaacagggcaggaccagaagcagagacatcagctgggaagtttcgtagtaattcactgaggcagaaatagccaggacctgcaaatggcaccagcatcagagatggaaaggaaaagataattccaggaagacttctctgcgtctggcccattttcctgggaaaaaatcatcagtgtcctcagatatttgaagtgctttttggggcaagtcgcagaaggcctgtatagcaatggtttagtaacattttgctcaccttctaggattttgaattcttctggtatcattcctcatttctgactctatatgccctactgcaaatcataaagaaatactaattctctaaaatatttttctacatgtgcatatcatacacaatgctttaccttgtttttttcaataaatattatgtctgagatatcattccatttcagcacaaataaagaactgcctcattcctttttgaggcagtatcatatcctattttaaagatatgctctaatttatttatcccatcttctatagatgtttatttagcttgtttccaatctttggcccttacaaacaatgccccagtatccccaaggatgttcaagatatccttgaatatctctccttccacacacggggaattatatctgtagtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgtattttgtcttcacttaaggaattgttttctcaatattttgtgattaatatcactagcatatttgggataaactgaaccagggattgtatcaaacttgaagaagatgaaattcaaaagatgatcagaaattccaaggtaagagaaaagaagcacgtgaaggtctgagaagagcaggtagaaaatggagagatgattcattgtaaaacaccaaggaaggttctctgaaaatacatagaggactgatagaaccaacgtctgttgatgagtgaatagtctaaccggaaaaagaaaacatttggagtcattttataccaaaagagtggttcttggcccatgtgagaaatgctatatttctctcaaatcattttcgtctgattcaggaaaagtgctaacagttttctattgctgtgaaacaaatttccaaaaacttagcagtttaaaacaatacccacttattatttcagtttccatgggttaggattctggcatagttgagctgggtcttcttcttagggtgtcacagtctgaaattaaggtgttggctgggctgcattcatctggagactcaactaaggaagaatctacttcttagctccctccatttgttgacaaatttgtttcattgtggttgtggaattcatggcagcttgcttcgtcaaggccagcaagggagagagtctgctacttcaaatctgtcacctccaaacctgtctttaaaggactcacttgactaggtcagactcacccagaataatctgccatttgattagctccaaatcaaataattagggaccttaattatatctgtaaactcccttcgccttcgcctttgtcatataatgtaatataaaaacaggagtaataaaagtgatagacctttgtcctttgccatattctgttggttagaagcagatgacaggtcctgtttacactaaggagataatattacacagttatgaataccagggagttggaatcctggggaccatcctagggcatgtcttcctcagatggttatgtctctcctgaaatttcttttggttttcttttattctttcatatatgtatgtgtgtgtgtgtgtgtgtgtgtgtgtgtgtgtgtgtgtgtgtgtgtatatatatatatatatatatatatataaaatttcagacagtcttgctctgctgcccaggctggagtgcagtgtcatgatctcggctcactacaacctccacccccagagttcaaatgattctcctgcctcagcctcctgagtagctgggattacaaacatgtgctaccacgcctggctaatttttgtatttttagtagagatgggatttcgccatgttggccaggctggtctcaactcctggcctcaagtgatccacccaccttggcctcccaaagtgttgggattacaggcatgagccactgcacccagccctctcctgaaatttcttaaatcaaatcgtcatggacactttgggagtacatgtagccttggccttgactgatgggctctgtatccgttggcttttgctgaatagccaacaaccacagggcctaagtagaattcatattgcttatgcatctggagtcaactgagtgtcaactaggaagccctgctgatcttggctccctcacatggcagactgataactgtggcaacccgactgctgcacatctgtctcatcctcctacaatccagctcaagtctgctctcaccctgattgcagagatgaaggagtaaaggcaggaccaattacacacattctttttaagcccctgtctgtgtcacattagctaacatgaggtttgtcaaagacgtcccctgggtgagcccagagtgagaatgcaaagacctgcaaaattacaaggaaggagcaaggaattggggccaaaaggccctaactcaataccagagcttcacctcatccccaaaatgaaaggaagatatttattgcttgaaacttagggtttctcacttggctaaactgtgaccaacttgatttctgtgctatttgcatcgaaaataataccaaacatgatgcattaatagaatagatgatgcaaaaaggtcatgcataaaaaaactcaacaagagcaaaaccactcagtataatgaactcagaactttatgttgggtgattccagagatgttttgttcccagaaaccagttgccataagaaaagaaatgcaaatggcttagtgaagattatcagcctttaacgcatagatgccagaaaggcccattctcccaggatggaagaaaaacagtgaaactgctggtgctgaccaaactgggatactctcaccgggttgtttgtatcaggatgtgttcctcccttgatgcccattaaaccagaatagtgaagtcctaatgcctacaggatccatttgcgacaaagaaagaattcattcagataaaaagctaaccgataggcaaagattttcaaattattttcttcttaaatatttttcacatttgtagtgaccaaaggagacctggatttcaatcttgactttggacctcactagctctgcagtcttgagcaaattatttaatgtcctccgaatccgtttcctcatctgtaagaagggatagtgttttaacttcacatggttgagataataatagtaaacaccttagtcttgtgtttgccacagtggtagcacatagatattcaaagttattattcctacaaaaatacggactgtactcaccccataattgcattttaaaagaaagaccagttttgcaattttccaggattatctacatgatagctttttacacaatcagtatgtgaaaggctttccttgaatgatgttaaataatctgtcctattatttggagaagtatcctttgcagatgttgtattgcgtgacaaggtctaatggtaaaactctactgaaaatgagaagatataatgctcaaaacctggctgtagctccttatatcactagaaaatcttttactgtctctaggtcatggttccttcactcatcctaataaattgtagttaattgccttcaactggcgttagtgaaggagacttagataatatctatggagctttttcaatcttacgaaaaggccctcactaatgaaatacatacattcaaatgcaaaagtaatgacattaatttttattttttatttttgttaatagagttatgactatagatgttaatgaattgcttatcaataactagatatttatttaattttacaacgtttgccacgttttctctaaaactacttttgatgcttcattttaagtcttaaattgggtcctttccccagcagcctattcttattcttagcagaaatcaaaagctgcatttttttcaagccttaatggctaagtagttatctgtttttaatttattgtagtcacttagaaaacattcatgaaaattattaaacatatactatttttacagaggagaaggaaaggaatgttcacttctgtccagtctgttggaagagacaaaggatgttagaaaccagtgtgcagcctctcctaagactgtccacatcatgtgacatttttacacataattttttgtggcaagatgacagttgccatacaaggctctgaaatcccagatgtaattaagatcttataatgagccacattatgtagggaaatgcttctaacccattgtgaatgaaaaaaaaaatgtataaaatcaaaaaactcaattaattaggtttcattgtggacaaattattttccaagctccgttgttattttaaactgagtcggaggaggtgaatgttggaacaccctcaaagatgactgaaaatgagtttggagaaaagtgaagtttcaatcaggatggttgtgtgggtgtttcataaagagatgaataaagcctggtcaagagtcctaacacagtggggtgtcaaggcagagaagtcttgcttaagcaaactcagtgccatatgcaagaagttaggtggtgctggcgtaagaccaacaccggtaatggtgcactccaagtcaccccacttactccagcccccagaagaaaattgtcaatgttgctttcctggcatttttaatcaacttctcaattattatcttggcaataataataacataaaggtaaacctaaacagtaatagtgtttgttagtattcatgaaagtagattgtcccagtataaagctaaccaatgaaattttactacttcataaacattttgttcttttaattttcaaggaaaaaatagggacctcttcaaaataatcaggatagtcagagtccctttttgtttggaaaaggtttctgaaacataaaatctttgttgggttaagactttggattttaggccaagttacagttttcagcaatttcagacatctgctttatgatgttactgaaagcgttcccccaccacattaaacccagcttttgggttgtacagtgatgtaaagtttattgaaacatttttacacttgctttctttgaccacaatagtcatttttttgtaacatattcaattaaacaggaacagtataaaggcagtgaaattgatacgattctcatttgaatctactgaatgccttaattgttctcattcgtggctgactgccattgacaaagatctaggaatatgagtacactatcctacataatagaaaagctaattttttgttttattactactgtaataatattaagtacctaaagagagttataggcctcttggggcccagaactcagagttcaaaatgacccttctttgattggatcaaaatctaatatttggctgtggcattatccagaagtatggagtttattatagctatgttcaaggaaaaggtaaggtgaaggaagatcagaagggatatatagtaaggagattcccatgttactaaactatttgtggatgttttcctgcatcatatgcaaatgagaattggtaggaaaacagagggctaagaattagagaaaataaatttggggaggagggatggattgtgcctcttattgctctgctgaatctccaaatataaacacacacacactcaaacccttctatgagtcctaaattacattcttgcttcaagctggctttttcaaatctggcagtccactggcgaaaatgtttgcaggttagagaaaaaaaaaaaaaaaggcaacagaaaattcacaagaccaaatatgtgtgtgtgtgtgtgtgtgtgtgtgtgtatctttagatatctttagatgatatatacatacatacatatatatatatatatatttaattcactgatgtgtacttgaaaatattatgcacccaagatggaaatcatataaggtgaatttttcaactgtgacaataccatgaataatttttaactcaaaagatggagtaagtaagtattcagtaagattcaaagacaggcttcgggagcctgtgactaccttgaaattctatgcatatatttgtggtttggtgtgtatatgcatttgtgaatttcttactacagaaaggttttattagattatcaaagaggtgagaccaaaaaaagattaagggactgcttcttgagaatctggtaaagtataagttgcctcaagatcaaaggaactaaccctttgacttgcaaatcaattgaaagaggagtggggtggtggctttggagtcctctggaagtggagggggcccagccctctcccagggatcagtgaaggaaattcaacagagtcaggaaacttcttgacagcctggtcaccaagggtttggaaaaaggttctattggagtggagattgatgggtggaaaaaggagagaggggagttggacctgataccaaagagatgttttcagccatcaaccagctgcaaaacaagatgggcttccttttcctacatattcttccaagcatcataaatactcggtctgctccccaacccacatcctgcaggatgcagccagagcaacagccccactccactctgaaaccagtcatcctagggatgatgatcatttcttagcttccctgttggaggtcggttggggttggctgatcgctgcttggttcactcctgcactggctgggcgttggctgcatggtaaagctgttccctgtctcatcctgttgggataaacagagtatcctaggcatattttctccagagcagtggcagacacaaagggtcaacagaaaccctcaaggttttgtcatgcctactcttgcaactagcacattgtcatttcagcctcatgctattgaccaaagcaagtcacttgaccaaattcaaagccacatgacagggaaatatattgcacctctttagaaggagcacctgcaaagttatttgggcctggatatacagggcagggagaattttggaggcaaaaatgcaatctgccacatctacgttagtgaagtcagtttttcgtacatgactaccaagacaaagcacttcacttaccaactctattcaaataaatggaaattattcaacctaaaattatgcaaacattgctccccttgtgccaaagaactgcaccatgtctgattggctttgcaggtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagtaagtgctgtgaactcaacagagctgtcatgtcttatctgctcttctttcagctgactctgtccccctttcttttccttttctctgtcttgggtatcattgacagccccccaaaacaagtaaaaagccagtgtggaataatggaatttgcatcagatacctctaggttccaaaactgattctattccttcacagccgtgaggccattactctctctgcattactcaattttaaaaaattgagtcttctcattttttaaataaatattcctggaggcattcttgtgagaagtagatgatgtatatgtaagacctgacacacagtaggggctctgtaaatggtggatagtgttatttttcatagcagagtagccaactaatcactcttcagaaattcttttattctagaaaacagtcggagtctgtggttctcaatcagggacacttcttcctccccctccaccccaccctaccaggacatttagtaatatctggaagaggtttttagttgtcacatctgaggtggatgctaccggcatgtagtgagtagaggccagggatgatgggaaacatccccaatccacaggacagtgcgcatcacagagaatggtctggcctatatgtgtgtctcatgatactgtcatctccctctctctgtccacatgtgttttgttttatcctctcttctttctttacatccttttgatctaggaatattatgttatgtaacatggtgtttatttgcataagacctcccaagagaaagcaaattggagtgtgtcggtatggcgccatgttgtgaggttgccaggcagtcaacaggaacaattaagtgcttttcaaggggaaccctcatttaacctatatccttgtttctcagtacaagtgttgtatcctagaggaatgtgttggatcctagaggaagaacaagggatgtaaagagagcactgaattacgaatgagaagactgtggctttcccacttggtacccatatagctatatggctagtttcttcatatttttaaatagattttttattttggaatagctgtagatttacaggaaatccatagataatacagagagttctgtacacccttaacccagtttgcccaaatattaacatcttatgtaaccttggtacagttatcataactaagaaattaacattgatgaattactcataactaaactccagactttattcagattttaccagctttccactaatgttcctttcctattccgggacccaatccaggatcccacaatgcatttagtgttccttcagttttaaaatgggaatattttaacaacttgagggttgttatgagttgtcaaaaagaccctctcaaagtaattctaaaagtacataagagaatataacatgatgatatatttctttacagtcatacaacaaatggcacaatacctatgcacacttagatcagcattatttgatttgcatttgaacatgtaaatatttgttccttcaaaagatatgtttgagcaccaagtgtgtttgggatgctgtgcaagatgctaaggatattatgagtatcttcaactccctaaggtgtgcttctctctcaaaaaggtcctagactattggggaataaagcacattaatcctaattaacattcaatatgtgaaatctctgactggaataaccatgagaggttctaagttgacaaagccagggtgccccagcacaaccttgagaggctttccaaggtaggttaggagcaggggatgtgaggacacagtgttccatgcagaaggaacagcatgggcaaaagcccagagacaaggagaatatatttatggaacagaaaattgatccatgtggttaaagtgtgtcttaggttgggaggataggtgagccaggaagctggagacaagaacagatcgcgaaagcctcctgggccacaccagggagtttctttgtataccaatgattggtggagagattgaagagtttaaatcaaacaggcaggatgaaaatttccatgaaataaagctctcttgcactatgatgtggtgagtggattacaaggaaggaagactggctgctgggcacagtatcaaaagattattgaaagagttgtccatgtaagtaaacaacggcctgaataagagtcgtgtcccatacaaatattataatgaattgaattatttagtaaagtaagctattaatctctttcttgaactaatttgtcttcactgaagcaaaagccttgaatttgggcagagtaggtagtggtttatttgggaaacatatctgaggcatgggcagaatttgctcaccaagattgcatgattctgctccacacatgcgtgggtgagggtgtgagccaaggcaggcaggatgtttgaggcagtatgtcaccatcacaaggccggtctttccaatggctctgacattctgatatatctcaccggaaggaggccgagcagaacttggccttcattgtaaatgatgggcgccattaaggaatttcttcctgctctgcccattagtatcctatcaatcatttttaatccatattctaccttccacctttaaaaattgaaatattttaagcaaaactgtcttcatactcttcttgtcttagttcatagtttatctctgatagttgctagcatgatcattcctaaggacttctttttacaagtcaaaatttaaactacacatgtaatccaatagatcttacggcctctgagaatgtccaatccctgctcagcccttgagggttttctctgctccccctttaaagcttttcttttcttttttattgttatttttttgagacagtgcctcactctgttgcccaggctggagcgcagcggcatggtcttggctcattgcaacctccgcctcccgggttcaagtgatactcgtggctcagcctcccaagtagctggaattacaggtgtccgccaccacacccagctaatttttgtatttttagtagagatggggttttaccatgttggccaagctggtcttgaactcctgacctcaggcaatcgagctgccttggcctctcaaagtgcaggcattacaggcatgagccaccagcccagcctaagcttttctttgatatgtacagaaatagatttctaaaacaaaagccagctaactatagctcaagggccaaatctggctgcctgattttgtaaataaagttttattagcatatagccacacccattcatttacctattgtcctgtccgtggctgccccctcactatagcagaagagttgaatagtcacaaaagagaccacatggcctggcctgcatagccaaaaatatttactgtcaggccctttgcagaaaaagtatgctggtccgtgacctaaaaagaaaggattttagaggtgctggtgttgtgttgtgtttgtatccaaaaggcaactggaaatcctttggcctacccacatgtgacaacacacactgtcctatactcactgggtcagtttctcgcccagcatcgtgtattgccacagttgaatttactagaccttttcctgtgattgagagctgtatactgggcagaaggaacctgccaactgcaacagtgactgtggagtttggacaccatggcatttgtatcaggttgcaatgcatttcctgcctttaaacgccttgtacccaatgcagtgttgaatgacaggcagtactccaaaccaatattgaattgtcaaagaagaagtaacaactatgacaaaatgtccaggtgtgactctgccaagatttttttaatacttaaatctttaagacacaaatgtgagtaatgaaatagagaaggccttattatatataaataatttcatgagtagaaaacccaggcattgctatcacattttttcctaattttgtggcctgaaaattgtattctcatcctaaattcctaagagtaatgctttaatttttaataatctcagaataatataaacctctagaatattctatatgttaagacccaagatcttgatttgtttggtttctggtctgaagtctattgagcatgaatgcatcttatgctggatagaacactgcagtggttgaaaatggagtcttcattcattcctccttttcaggatgctatccagccagtatgtacctgtgctgcttgtatacacctggaatccgtgaagctagctcaccctatgttttctggctaagccttatccatgctgttgttgaatagttggcatgccaccactggatccctatcttagaactggtagactgaaagcttatgaagacaggaacatgttctttttcactcttactgtgtactgtactatacacagagttgctgctctctattgtcttttgaatattatgaaaactttgcaagcaaatgtctttgaaagttgcttataatgtttaaattactattaaaatataagataccactttgtgataggaggcatgactcagggagggctggcttgttcctgtcttttaaacctgattttgaaaatatgctattggttatgataaaataaacaatcctcttcctcttcctttttctgttttgtgaatttgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtaagcaacttatttctattgtcctgcagttataaaaaggcacatctcattctgtacttagagagtcaacccatactgtaatgcatcttaaagaataaaatgcagaaaagttgtattagtcagctcttgctaggataatactgcataacaaacacccccaaactcagcagattcaaacaacaaccatatattactaatacccacacctgtgggttctctgttcaagattatagagctctgatcattggatgagctataccatgttaacactgctctttcatgccatgaaacatgggttggcaaaccacagcccatgagccaaacctggcctgctacctggttttgtaaataaagttttatgggaatacagccaggtccatttttttacatatagtccatggctgcctttcagccacaacagcagaatcgagtagttaagagagaatcatatggtctacgaagccaaaaatatttacttactttctggtcctttccagaaaaagtttgccattccctacttttaaacatcactcttcatcattacacaaaactaatttctgttgccttgtatgttttatggttctagactggaccaattagtgcaaatagctaagggttgaatggtgggggtgaagcagtgatcataggctgggaataatttcaaaaggcctgttagatccagcccagtgactttagcccactgagttctctaagaataagggcaaaggtcaggacacaattacattggaattagttaacctcacaaagttaaccttgcctaatccacagccacaactgcacccctttgaccgtctgtctcacaaatgcctgcttgctattgatcaaaaagggagctattttatttttatttaacaagccctcatatggtacaagtatgtgccaggcactggtctaagcattttacagatgtcaactcatttattcagccttacagccctacaaaggtaggtgctaatattatccactttactgatgaggtgactgaggtatatgctgaagatcacagggttacaaagctcacaggtggcagagtcagtaagtctgcagtcaagggtcaggctcttaaccagcagtccacaaacattatctgtaaagggccagagattcaatatttctggttttgcatgccaaatgatttttgtcactaatactcgactcttctgttgtagtgggaaagcagccacagacaacacctacacaaatggacatggctgcgttccaataaaacttcatttataaaaacaggcagagggccagagttggcccctgggtagtagtttgctgttccccgctcttaaccaccatggtatgctgctattcacaaaagggtggtatatttttgaaatgctataattactctctagggtttatgacagtgtacgtaatgagtgatagctgaatccttgctttaaaaaataaaatcaacattcaaaattgcatagcctgaagatggtgagtataacagtgtttctttcaatataagcatgataaaacacttatttatatataaaaaaacctttcaattcaaacctatgcaaataatgtgacatggctgagtcctttatattgtaggtagaaattagccaaaaatctaagaagtgaattgtaagcttcccatctctcccaataatggtacatactatattggctgagcgagtaggttttcctttgttgctatcctcataattctctttgcctagaagagttttctgttccaacatcctgccagaggatggaggacaaatccttcaccccactaggctctgggctagattggcatttgcaatttttagctgcagtggggcaaaattaaagcacaaaggaaaacacaatggatgcaggtacaaaaaaagcaaatgtttctagttaattaatgtgctgtattaatctgggatagaatccagggtctaaatgattattactctattaataattaattatgataaatgaaacctgatcattatgatctcattgccattgatgaatagtttgcaaaattccatcagaccacttcagttatataaacacacatcagcattaccttgaaaacaccctccagatgtcaaaactaactcatgagggggaaaagaaattctaaaattaattgctacacaattaatctttacaaacctgacggtgtcaatttcagaaaaatcttcatgtagaaagtcactttacatttccttggggggtattagcaaggaaggggcaccccctacgattaaatgcctgtgacatcttgacttgcaacagctaatgacatatttgcttatgaaatatagtcctgactttaaattgatgtgtacattatgatctgtgcaatggggcacgttaacattgctccgagagacataatttttatactttgaattctccgtgtctcactgcgtaacttaatggaacattacattctgcctgcacatttcaagctcaatggaaatatgtacctagtttcacagattaatgatactataatggtattttcctttgcttaatggactatacacttagtattttcttactctctaatgctaatgtgcacttggtgttttatgaaatggtgttaactaaatgagtaataacgggttcatgcaaagattattagaccagaaggggtgggggcagcatacaactctggattttgctcccaattttaatcttctgtttctacttgctacatgtagtcagccatacctgccacagctatttcatagggttcagttaaggttcaaatgggaaataaacatcaaagtaataaaaaataaaaatgctgtgccacaacaagaaggaaacaatacagatgtggtgattttgtgatgcaggttccaaattgtctgaaaagcggaaatagtattcactggggtatacagaacatttttggggggtgggagatactgacaattgcaaaatgaaaacctttccaaaatgtatgtattagtctgttttcatgctgctggtaaagacataaccaagaccaggcaatttgcaaaagaggtttataatggacttacttacttacagttctatgtggctgggaaagcccacaatcatggcagaaggcaaggaggaacaagtcccgtcttacatggatggcagcaggcaaaaagagagcttgtgcagggaaactcccccgttttaaaaccatcagatctcatgagacttattcactatcacgagaacaacactgaaaggacctgcccccatgattcaatttccttccaccgggtccctcccacaacatgtgggaattcaagatgagatttgggtggggacacagccaaaccatatcagtgtatcaaataaacagatgacatttgagaccctcgatgcatgccacagaagggagccagaagcttacaggaccctggaagggctggggcatgaagtcagggagtctgctgctctagttcatggagtcatgatgagctgtagctgctgcaaagttgcccacagcacaaggcaggtgtactcaggcgctcatctagaagcttccaccaaccgcacgtctactgtctgccatcaggaaagcgtgtttcccctcctctaagcacttctggatcttgtgcaaaggcatcacaatagcagagcctgacccagactcctacaggaaaggggattctgggaaatgcaacttggattctcctcataagcaggagaggatggacgggagggaagagaggatgcaacattgatgacagacaggcctgcacactgggcttggcagattatcaattccatccttcttttggatttagtgatggcatgttgtgttaattttctttttaaacaaacacaccactcttaaagtgattgtattttaagtccagtgtgattttttttaaagaatgtcattttattaaagacccatgaaatttttctctctgcattgggtaaggtaccatatgttaatatccaattagactggtttctgctataacatattaaaagttcaactgtgagtcatttactctttataaagagtgatgggttttgtttatcttaataactgaaatacgatgaatattacagaggcatgactcagaggggtaaaaagagattaagatgcttagaacattgtagaaagcattctttggatttttttgagcagcaagagaacatttagaataaccagaagatccgtctgctcaaacacgttcagaattttttttccagtataatcagaaaggctcttggcagtgatgaactgcacaatttctggttacggatggcattgtagaatgtagttcgtgtttgtgggttttgagtcatcctgagttcaaattctgattctggtacttattgttaatatgtgccatcaggcaataataataaaataaatagcagttactgaatattacatgccaggtcctgtgcctgggacttaacatgtattctctcctttactccttaaaataacactgtatatttctcaatatacatgagaaaattggggctgagtaatgacaaaggatttatccctgcaaatgggaatcatcttctgtgcttgcccttggcaaagtgcattcagaatcagaaaatgacagacatggtgttaaatgaaaaattataagaaggtcaaaaggagaagtctagggttgtgctgtccagtatggtagctatgagccacaggcagctatttaaatcatttaacttaatgaaaattaaataaatttaaagttcagttcctcagtctcaccagccgcagctaaagtgcccagtagccatatgtggcttgtggttaccatatcgaggagagcagaacatttcagtcattgaagaaagttcttttggtcagcactggtctagcgaattcattgtgtagatttttataagagtgaaaaaaagcagcaaaactcaaagttcaaattctccgtagtgtttgagctgaaaacagaaatgtgggtaaatacgacgcttctttccacccactactttccacccactttccatgtttgggagggaaggagatgaggaacacagatgttggggttcttgccaagctttcacttaaagaaaatgaacagggacaacaaatgatcatgtttttataacccctgaggaccacagaacggatttaacgtgcatgtgcaacatggctcattgtttttgttgttgctgttttgtttccgcaggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggca

SEQ ID NO: 16937 - DNA, 82494 bp, Human
tgtcccgggaggtaggagtggggagggagctgtcctgtgcactgtaggatgttcagcagcagccctggcctctacccactcaatgccaggagcacacggctccttccacttcagttgtggctgccaaaaatgtcccctgggggaaagggagcaacatcaccccattaagaaccgctgttctaaaccttgtatgacatctgtagaaaactggcagataagagaaaaaatgtagaagattcaaagggataggaaagagaaatctgtgaagacaatggaaagagcctgtagtcccagttacttgggaggctgaggcaggaggattgcttgagcccaggaatttgaggttgcagtgagccatgatcgtgccactgcactccagcctgggagacagggtgagaccctgtctcgaatgaacaaaaaactcaaaggttattattccgtaactattgaaagaatcttttcatgaaggatggtaataaccagctttctatctccacacagagcaaagtaaaaagaagtaggtttaaatggaagagaaattaaaactggacatacagatggttaaatattaacaacggcccctgaatggcactttctttcctaaagatcttcatgagcagaataatctaggatggctagggattgttccctcgggactttgtggttaagaattcaggatcttcaagtaatgaaatctgcattaaaaaattagccaaaactgtttgtttattccataatcatgtctatatggtgcttttaagaaaacaatttttttgttgctataaaagcaatacatattcactgtggaaaaattagacgatatctctaagcttaaaagaagaaaaatttaaaacacccttaatcccactaaccagtgagataccatgtttgatactttagtgaattcatttcctaatagttttctgtgttcgcaaaggtatatgtgtagatataaatatattacacctacatagaaacgacggatcactcagcacataatgctttgaagcttccattttttttcccatttaatccgctgcacatgtctttttccatccgtgtgtaccaccgtattagttttaattcttccactgcacagatggcttataatttaaaacatcccctgtttttggagatttaacttgtttccagtgctttgagatcataagtaatattgcagcaaactttccctagtcaggggtttgcacaccgttcttccccccacccccactccccacaccccaggacaaattcttggacatcaagttgctggagcacatgataccaacagctgtagggcccggagtaattggcgaaactgtgtatttgtaaggcatttggtaggaaaaatgctaaacagaccaccaaaaagattgctcaacttacattcccatgggtggtattggtttttgctttttttggttttgttttttaatcttggctaaaatgacaatttgaaaggcgagggtggagggtgttcagacagctctctcattctgttgagaattgcttggcccagttctgggccttgtctgaattgccggtttgctgcaatgttttttacaattgagcaatcacctagaaaaaagagaaggtgaaactaacctactgcaaaaaaactgctccaggatgaagaaggttgcctgtatttcgtcatttcagccaagccggaatacggagcaaggctgtctgcaccgtgctaccatcctcttcaggctgcagggcattttgtatacccaccacctcccattgatgctggaaaatccggtcacagaattccgtgcagcccagcccctgagggtggggcgtcctgtctccgggacgccgggttttctctggacacgaatgctccgggggtaggaggcgaatgacactggcacggcggggctccggagccaagaggtgaccaggctggctgggcagggctgagtggctgggccgagcacgtgatgctcccagccggcctccggggccctccgggctgaaatcgacatttgcctctggcaggaaaatgagcttgtcagtttctgcctccattagaccctcaacccaaaggagcaggagatttcggtagcgttttaactttatctcagaatctgaaagcggaaggtaagctgcttatcactcagaaaaacaaatttgagaggagtgacctagtaaagtacactgcgactttgttgatttttaaaatctggtgttgaaaataattgatcgctgtgagagtcaagggctgtatttatctccaaattagagattaaccttctgaacagaaatttggttaatttggagggaatcacggtataagggccagggttaaatatagaaggacacgaaagctgatggaataaactgcaagtaaacttaactctaacctgcttgtaaaacaatctatttcatgtctccttcagggctgtgagcaaagggaatgttaaaattgtgatttttaactcaagtgaaagtaaatgaatctatttgcaattggaatacaaataaaagcagtctttgcttttgtccttttacatttcaaaaacgcttgtgtattttggcaaaagaaaagtttatatgtgcactgcttaagtttgaaatacgctatttcaaatttacaaaattatcacagttgtaattttctaaagtctttctaggcaaggctgtttcagttgtgaatgagaaatgttgacattgtacatattttctgtgatagtaaaatgactcacttcttcagaatgtgataaagattagaaaatgtgaaataatgagttattgtgaattaagtcatgtctcagagattaaatgccttgccagaagatgtaagaaaacagagacacaaatacaaccatgctcacgtagcagtgctttattttaaatcatcacatatttaagtaagtagtagaaatacgtggtgtcaccattttttcctttggcaaatacaaattaatattggaatgcacctattcagagtaattaaagcattattcatccgtgcaattagtataatgttccataatgaattgctttgaactaaagtgtttggtataatactcgatatacggcttgaaacatagaaactctaggcaaagtatgtccatgctatattttgtgtcattttgatttgcacaaaatgtttatttctccactgcatttgataaatactagttttaaaataaaacatgaaattgtatttcctttcactgtaatccctttattgctaattcttttgaaatcctattactcgcttggagcctgtaataatttggatttctcctcctgtgtgttgtttttcataattcttcgcgaaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtaaggggcgcgcggcgcctggatgccctccccggcgcccccggcagcgcggacgctgcaggtggagcccggcccgcgggcctgcagcccggctgcgcccccagaaacccaaagtggggcctctggctgctgcggcgcctgctgcccacagctgcctgctgcagctgcatgcacccggccggggatggcccgtggcaggcccacgcgtgacttgggtcttggcgtgcccgccccgagaaagcgggcaggggccagacagaaagacgggggagggaaaaaaccgctccggcgggggaacaaaatctgaagtgaccacactgcatgcattctaagtagacagaggggcttttaagaggtaactatcaagtgttttcctagtgtcattctgcttcttaaataacgacatgtttactaattacaggcctttgtcctcagtaattagcctcatttctttcaaagcaaaagcgggctggggagtggaaacttcttggttagcaatttaagagccagatgtgcaatctaaattgctttgcactattttgcaaggttccagcatttacagggcatacgtcagaaacgtatttttttttccttccaggtgttttaagtagattaaaaaagaacggtatccaatacaataaaaataaattgcagcttccaaagataacatgtgagcgtaagagacagctacatctctaagaaccaaatgatctttagcagagagtgggggtggagataacaccaaaacctaagaattcccagagttcttgttaattctctcgctgataattcgcttgctgaatggagaggcttgatgacagcgccagatggaggggtcaggtgacttcagttctagcatgacagtgggtgggggattttaatggactgtttctagagcgtttacatgcctttctcggggtcaggaagaaactacagccaggacgtgtgggggcacccttagggggagaatgtggcattattttcccctctaaaacctgacccttctggaagctttgttgtcactaaactgtattggaactcacatcatgaataatttgaccaaccagcaacgttggggggcctgtaaagcaatgctatttccatcaataattgaaggaggcatttctttcagaatttgggacacccagatgtgttgctgcagtaatttagtaacttgtttattgcaattttcttcctttggttcagtttggttacacaaattaagatccccgggtccccgccctcccttctcctccagcccaaccctagatagagcaaagcagatgatagaggtggatctaatacagacctagattccacttttggctttgtgactgtgcagccttggatatgtcatttagtgtctttgggcctcgactatctcgtcctcaaagtaacaaagggatttaggtcagggtgtctcaaccttggcactactggcatttggggccagataactccttgtggtgaggctgtcctgtgcattgtaggatgtttagcagaatctccgacctccacctactagatgctagtagcacttccccctcccagcccccagttgtgacaatcaaaaatgttgccagacattgccaaatgtcccctgagggctcccttgccccctgttgagaaccactgattgagatgatctcgaaatattcttcttcgggctccaagaattcattttcttatgattggtttgatgccaagcccttgatcagaaatctgattccctttcttaatatcacatatattggaaaacacaatgtgaaggcgtttttatgctgtgaatttccagaaatagcttctgtgaaaaggggaggagctgtttgtatgccatttgtagctgggaggcgagcttggcagaaaggagagtgttagggaaagaggaaaaaaacagagcactagatgaacgtgtgtggaaacctgccggggcttcgtgctcagcagacctggagcacgtccctggacgtagtctaaccctgggttagacctaacagctgagagtccatttccttgtctgcaaaaatgagaataacagtgtccactcggaggtgttgtgaggatgaaacgacacgacatctggtgctggtgggggacgtggtgaggacgagagggtggtaatgtctatgcagctaggaggaggcaaacacaaatggcccgcaccaccagcgacacggacactcgcttgggcagacgtggtcgcatgctttaagcttcagtccaggactaaagatctggctttgacacctaggagggtgaccgtggctgcatcacttcaccctgcagagctgctgtcggatctgtaaagtggggccaaccgtgcttgctgactctgcttccttggctgttggggagggatggatggaagtgagagggtctgcaggctgggaaactcccaagagacaggaagcgggggtggcagcagcatagcaagggggggacatgtttactatgtgtgtgtatgtggtggtggtggggtgcttagaatggccagaaaacatttccttgtgccccaggctttggactttgatgtgtccctcccctgggttccctttccgttgccatcagcttgctctctctctctctctctctctctctctctgtctgtctcatctttcctggcaccatgaaaatggtctcctggggggagataggaaagccctggtgggggaggttggccttcggtgaggaagacccactgtgcagagggctagggtgagagcagctggctccatccactccccacgccactgtcctcacaggcttcagtccacggacatcccagggcaggcctgtcacgctcctgtgtgcctccagtgggcttggtgctctgtatgagccatctggccttgtctcttcaacaaggtaatatcatgaaagaaatttttaaaaagggaggtggggtattctccatcaaacgagacttaagagacggaatagccaaatatcacttgtggccctcgattggattcggcccaaacaaacgtgtaacaggcattttggggatgcctggagatgctttgatgtgactggctattaggtgacactaggagactgctgctgctttgattagatgtgacagtctgtgatgtgttcagcagcccctcggacagatgcagtgatccccacccctggcagctgcaacttggcatcaccctctcccctggggtttggtctggaccaagtaatgaacttccaatgaatacgtctagcaaggggtgggggagaggcacttccaccatgagggtgtaaaggggcttctgcctggggtgtgttttctctcttgggttgcttacactgaagctgccatgtcgtgatcagccctacaaaagggtccatctgccgtggtgaggacccgaggtccattccaacagcctgagaagaactgagacccgctgacggtgtgagggtgtgagcgggctcggaggcagacccttcaggcccagttgagtctttttttttttttttttttttgagacagagtctcggtctgtcacccagggtgcagtgcagtggtagcgatctcagctcactgcaacctccgcctcctgggttcaagcgattgtcatgcttcagcctccctagtagctaggaatacagggacacgccaccacggctggctaatttttgtatttttagtagagatgggattttgccatgttggacaggctggtctcgaactcctgacctcaggtgatccgcccaccttggcctcccaaagtgctgggattacaggcatgagccaccacgcctggccgcagttgagtcttgagatgcttgcagccctgtgagacaccttgagctgaggcaccagctaagccactccagggttcctgacacagaaacagtgacatgatagatgtttgtgtcctgctgctatgctttggggtaagttgttaggcagcaatagatagctaatacatgtgtttatgtagaaaagtcttcttgtttagagatgtatactaaagtgtttagagatgaagtgtcatggtagcagtcatttactttttttctttttttgatgttttcttgagatctctttaatgtatgacttaataggagacagatgaattctcatacttggttctacattcaatctgtttcaatatcgcatgtcatgtagcctctggaaaattccattgtatgctcatgagagaatgaacttagaaaaaggcaaataacaatgtcagaatattgtgaaatgtttttgacatcatggactcccttaaagggacttggggagcccaaggagtccccagatgacactttgaagatcaggcttcaagatcaataatttacttttaaatggttcagttaaatgaagagagagaaagagataaagcagatagagccaaatgtgaacaactgttcagtctgattggtgttattcactggattcttctggatgatgttctgtataattgaaaatgttcataataaaaaattaagaaaaaaagaaaagaaatgtaaacccttagacacactggggattctgactgaataggtctgggggtgaagcccagggcttaacctgtgctccaggtgcccccatcacatgggccagaggccccagccactttgccccagaggtcctcgccttacctgcctcctctccacctgtcagccttgcagtagcagaccaaaggggtttagtgtgatgacgcatctcttctaccaacctgggggaagaggtgtgtggggacagtcccccctcctatcccttcccccatacacactttcccttggtaacaagacctttgtttaaccacattttcagtgggtggcttttttatgtgcaggaatttttttttttttgtgataagtatttttttaaatgactttcatttcttttctttttttttttgagatggaatctctctttgttgcccaggccggagtgcagtggcttgatctcggctcactgcaaccttcatctcccaggttcaagtgattctcctgcctcagcctccttgtagctgggattacaggcacgcaccaccacgcctggctaatttttgtatttttagtagagacgagtttcaccatgttatccaggctggtctcgaactcctgacctcaggggatgtgcccgcctcggcctcccaaagtgctgggattataggcttgagccactgctcccggccccttaattacttcttcattcagcaaatattccttgggtctgtgcgtctaggccagggtttctcaaccttgacactgtggacgttagggtccagatgattcatttttatggggggctgttctgggcaatgtagggtattgagccgcatccctggccaccatccactagatgccagtggcaccccatctcccagttgtaataacaaaaaatgtctctagacatggccaaatgtcccctgggggtcagtattgcccccagttggttgagtcctacaagtctaggcagtgggatacatgttaggaccaaatggacaaggttcctgccctcacgggactgatttgagctgagggaagaggaagtagctgttggataggctgtgtgttgagtgaaaggatggacagcaaaggatgcacagcactggactccaaacgctggtcagggagggcaagaaggcctctctgaggggtcgcacttgagcagagatccgaatggagagagagccacttgagcacggtgggctgagtgctcagggctgagggaacagccagtgcaaaggccctgaggcagggcaggacaggaagcgtttgcggaaagcagggagatcggcgtgtgcaaagtagagctacccagagagtaggggtggggacaggtgctcagaggggcgcagggggcaggccatcctggaactggcagttgtggtgtcaaccctggattgtcctcagtgtgatggaaagccactggatgctcctgtgtcggggagtgacatgttgagactgggttaaaaggactggctgctgtcaggagcagagtcagaggtgggtgagaaagaaagcagggcagccagcaaggaggctaggaggcgaggctggaggccagatggggagtggccagggtgaccaggtgagttggactgaggagctaacctctttagcagcaatgttgtcctaggtgccagagtgggcccttggtgatcaaagaagcctggcgtgggagggtagtgtgaactacagggcaggacatggaggctgcagacgtgtcctcatgcatccggctcagtcgcagcatcacctttgatgggcagtggcctcccagggacagcagaggaaatggccatgcacattcccacatgacacctgaaaagctctctttcccgcttcttgtcgtggctgaagtctcccaagctgtcaggctgccggtggctccggtgattctggctacacagcttgcttgctgtcctcgggcccagcacatttgttcctgccactgagtctctgaattggctgttctctgtggctggagggtcaacccccacacttgttcccttgttgccttctccaagtggccctggtcgccctgcaccgcctgtcacgtgcgcttctgcgggatgcagtggcctgcaatcgggggttcatggaagcccctgcctgctggcttgccatcttcacactgttcttgacgtggtcctgccctgccccagggcctttgcactggctattccctcagccctgagcactcagccccctcgtattcaacagagagcctgctgttggctgggttgaaagtagatgtgagaccggagccttcctcacagaggggacttgaacccctcttgaagctgcagaagaggagagtcctggaaggctggggtcaggcccttgacctgccctggggacgacacatgggaacagcagggtcatgaaggagaggctgtgggtgggcgctccccctgagggtggtgttcccctctttccatctgaggcagttggggcgcccaggatgggtttggggtttgctgatgtgagagctaccccaacgctgtgtttccttatgggggaggctgctcctggtcctgggtgctgggcctgcggctcctctctgtggctgccgctcccctgagccttgcccgcagtttcgcgatgcttcccgatgggctgactgtgtcctcctatctcttggctcttcacttcccttctgggttgatttggctaaatatgaaagttctttttcgccctccactctaacccctggaggtgctggttgggtgaaaaggcctctgtggttagcagatagccgagagattgttcctcttagcttagtcacgcatcacaccagctcgccttttaccccaaacatggaattggctcaaatgtcagcccgtgtgttggtcagagtggcctgcctctcttcaccgtggcgtcccgggccaccaggaacagcacatgaacgcggttttgggtgccttccagcatttaggctttacacacttgccagtcacgagtggctcctgaaattttctttttatccatgagggggtgtgaaccttggataagcagaaaataggttgttgtggagaaaacctgtcagaaaatggtgaagggaaggccaggctgtggaggtgccagaagagcgagggatttcccacctgcactgtcttcagcagctgtgatggcttgaactgtgtccccaacaaattcatagattcaagtcctaaccttcagtacttcaagacgtgaccttatttggagatagggccttgacagaggtcatcatggtgaaacgaaggcatcagcagcgcgcgtcccttcatctcagacttctggcctccggaactgggagaaaacccttttctgttatctgagccacccagtccgtggtgcttggttacggcagccctagcaagcacgtgcagcagcatttttttgtggatgcatgagagcgcgacccaggggcctttaattaagctattctcacacggtgtaggagaaacgtggcccccagtgccctctccatggaggcacatggctctgggtcctgaggtggcagaggcctgcctgctgttgtggagaaaggcccctgggacctgggctggatccagctgccccctcactgtgtgtgagacttaacctctgtgccgcagtttgcttatctgtaacttatctgtaacgtgggcctgagggaggcggtacttcatacacgggggaagtgcttagaatgaagccaggtacacggagccctgtacaaaggcgttgtgactattattatgggaagaagtctctggggaaattccaaacccttggctcttggcaccagcaacacaaacacctcacagcccagccctcctgtccctgggatgggggtgtgagaacactgaggccattgtgtcacccgaggccacatgtggttggcctcatcctgtttccaacacgtgggctgggtttcaacgtggaacgaatggctgcatggccctgggtccataggaagcctgccatggtcacacaacagctgcctagtcctatggaagccagactgtgattgaaggaacacagggagtgctgggggcagggccggggccggggaggaagtgggaggaggaaaaaggaagtgtctccgctggttcgaggcagaattttgaaacaggcacagtttctttctgaacatccttttgctctgagcttccccctgtttgaaactccttggtcgtgtggccctccacccctcactgggggccaccacctggctcccgtcactgtcagtgccttcctgtcttctcccctctggtgtttggagggttagctagaaggggtggaatgagtcctggccacctcatcatcctaaaggtgtccgcattttaaaagcaagactcaaaatgattacaaatgaaaatgaaattcctggggtttcaggcaaggtggaataaggcagtgaaaagcttttgtattggagccagcctccaagatgggcctcgaccatcctacctccaggtgttcatgctcatgtgtggtcccctcccatatggaaccattcagggctgacctgtgtcaccaataggataccgtggaagcgacagtgtgtgacttccaaagctaggtcattagagaccctcctggttctcttggaccaccccctctagagaaagccaactgccatgtcgtggggacattcagggtatcctgtggggatgccagcgagcaagttggttgctatgtgagggagcccccgtccaactttcagatgacagcagccctggctgacatcctgaccacaacctcctgagagacgctgagccagaaagacccagccacactgctccccacttcctgacacatagaaaccgtgtgaatggtcagtgtaaatggtaattagtgatgcagcttcagataactgaaatgactagtaatggtccaaagctttcttggaggggaggcccagtgctggtctctccttgggtcagctccccaggctctggccatagctgccttcgttttgccccttctgaagctccacttttctctgatcgttccatatttgttcatggtattttctctctctttccttcctaggttggagaggagaggagcttcatgcaaagtttaggtctattgatgataaattagggcatattgaggatgagtttggatatatagatttttagtaaatgggcaacggtctgtatttcatgaaaatgtatatcctgtgtatctctttatagcctggaggcttcagtaaaatattccccaaatgccagtggggtttggctgtctgggcgttactttgggcattcggcctttgcagatgcgggatgtcatttttgatgcgagcagcccccttttcctccagcaccagggaaacacgccacagcctgtaatgcaatgtggagcccgtgtcctctgcccgctgcacaggggatttgccaactccagcgcctttgctttgtcagggctttcagacttctgacctcaattatttcagtgggaggtcatttttgcaagagaggatgcaatgggtgtttgaaaagagaaagtatttcacgggcacttcaaagaagtgttgcaagcatgccaatgaaaaacctcacttttgtaaagtgaagcagtgagatttaactccagctgatggcttgtttgggttgcctttggtcaacttttaattgaaatccatgtgcagaaaagtgcacaaagggtaagcgtgcagcttgatgaattgtcacaaggtgaacacacctgggtaacagtgcccagatccagaaatggaacatgaccagttcccagaagccaccctcatgtccccttccaagggtaactgctatcctgaataacgccactggttccttctgcttgtttggaactttatagggatggaatctcggatccctttgtgtctgcttttctttgtgtctttcttttacttgacattaggcttgtgagcttcattcttattatgggatggagtggtacctctttcctcctcatagccctgtatagcctaatagctttctttgtatgtaaagtgtctcttttctgtcactgcttttaagagatcttctttttcacttgtttaacagttcgattatgctatgccttggtgtagttttcttcatttttttgtgtgtgcttggggtttgttgagcttcttctatctgtaggattatatagtctaatagtttaaatctttgtgtaaacaagatttcctatattgaatgttctggtcagtgtatctacatttatttccgagaaacttcttgagagagcttaaagggatttttaaggcagtttccctctcaagctgtcacctcctccacttggataaaaacagtgaaggatttgtcttgttgggctgttaagaaaccgtcagcttgtggtgattttagcctctgttatgggtccagagtccactccctcaggctccattgattctgtgtcgaatgcctgtggctggatatcaggaggacacctgtttttgtcagcccaactcttttcatgagtgaaaagtaacaagggagacaagatgaattcagaaaaacaaacaaacaaacaaaaaaaaccagtaaggaaaggcaaggtatgcccctcagacaggcattgctacaaattattatcatgtctttaaaaaaatattttctgtttttctttttaaaattttttaattttgctacaaattataaaactggtgggtgatggtggacgtttcaaaaccactcacgtgtgacatggcagtgacttcaggctggcctacatagccttttgttctctgtacatgtacagataaaaatctttcttgattctttttttttctttttcttttcttttctttttttttttttttgagatagagtctcgctctgttgtccaggctggagtgcagtggtgttatcttggctcactgcaagctccgcctcctggattcaagcgattctcctgcctcagcctcctaagtagctgggattacaggcatgcaccaccatgcctggctagttttgtatttttagtagagatggggtttcaccatgttggccaggctggtcttgaactcctgacctcaggtggtccacctgcctcggcctcccaaagtgctgggattacaggcatgagccaccacacccgccctcttatcttgattcttgagcatgtctgtgcagtgatgtccaaagcattcaatagctgactacttgatagggttttatatctattgatggatatagtattaataacactccctgtagaatagaggtagtatgtgtgcctggctaagctttttgtggcttagtggacactatttctatatagcaacattcagcaaacacttcattttatgcaggtccggatagtaaatagagatgagtaacataggcctttgccctcaaggagctcacagccaaatatgggaggaagcatgtttgtaaataatcacttgaacaaaatgcagtttctaaataagattgatgttaaaaatattaatataaacaatattaaaattttagtgattaaaacacaatggcaaggatgcaggtcatgaaatgagtggaaaataggaagggaacaaaaggttatactaggccagtggctcttaatgtgcgcccttggatcagctgcagcagcctcccttggaagcttgttagaaatgcagattccccggccccatccaagccttgccggatctgaagctctgagggtgggacctgacagtctgggtttccccagccctcctggtaatgctgatgcacgttcaagctgaagaaccactggtttagacggtgataagccaccagggttctgtcgggaagcctaggacaggccattttagtgcccacgttgtcccctaattgccagaagcctcagcacagcttggacccttttgttaggggactgatgtatgtcggcaatcaataaagtatattagggagtttttctgaattttttttgagacagcgtctcgctgtgtcacccaggctggagtgcagtggcgcgatctccgctcactgcaacctccgcctcccgggttcatgagattctcttgcgtcagcctccagagtagctgctgggattacaggtgcccaccaccatgcttggctaatttttgtatttttagtagagacggagttttaccatgttggtcaggctggtctcgagctcctgacctcaggtgatccacccacctcggcctctcaaagtgctggggttacaggtgtgagccaccgcgtccggctctgaattcttaaatgaagggaaagttttactttgcccaactagtacagcttactactttatttcttttatggattgtgtttttgatgtcatttctaataactgtttgcctagccctaggttttgctcatttgtgtaggagaggtaaagatcactcacatgggtttacacaggcaagggcataactggctgaagaaatataaaatgccatgtgatgctgccttcgtttgggtccttgcagaagtggaacttgaaattaggtttctggtgcaagttgatttgggaggggagtggggaagtgagaccaggaaaggaaggcagccattagggccgggctgttaatgtcacgcaatgggcgactggagcttaattccacactttggaaactctaggaaatggtgctcgctgtgtcatgggcccccaagatcacctctgggtctggtgatttcctaggagggctcataaaacttgacacatggcatatgcatggctatgatttagtaaagcaagaggacacagagaaaaatcaacaaagggaaaaggcttatggggtgaagtctggagaaaagcaggcacgtgcttccaagagtcctctcccagtggggtcacacagaacatgcctactcctgcccatggtgagttgagacaacatgtgtgaaatgtccaccagggaaggtccttagagactcagcgcctgggatttgtattgggggctgctcacataggcaccctctgcctagcacacatcaaaattccagactcccagagagaaagcaggcattcagcatagatcacagtatttggacaaagagtttaggcacagtgagccactcttaccagctctgggaatggtgggaaccctcccaaaatacaaattcccagatgccagccaagggccaaccttgcaaacaggcctttctaaggagagcagtctcaggtctgctatattacgtgttttctgcacaggtacaaagcacatgccttgaaataatctcattcaagggacaagggagtaggacatttgaagatgtctggttttctccagactttgccccgcaagccttttccctcgggagtcagttcttgagagtcatcgattaatacctattcccaataatgcacttcaggcatgccatgtaagcagagccaccttctgtgggtctcaaaacaatgacagtgaccttagactaagcgatatggttggaaattagctagagcttactggaaggttttgagtgatatgagtggggcgctggcagcatcagatacagtagttattctagaaattggatggggacaacagagccatgtgtatagggtagttcgcatgcctggggtcgtgtggcagtattgtaactgtgaatgaagagaccgaggtcaaggcttcgctctaacctccttaggtagatgcttccttcctgtgtctgctcattggaggaatgggaaagtgtgtgtgtttgtgtgtgtgtgtgtatgtgagagagagagagagggcatgcgtgtgtgtgtgtgtgtgagcattgtgggggcagaaaatcctggtacactagctgtattttaaacttccacttctaatctttcagttctgagcagcgtgaataggcagataaacaaatgtttgctatagcctcaaacattcatgccagaacatttttttccctccttccacacaagtaaattaagagaacagcggtctgttgtataatttgaagatggctattaatttgtgttggattgcatttcttaagcatgttatgttattcgaggagcaggagaccctggaggaggcgcttgtggggaagctttgaagctggagcaggaaggagtgaaatgacacagtctgatgacgatcacggtaatgcaggccttgcagcctggcgacattcttcaaaggcaactaactgcaagactgccctcttcccctcccctctcagacatctccaagaccctgccaaccgccagatgaaaccaatcttcctagagcctcgtgtggtggtctcaggcatcgcttgggagtgccttagaaattcggcgtctcaaatgcagtcttgggccacaccccagctctccaggatcagaatctgccgtttaataagaccctaagggatgcatggctcatccaagtcggagtcagatctcacccgaggccgcacattggcagcacctggggagcttttaaaaatgctgatgcctgggcgctgcctcagggaccccggtttaatgactctgggcggggcctgctccttgggctttctgaatgctcccacgtggttcggctgcgcaccccgggctgggaaccgtggggttccctggcagtacccttctggaattctccttccccagcctcccagtcacgtgactgcttaatctcctccctctgtggctctttctctgtcctctgctcctggctccccgatttctgaaggcagcccggtctcttttctttctttgttacctcctggccattctccaaagtgcctctgcgggggcgggagcttgtgagaaattcgagcctcagccatgccccagacctgctgaatcagcacctgcagtttaaccagaagcccaggggatgcgcatgtgcattgtcatatgagaagcgctggtctaggtgacgtaagctgggaaagaaacccagggaatctgctggaatgtagggagcctgggctcaggaactggaaggcgtctgtctgggtctctggcttgtttgttttctagctgtctcaacttgccactgtggtcatttggggctagatcactcttctctgtgcgggtcgtcctgtgcatttaggacgctgggcagcatctctggcttttacccacatcatgccatagcaatccccctccccagaggtgataaccaagaatgtctccaggcattgtcaagcatcccctgggggcagaatggtctctaggggacactttggtgtctgcctctggcctcattccctcccgccatacacccttggtagggttggtggttccaagttagccactaccgtggaaagagagacttcctttctccccctcgtccatgtgtgcggccctgcatgggtcccacgctcatccccatagccggtcattgtgcctggtggtcggggcactgtcattggccagattgggttctgtgccacatctggggccaggggccagctttgttagcaattgaaggagactgggagagttctgagggaggcacaaatggctattttggaccactctagcagccctttacggacccaagtcctccgctgacccttcacccaataacaagctcatttagcaaatatctgttatgtggcaacgaacagctgggccctgttccagggcgggcattttataaacagtcttcaggaccatcctaggaggtggtcttgttagcccatattgcaggtgagcagactgcagctcagcagggctggtgacacccatggcaacctgcggagcccagttgctccctaattccccccaccctgtgccctgctgtcagccctacctttctgtcacccccttgagctcttcctcccctccaggctgccctacactgccatatagctggacgaattgtaaaaggaacactgtgtcatcatgcctctgctcaagtcaggaaagactgttgctgctgtcatcttttgtcccctccccagtcccctcacctccctgcccctcagaatactctcctgacttctattgtgtttacgtctctacttttcattgtagatttaccaaagaattctggttcctgagctttgttaatttacttctgcccgtttttgaacatgatgtaaacgggatcacacagagtgtttggatgcatccggattcttttgctctgtattctgtgtttactcattgcaagcatactttgggaagtgcttgagtcaaagggtgggtagatgagaagccactgaaggtgacagaggaatggccgtgggtcagagagggaattaccttggcattacttgggcagagctggagtggtgggctacgcagttaggaggttgcggtgacctgggtaggagctccagcttagggtctgaaggccgtggggaggatggcaggtgaggcgtggtaggtttgggagggttgtcctgccttctctttctgacgaggtaggagttacaggttggaggagatggaaaaagggggaagcattcctcatacaggcttgttggaccagcaggagctgaaccagcagtcgtcttgggttgcagtgaaaccccctctgagactaggggctcccagcaccaaggaactggcagccagcagccagcagccactgaggccagcacctctcgtaatccgcaaggttggaagaaaagcagctcggtaaaggctgcttgtgatgagtcactggggctcctggaaaatctgtaagaaatgaagcttttgagatgtttatttttagctgccgtctgaccatggcctgtctctgaacttgatgttcttgggccctctcctctggctgtgtgttctagaatttctgttgtgtcctgtgcttttcatggtgtcatgtgaacactacaggtaactgtgatgatcttgaacactttgttagcgctatggtatgatcatatttttattcatgagccgaggcacccggaatcttgaagcattcggatcactaattacttggagaaacttttctgattgtaggatctcacagaaacctctctctctctctctcccaccctctctctctctttctctctctctctccctccctccctctctctctctctccccctccctccctctctctctccccctccctccctctccctctctctctctctctctctctctgtgtgtatgtgtgtaataggaactcatctttattttcccaaagctttaaggttgaaatgttgatggtgacatcctttagttgcattgttgggtttctggaaactcattccttcccttaaataatcctaaggggaatgactgtggccacttgtctttatattatacttgtccccgtgggtcacgattatttgtttgctgggttttgttgggaggtgagggccgcaaatgtgctggtagctctggtgccttggacagtggcctggcaggtagcagatgcccaataaacacccatggtgtaaagcaggggccggcaaagcacagcctgcaggccagatccagcctgttcctgtttttgtaaataaagtgttgtcagcaggcagccacatcccttcatttccatattgtccgtggctgctctgctgtacaatggcacagtccagtaatcgcaatggagactatatggcatatggcccgcgaagctgaaaagatttcccacctggacctttctcagaaacatttgcaaactcctatcagttaagttactacgaggaaacaggaaggagcaaggggcaggaacagcttgtgggagaggctcatgagagccggaggtggttttagtagcagtttctaccctgcccacgctggcaggggaccctgccgggacttgcctctagggtggccttccttgcttgttggagactcttaatcttttaatctgagttatgactttccgttccatctgtccaagtcatctggggattagctaatagagcaagttggcaaataatctgacatggtctgatttgggaggggaatactggcataaacattggcaggtactgtggcacctggccactgctgggcagaggacagagggaacaggtggaagggcttcaaccacagcgttttatggacggtgtaaatactgatggcagcacaaagtgtaatggctccagatgggaaatcacccaagtgtcacccgcagtagaatggataactacattggggctgattcctcagtcaaatactgtgaaacaggagtcggccaagttcgtgatcctgtgggccaactccagctcactgcctgctttcgtacagcttatgagctaagaatggtttttgcatttttatatggttgagaaaaaaccaaaagaataatattttgccacacatgaagatgatatggaattcatatttcagtgtccgcgaataaagttttattgaaacacagcaccaggcattgatgtgtctatggtctctggctgctttgcaatgacagcggtggagctgagtcgtctagacagagactgcatggcccagaaatcttcaaatatttactctctggcccttcacagaaaaagtttggtggcccctgttacagtgcaaagagaatgaacagatagttacactgaacaacatgggtagatcttgcaacataatatagaatgaaagaagctggaaacaagatttcatttctttaaagttcagaagcaggcaacagtaatctatagtgtgagggttgggatagtggttaccctttggggtgggtcagggactagcgggggcttgaagtggtgtctaggggctggtcatgtttcgtcccatgatctgagcactccatacatgggtgagttccctttgtgaaaatgtgtggagctgttcatctatgatttttgcattttacgaatacatgtttacttcaataaaaagcttactcaagaaaagtgatttcagtctggcagctcctcagaaggttaaacagagttcccatctgacccagcaatccactcctgggcatatacccaagagaaatgaaaacatatgtccatgcaaagacttgtacacagatgttcctaacagccttattcataatagcccaaaagtagaaacaacccaaatggccgtcagctgatgagtggataaacaaaatgtgatacagccacacaatggaatcttattcagcaataaataaaaaggggtgaagcactgatacgcaccacagcctggatgacccttgaaagcattatgctaggtggaagaagccagatgcaagaggccacatactgcatgattccacttactgcatgattccacttatacgaaatgtccagaataggcaaacgcataggatggaaagtatattagtggctgcctaggctgggagaaggaagtgattgctaatgggtagggggtcatttttaggggggtgaaaatgttctggaattggatagtggtgatgattggacagccttgtgaatttcctgtaaaccactgaattgtacactttaaaagagtacatcttatggtatgtgaattacctctttaaaaatgctgtaagagattgctgctacagacctgtgtgtatctgtacaagtcagaaggaaaaggtctcaaggtgacagccacctcatccattcttcctgctactcctccaaatgcagatatcttgaaagttgacaggcagggggaatgcctgacttcccccaggtaatccagactcttcctctagatccaagccagttgagtagcacagagcagtttctagaatgtagctaacatgggcatgttaattttgctacttttgtttactaaaactgcagttctcagaaaaacaggataaactaaaagatcctagataacttgcttcctggacttttcctgtgattatgcctgacttcgcccccattttcctgatgtctgttttcctttggtctgattggagaggaatgggaatctatgtagtagccactggggcccattcccatagctgagcctgggctgtcggctccttgctggttcctccaagacttcattgcttcacagccaatgaaatggagcagtaaaaaaacaaacaaaaaacaacaaaaacaaaacaaaaaacaaaacaaaaacattaaaaaagacttcactgcttacctgtaggttgctttttatatatagttctcaatctcttctgaattaaacttcttggtccccacttctagatgttaagggccataatggttgcaaatattgtgataacttttgagaggatcccttttgagggtgcgagatgactacccagaggatctgaaggttttcattttgctgacactgaagagtgtatttcttaggattttctgctctgtaatgacagataatcacagctggcagtgaagatagcgctgaactttctgtaaagtcccagccctaaacattatctgtggcagagacaaacagttttaattaatgacaaaaggtttgcttgtccctgcgagggtgaaaggggccggtgctgtttcattccctgtgccatgtactgggctgaaggggcaggggagggagcatcccagggtcctggcttttgagagaggggcagagagggtcagctgtggtcacacacccatacttgggagtcgtacaagtctcttggttagtggtcttgccactttgaatagaggtatttcagatttgaaagaaaacagtctaaacagtctcctcaaagtaaatgctttgaggagtttttaggaaaagctatttcgaatgtcaggcatagattcatgttttaatggcctcactgattcttggtaagtggaatcccccagaaggtcccccagaagctcagttggaccaccacaatctccctgaacagaactggagtccatcaggtcccctctatcagttacagaaagcagaggagtgagcagatcaacctcagaaacaaggcgacatgcagggggataaggaaggggtgttttcatgaaacatgattttcattttaacaaacatttatgaagcgctaaccacatgccaggcacaaattgctttacaaatgtcagctcattccgtcttcttcacagcaccctgaggcaggtagtgctgcaattcctacttcatagatgggggagactgaggcacagtaagaaaggtccaacaacttgcttaaggtcacacgggtggtaagtggcagagctgagatctgaactcatgcagcgctgttctggagtctgtgttttaaccagtatgcgtgtgatgctgcctctcttgtgatgaacatcagaatatagagggacaaagtacaatattgaagatccaaatatctcatactgccaatttgttttaaaatacaactacgaagaaaacataccaacaggttatgggagttatcaagggcatgatgatgggtaatccttattttttttcttgatagttttctgtatttgtcaagaagttttgtaagttgggtggttggttgtgtgttttaaaaaaatagccacaataatatctctgacttcggaatgctcatctagaactttgccatttcctcatcaagaggtagagtctactttctctctccttgaacctgggtgggattttgtgactgcctcaatgaacagcaagtggcaaaagggacggtatctgacttctgaggctgagccacgcaaggtgatacagcttctgccgggtctctctctcttaacacacttgctttggggcccagagcctctgggtaggatatactgccacctggccgggcgcagtggctcacgcctgtaatcccagcactttgggatgccgaggtgggcggatcacctgaggtcgggagtttgaaaccagcctgaccaacatggagaaacaccatctctactaaaaatacaaaattagctgggcgtggtggtgcatgcctgtaatcccagctacttgggaggctgaggcaggagaatagcttgaacccaggaggcggaggttgcggtgagctgatattgcgccattgcactccagcctgggcaacaagagtgaaactccatctcaaaaaaaaaaaaaaaaaaaaaaaaaagaaagaaagaaaagaaaagaaatactgccacccaaagtcacatgctgaagagaccacatggggatgccacatggaaagagagagaggcctgggaaccccagctgttctagtctccagctgttgagtctcttggcccaggcaccagatgtgtgagtgaacaagccttcggatgatgccagctccagcccctgtctgaccaagaccttgtgaaagaccctgggtgaggatggtcttgctgagtccaatgagaccccagtaccaggatagataaagatatgatgggctgcgtgcagtggctcacacctgtaatcccagcattgtgggaggctgaggtaggaggattgtttgagcccaggagtttgagaccagcctgggcaacatagtgagaccccatctctacaaataataaaaaaaaattagccagtgtggtggcatgcatctgtggtcccatcttctcaagaggctgaggcaggaggatcgcttgagtctgggaggttgaggctgtgttgagctgtgattgtgccactgcactctagcgtgggtgacagagtgagaccctgaaaaaaaaaagaaaagaaagaaaaagaaaagaaagaaaaagaaagaatcctttggaatggctaaagaagatgccccaactgtgtctggggaaattaatgcaagttccacagatagggtgaaacagaacagggttctgcagtgtgaataggagctttcaaggcagaggagaaggttcaaggtagaagagaaaagcacattcaaagatacgggtttctacctgacatttttggtcaaacatggataaccatgattcacctagggtagcatttttatattcagccaagccttgattctacttagaatctgtccttctagatcttgatctaggtgatttcctgctttctttcatcttctagaacctgttatgttattgctaatacccaaccataaaaagtccaggtttccttcgagtgttacagatccctgttctgagagcgagctgacccattcagagtcacttttaacatcagagctgtaaatgacatcattaatactattgtattaatacatgcttgtcttcgttgggtcctgggtgaagtgagttttactggacaggatctgctgttgaagaacttgagcctgattccttggggtcttcatgcttggagaccaaacctactgatacttttttgccttgaggcattggttgcaagatataggtgtcctgcattccttccacagttcctttggaggcaaataatggttgtgtaggagagatgttctcttgtcaggcaggatacttccagcctgaactgaggcaaattccactccaccctctcactattggtactgtcatgtatggctgctccagtcctccccagagttggtctgcattgctccagctaacttgacctgtcttccttccttcagagctcaagttcattctacctattaacccataattatcatgctgctgaataacaactccttcaaaggactcagtggcttaaaacaacaaccattcattattttcacaagtctacaggttggctgcatggttggatggggccaaagttggctgatcttggctggactcacacataaatctgtggtcggctggacctagatgattttttccccctttgagatggagtctcgctctgtcgcgcatgctggagtgcggtggcgcaatcttggctcactgcaacttccacctcccaggttcaagtgattctcctgcctcagcctcctgagtagctgggactacaggtgcctgccaccacacctggctaatttttgtatttttagtggagacggggtttcaccatgttggccaagctggtcttgaactcctgacctcaggtgatccacccgcctcggcctcccaaagtgctgggattacaggcgtgagccatcgggcctggcccctagatgatcttttaatcccaacctcacaatagacaccaacacctccttctgggtccccagggaagtcctctgaggctctgcagatcagagcctgtttattttcctcaggaccactgcatgttccgtcaaagtttaaagatatgattgctctctacagtgattttttgtttcaagcattattgcctgaagtagttgtttgactagagatgtagttaaattttaggtggtatcaactccttttgaatagactgtccaagtctctgcgattctatctgctggttgggtttttctgacaagggctctcttggagggtcaacagcctgtcgtcttgtttttcccatcagagattttctttcccacatatattaagaggttattttcatgttgtttttgtatacatgagaatgaaatctttgctttctaattttactctcttcctcatatcattggttgctactgacttctgcgatgtgattcttccctgggcactcatcagggggtattattttcaacttggcatggctcaaacctcaaacttttaaagttttaaagcagccgagttgcactgatgatcaataaatcaatcactgtgaccactttattgcttgtaaggtgattaccctactttgcccatagtgactcttcaatttgattaaaatgcagtttcattgggtcgtggttgagtcctctagatatataaatacatgagagaagcctgcactcaaatgtttttataaccacccttcagatttttaaccatctatgccagcacttttgtggtcctcatcctataattcaaatttccatgctctttgccaaagtaattcttatttatgcatattccaacctcttgtctctgtaagagtgtattcttttttctgctaactggtggtgagccttggtcccactgcaaagcattttctacagctgaaatgagctcctgtgcaatctgtaaatcaggctctgatggtgggagaatatgggagatggtgttggttcactcgcgattgttttccaggtgaggagagctggaatagtgggagtggaattattatcttggataggaaaggaagacacattcaactgtgctactgccctggcagcaggagcccttttgactgcattttaagacattaaaaatgagcatctgtcctggagctccttgcccagggcagcgtgccaccagcttctcatggctcttggctcgcggcaggttgtcccacctcccttgtccagctccagggtggccccactcacatagagggctcctgccatctgcagattgcctgggctcccaccaactcattaaagtcttgccagcattttcactgtgccattggagtacattttgaatatccatgatgacaatcacataggctgcctgcctgagtggtccactttgtctcccataggaaccaattattgctttgattaccattattttcatttaaaccctatttgcccctccagccctgtcatttggacaccttgcttttgcagaatgtgaggttttccaggaatgtatataattaattaatcctcatttgcagattccatatttgcaaatttgcctactggctaaaatgttatgtgtagccccccagatcaatactcgtggagctttcgaggttgttcatagatacgtgtgtgtgtagagcgacaaaaagtgccagcagtgcccgttccttgctgaggtctgagaaggcgatgctctgccttcctgcttccactctcctcctgtcaacaagggtccttttcgtgttctatttagtgccatgtttttcacagttttgtgctttttttgttggtaattttgctgtttaaaatggccctgcaatgcagtgctgggaagctgtctggtgttcctgagtgtaggagggctgtgacatgttttatggagaagccttgttcaggcatgagtgatagtgctgctggctgtgaggtcaatgttaataactcaacaatatctattagagtgtctttaaacagaagtatataaacaaggtacatcttgattgtttgatgaaaatgtgaccaaagattttgcaggaacttaaccctgtattctcttgggaacagtagttcagtattcagtaattcagtgtttgaggtgactttatagagcataacctccacgaataatgataattgactgtgtatatatttcattacagcacagatgcctatgctgaaataatttttcttatataagaaaatagggcacatggactattcttcttgcatggccatggcatgtcctgctcatgtctttaacgaccggttttcttgcccaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaaggtaggtggcattccgaaaggacacactgcaaatggctaagccatgttttcattcaaaagttactgagctggggcttaggtccacgtacgtgtcatgtgctgggttagggtctaaagaagaaaagagccagtgggaggagcagatatattggcagatcgttgtactagcaggagctttgggcaggacgttgtgtcatatggagggattgtggtgtggaggagagggaggggactttgcaggtgccatttctggaacctgttttctcatccatgaggatggaagtgattatgcctgaaaaggaaatgagattatgtgtatatgaaagcacatatgacagtgcctggtgtctagttggcaatcagtatatattttaatggaccacaatggttatctgtcaagtgctgtgggatcatttaggttcggttagggaagggtttttcagcaagggtaacatttcagttgggtcttgaaagatgactaagattttgctaggcagaggaacggtgaggattctaaacatcaggaatgccccccttttttaagtcacagaggcatgaaagaatctgatgtatctgggcaattcagggagctccgaggatctggtggaggattcctgcagagggagggatagggatgagtgtggaaatggaggcagcagggccacgtggggaacggccatgctggcggtggagaggagtttgcatttcatgctgaaagccacagaagacaataaagatgcgctgcaaagggagaaacaggaagcttggaaatgagtccaggagaccgaaggcagtgatgtgtaggtggagagaggggatcaggatggagaggtattttgaggcgccacggacgggattcaggggaggtgctggggccaggaggggaatggggtcacagaacaccaggctttggcctgatgaggatgatgcctttgatgcctagaggaagcaaggggggactggcagactgcggaggaggccattgagttctgtgtagatgcgttggtttgagctgcgctgcggatgggtgatcacaggtggcgagaactctgtggttcaagggtgagggaagggccggggggagaatgaggtccctgtgtgcaagtggaggctgaagctttagaaacagccacggtggcgtgggtgtgcagagacagaagggaagaggtagtcaaatccccaggcagtgcccagagttaccaggtccaggggaggcagatggggagcctgtgacaagaggggaccctgccaagagcagtcccctgtgaatggaaagggtgttgtgtaggggcctgctcacaaggtcaccctctatggagaggtcaggtaggaggcgagccagcggcatgggggctggcggtgaggggagagctgcttcagacgagggtgaggagtgacatggacagtgtgaccatgtcacatcgcctcacgagggctggcacgaaaggaggaggggaatgtgtagggagccaggctcagtcatgaagatgttgcagcctcttggctctgcagtgcaggaatgtggggtcgaggcagcattccctctagagcacagctcagcagactgcatcctgcgggccaaagccagctggcaccttgttttagaaataaagttttattggaactcagccatgcccatccatttccatatttttatgactccttttgtgctacagtggcagggttgaggagttgcaacggagaccatccggcccgcaaagcccaaaatatttactctctggtcctttacagaaaacatttgcccaccactgctctaaaaggccgtgagggaatgatgatctcagaggagcataggattctgttagcacagggaggtgtgtgtaggtagtccatctgctgtgggagacgtgatctgtgccagctaattctaagttcgtgctgctaaaatttaaccttgaaaacaaaaggaggagatgaagtctgtgtgaagaggctttttaatgaaacttagcaatgtaagttaagatagtaactcatattcagaatggagacaccgaaccaatgtcccccttcagcatagcttttaaatcatcaaagatcaaatcacatttagtatgttttttaattaagtgaattatttgagtgtgtgctcgaattctttggagacttttgtggcatctttatagctctgtgaactagaaagctcatcgtaccgttgcggcacataactgaaagaatcacatcagtgggaatttagctgcttgatgacattcattttattttcttaattaccctgtttcccgaggaaacagtttcaaggaaaaaagcatgaattcgaaaatgcattcggatcagttgctgtatctgctttgttctagatcaccagcaagagcaaggagtccatatgggagttcatcaagagcctgctggatgcctggtcgggatgggtggtgatgctgctcatcggcctgctggcgggtacgtggatgggcatgcggcactcccgtgggaagctgcagaggccgaaacctcaaaacacgaaccctctgggagatttggaatatagcgcgtgtcgcttgtcgcttttacccctgtgggagggatttattacttgaaatatctaagggcaaaatgcatggctgtatatttaacctaaaatccatcatcaataaggcatgcccaaggcatgagctcaggcacaggcttctgaagagctgtgacgatagagctggtagcctttccacacagagcagagttttcttactataccggatttgactgaaaacacacattttttttggaaacggtcttgttccattgcccaggctggagggcagtggaatgatgccagttcactgcagcctccacctcccggggttgaacaatcctcccacctcagcctcctgagtagccaggaccacaggcatgcgccaccatgctcagctaatttttgttattttttcatagagatggggtctcactgtgttgctcaggctggtctcaaactcctgggctcaagccatcctcctgcctcagccaaagtgttgggattacaggtgtgagccactgagcccagccaagcacacattttatattcggttattcttgattatgtagatgacaacaaaatcagggactgttttatcttcaataacaaaatgtcatatgagattgccttttgctactactggtaggctctgggatgaactggaaacatcctgcaacagtcagcaccatgctagacacccacgggagctgaggcaggcccaggggcctccatcatcctgaccctcaggaactctgcatctttcctttttagaatcccaacaccgtgtttgcgagcagtagatgtttccagagtaaatggatgctatctggaggggaaacacgtctttttaatatcaaacgcaccagcccttccgggaaatagtttcctgaaacttatgtccttttaggagattgtgaaggttaatgtctaagaataaaaaatttggcatgacgaagaggtttccttaataaaaatcccctgcatataacaacataatagttatggttagagaacagatcagggaattgactagaacacaggcagaatatatgtagtaagtggtctaagaaggacagaacacaaatggggcacagatagagttttgtgattccaggggctttcagtttccaggtgatcttgatttattccctagctcatcggaggaggggcttggttgccagggaagggctctacctccctcacctgcctcagcattccgtaaagagctaagaggaatgctcagagggggagttctttcctactagtcacagatgctgtctgtccgtttctccaagcctgtccttcctttaccagtggcatttcccgtcatgtactggcagcagccagggcaggaaattagacttcattgtcacaagggattggacgaccaattttgcttgactgcttctataaaggcctttgaaggtgggccaggtgggagtttgctatgaattttgatgtccttatttagagtagattgataaaaccttatagtgtgtcatttttcttggctcgtaggaaggagaaataaatagggtaaatgaagaaactcagaacaggaatagatgttctgataacggcacagcttagattcattgactgacctaggagcccaactgggctgactttaatctgattttgaccagctggctttattatccacttgatttccatcagctctttcacgagggggaattaaaaacaatatgctgctgccctggcttcacttaaacagtatctctggagaggacctctagcttgaatacagcctgcccctcccctctgtgattgtaatgtgcagccaggggtgagcaccactggccaaaggagagcccatgcgcacgtcagcaggggaatacatgggagggtgagaatggggtgatgctgaaaatgaagggactacagtgttcttttgatttggatgcactttgaagggacagccagagagccacgtcccactcacttcccccttcctcgctggactaacagtggagaggacctggggtctcactgcctggccggctgtcccctcagtggctgttgtcttcggactcccctcatgggtaggcccacagcatctccgcatgtgcttatcagaagtcaccgctaggtgtcactgttggaccacgaaagaaagctgaggcctgctgaagcgcagtcagaaccagaatcagcaaggaagattgggtgtgcagtaggggggttgtgaatgaatgaataatgatgaaacttggggtgatcatcctgtttgcccctggatatctgcaggaccctcccatcttcttcaccttcttcttcaaatactgcacgatgtcacttatctgtggagtccaaaaaaataaaaccagtgtcatagaaacagagtagaaaggtggctgctagagggaggggtggggacaggatggggaaagagatgttgatcagagggcgtaagtttcagttagactggaggaataagctttagtgagcggtcgcactgcatggtgaccacaattaatgatcatgtattgtatatttcaaaattgctaaaagagtagactttaataatctcaccacaaaaataaactggggaggtgattcggttggtgcgaaggtaattgtggtttttgccattaaaataacggcatgatcggatctttaattagctcgatcaagtctttctataatgtatacatagatcaaaacatgacattgatatacacaattattatgtgtcagttttaaaaagttaaaaaatcaagataatgagctctttgcctttgtttttcctgtggaaaaacaaagaactgtggatagttctaaatttgacattaccggaccctgtggaaagacctcatgaaatactaaatattatggttcttgcgtgctgttgctagggggcagtgtttacttagctgactctgcaaactagcattaagcggaaccaagcttgcatccaggatttcatgatctagagaaaatactttgagcatgtaggatttcttttcactgggtttcagtttccaactttaaatcaggaaatagttttcaccattccacaaggtatatgtacttcaaaacatcatgttgtatatgattacaacatacaatcttatgtgtccattttaaaatgaaagaataaatcaggaaatagctaatgatatctctaacttaattagactaattatatatatttgtatatttggaatcaagtctttcattattgaattgcatgtttaaaaatttcaaacctgtctgatatttaaaatttaaaaaacaataaaattacatccctctctctgtaagcctcacctccctcacctgctctatggatgtatatatgtatgtatgtaaagctttattgaaatataactcacattccatataattcacccatttaaagtatacaattcagtggtttttaatgtatcacagagttgtacaaccatcaccgtggtcgattttagaataattttatcatgcccaaaagaatcattataccctgtagctatcaagcccctgctccccaaccatcccccttccagccctaggccactgttaacctgctttctgtctctatggatttgcctattctgggcatttcatataaatggaatcatacaatatgtggtctttgtgattaacttattctactcagcataatatgttcaaagtttgtccatgttgtagcacgtgtcagtacttcattccttttcactaccaagtacaattccattgtatggatagaccacacgttgtttatccacttatccattgatggatatttgagttctttctactttgtgactattttgaagaatgctgctatgaacatttttgttcaagtgtttgtgtgcatggatgttttcatttctcttgggtatatgcctaggaatagaattggtttttttgagacagggtctggttctggcgcgatcatggttcgttacagaccgggcttgagcaatctgcctgcctcagcctcctgagtagctgggactataggcgcgtgccaccatatctggttaattttttttttttttttttttttttttgtagagacaggatcttgtcatgctgttcaggctagtcctgaactcctggcctcaaacgatttgtccacctcggccttccaaagtgctgggactactggcataagccactgcgcctggcccttatactttttaacagagcctttaatatacttattttctcctgtcccaggtacagttacacaaaggcaggggcctgggtctactctttgcactgctgtattcccaagacatggatgagtaactgccgtgtagtaggtacatgttcagtaactatcccttgaatgaatgaatggacctgagttttctgattttttcattcatttatttattgcaatattttattcaacatggatatatagtgccaaccatgcacctgacatggatataacaatggacaagacagatagggtccttgcccacttagagtggacacagggtctggatgccaggcctgaccccccactgtggtatgaaaaccaaacaatgaaaccttttttacccaccacttatagactagtggaagtacacacacacacacacacacacacacacggagaaaaagagaaagagagctaattgtgatattaggatgcgagaggtgtggtgatggggaaggacaggcagccacaggaatgccagggaagtacacctaacccaggcttaggaaatcaggaaagacttcccagaggaggtgatataaatgctggaatctggatgataagtaggagtctgatgggaggggagggcagtgcttgctgagatggtgcaggtaggagagcgtggcacattccaggaacatggagtgggcagggtgtggggagttagtgagggaaagagatgaagctggagagatctgaggggccagctgtcagggtgggtgacctgttgaggatttgggtgttctcccaagaataatgggtaaccatggcagggctttccacaggggagtggcacaggtcagtctggcatttggaaagcctatttgaccacagtgtggagaggccatgaatggggcaggactgaggctggagaccagagaggaagctcctgcagcagtccagccagcaatgacttcaacacggtgatctgaaagacagcccgagtggggatgggggaaactgcagtgattcaagagagatttcagaggtggagctgctgggatatggggattgcctggaagggggttgctttcccagatttctagtttgcacagtagtgtgcctggatggtgggttcctctcccagttgggacgaagctgaggctgggaggaggatgctttagttcggtgtcggatggtggtggactgaagtggagatatctagtagacccaagaaggcaaatagacttgtgttctttgacaatgcccattcattggctttgactgcctggggctttgctacaaagatttgggagggtaggtccacaagtgtgtgtcatgattgattagtgatgtctgtcatgggcatgtcaaaagaattgtgaaggggaatccaatagagtgtgctattattgattggtgatgtctgctgtgggcatcggaagctgacggctgggctatgtagtgattggctctgtaatagccagtgggctctatgtgcttggaaaagcatagcttgagatgtacatttatacctaatggtaaatagtaggatatgaataaggttgccagggttgagagcatagtataaaaagagaaaagggtttagggtcaagctttgaggaaatggcctttagaagttgggtggaggagtcagaaagatcagaggagtcagagcaaaccagagagtgaggaggaaagcaggagagcatgatgtggaagccacgggaagaggtgtttctggaagggtggagtggtcaacagagtcagatgatgctgagagctctggaactggggtcagcaaactttttctgcaagaggccagagagtaaatattttcaggtttgtggcccatgtggtttctatctcagctcttcagttctgccactgtagcatgaaggcagccacagagtgcatgtaattgaatggtgtagctgtgctccaataaaactttatttacaaaaacaggctgtgggccagatttggcccatgggctgtagtttgtggatcctgttctagaggaatgagctaaggccattgccttagctgcatgggaatctcctggtagattgaggggatggactgggccaagggaaggaaagagattggatggtgactagagggaaagtggaaacagggagggtttttttttttttaatgtttaaatgctgatggcaaggagaggaagaggttgaagatacaggagaaggaaaggggaatgggaagaacgaggccccatggaggaaggagatgtagagctgaggtgggcggtgtccgatgcaacaccaggagaagagaagggaggggtgagtgctgatgccaggtgtggatgcttttggtgaggatgtggatgcagaaccgatcctgtaataatgatgcagtgaaaaggctgaaaaatgaagatgcttgaaagcattctctgcctttgtgagagatgagaatgcattattctggaaagagacccaaggccgccttttgtgatccattcaactgcacattccgttttctcccatttctattggcttttaaaatacttatttagttttatagacccataattctttataatttaaataatgcagagagttttaataaacaggatcttcccgaatttggttctcatttggtggcaaaaccttactcatttatgatgtgaggccgtcgtagttgttatgagtccattttgtctgaattatcatgtttccctgagaaatattaatgtgtgtgattctaggatcctgccccagaagccattgagagagttctgtcttttacactataaatacccaatgtcaaaaacttggaaagggaaaaattgcaaaagttgcttgtctctcctacccagttcaagctactgaaccctttgtatttctcattgggcttgtgctgccttgcccataacataaatgttcaagtgctgcaagtttaatgaaagaagcttcctatgtaagtgacagccccattgcaagtttattgcctgctctggaatctgggccatcattgctgatgtgcccctgtctggccgccgtgttggtctcattcttgtcgcatcatggggcgattcctcttagtggctcgtgttacttcttccaggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagaggtgggtatttgggcagggtcctggctggggacccctgccgttccatgcgtgcttgggaatgctgctgggagatttgtgaatgtctgtgatttcaccttcaagtgcctgctctgaagttcgtggcttaacactagatgacgggctttttccagctctaatgctaccactcaaacttcacttgcaaaacccttccccactgtttcatgtgcacaatgcatatatatatatatatacactttaagcctcatatttggctttatcttgttatatttggctttattttttcttaccgaaggtggtttgctgatcatgctgaagaaacaaggttgactttgatatcttctaattgagaagaacataactttttaagttatcctttaaaaaaaacagctttagtgagataaattcacagttcacattgttcacccgtttaaagtgtacgatttaatgcttgtagtatattcagttttgcagccgttaccacaatctaattttagaacattttcgtcatcctttccaaaactctgtctccattagcagtcactcccatgtcccccaacctgccagctctgagcaaccactaatctaccttttgtctctctagatttgcctcttctggatgtttcatgtaaatgaaatcatacaatgtgtggactttgtgtctggcttcttccacctagcatcatgtttccagacttcttcctattgtagcatgaaccattacttcatttttttatggccgaataatattctattgtatgaatggaccacattttatttatccatttgttggttgcttttgctttttggctatgatgaatgatgttgctatgaacatttctgtacaggtttttgtgaagacatatgtttcatttctctcaagtatatatctgggaatggagttgctgggtcagatggttactctatgtttaaccttttgagcagctgtcagactgttttccaaagtagctgtaccattttacattcccaccagcagtgtatgagacttccaatttgtccaccttcctgtcagcacttgttattatctgtttttgattatagccatcctagtggttatgaagtggcatctcattgtgctttcagtcatcttccattgcattttatgaccacattatagaggatgttctgggccttctataaagagaatgccctaggcacaggagataatagtggtgaaccacagacctatagcatttagagcttcagatctttattaaaatcttagttcaggaaagagttaacttctaacccatttcagtggttaccaccatgactatgagttattaaaggatcagaaagccacgtgaggaggaaccaggttgtcaagcttcacattaggggtaatgtgaggatctctcaagctagaactaatctttcaaggtatatgtaatctatttatacatctcctcccttccccactttttttttttttttttgcctgactgacttaccacagctgaagacatttggaatgcactttgccatttttgctaaacctctttctcagtggaattgaaaattaattccttcaaatctcagaaggagacagggatcttgaaatctcacatgttctcagtgctctccattacttccaaaaagaaattctctacttgggttgatgggagcgggcagacagaattggctgtgcgccatatttttattcttctctcctacttgcaatgtgtgttttggggaaatacagccatccatcttttcagctgtttttaagatttatactttgattcgaagaattacctttagtaagagtgagagttatttttagcctccaaaaaagtacatatttaagtgggtgaaaggtatttcttagtccgatttctcaccgcatagggtgtgaatatatgtgcttgtaaaggccagagcagtctcctggaacgtgtttttgcatttaataggcacacatgtggctgtccatggcctgacttgtaggtgacctctcttttctgccccctttacttaagtaatccagatggtggcaagaagctgaggtctagagagtgtggtctgtacccagcagaccaggcctttcacgcataggaccccagactgtgtttttggttcagaaaaccttctccatacatcagataatttggaataaatggttcaatgaattattctgaaagtgatcacgtttttcttctctgatagtgcctctcaaatgttagtgcgcatagaacctcctggagggcttgttaaaacatattgacctgggccccagccgggagagtctggtgtctggttcagcagttctcgggtgaggcctgagagtctgcatgtctcataagccactgatgtggctggaccatggaccccaccctgagcagcagtattctaaaatacaggcccgacccgtattcattggcagtgcgggtgcttgctgtgcttgggcgtggccttaatgaaagctaagagagaccaagccaccacagacaagacaaaactaatctgccagggtctcggaggcaggattttctgcatcacacctttgattaactctatgcaagtggtgattaaaaccaagcatcatccacggtttccattactgctgagccttccctgtgtagaaggcgcgtgtaaacagctcccagagaaacacccgctgctctgtttgtgtgtactgactgtagcaatagcaacagctgataaacctacgctggccttttggtttatacaggactgggaccaaacctgcccaatcccgtcaaagcttttgttgtcaagacagatggggaggggttgagtctgttgctcaggtcagctgtggctaatgtttccttttgtgttttgtgtctgttgtctagggtgccagtgcttacattctgaattacttaatgtacatcctatgggcgctgctgtttgcatttttggctgtctccctggtgcgtgtatttgcaccatatgcctgtggctctggcataccagaggtgagttctggctgatttttttggtaccaataataagaatagcaaattcttctgtagcactgtcatgccaagcacagttccaagcgttttacttctactaactcattaagtttctcaataagactatgacgtaggtactattattctgcatttgatagttgacgaaactaaagcacagagaggttaagtgacttgccccaggtaaccaagctggtaagctgtgagttgaacccagtgttctgacttcaggatttacacactgtcttcaagatttctgtgctattgcttctcagatgataaaagccttgtctttgtaaaccaggcataactcttaaagcctgtggaatcagagttcattaaccacacacataaacacgctgtaataactcatcagtgcatctgtgatgtaatgtgagagacgatagtggaggtttgttgctgtgaaagttcactgatgatgaaatctctcttgccatgttttgctcttctggtggcaagctaatagcaatcttttaaaaacctgaattctgcctttaatacatgtactgtgaacgtacccccgtgaatttcgagttcttataaatagttttcagcactttcatgtaaccgaagcatgagggaagtgacctcaccgattaagaggagtgcctgagaccaaacttgaaacctatgaggacctactgggcagaatcatgataattgagctgattcccgaaaagcccagatggtggaaattttagccagaagtaattttaaaagttctggtattatcactgtaatccatgcagttcagttctcctttgggttgatgccttagcgatgcacacaggcagtgggctagagagtttgaagatgtagttgtgggctgagtatggcagtaaatccacaccctttgggaggaccctgcagccctgatggtggtccaggcagtttgcagaaagggctgaagtcatgaaaagacaatcagaggcaaaattcaacatggtcttgtttcaggaaagatagaaaaaagaagtcttaatatgtcatgctgaatttttgatggttgatgttaacatattgcttcaggaacctgaaaaataagctgtattaccaacctgttttctcagcgcagccagttctgctataatgcaacatacgcattcctaaaaatcaccatgccatgcaaaatcacacaacagaaaccacagggctttatggggaacatgaattaggggcacaatacacaaaacttcatcactgacacatatgacaaaaagaggaacctagtaaaaacaggagcacagctgtacacattaagtggctaagaaatatgtaaataccacaataaatatgtcacttcctgcaaagaacttgaagtttgcttgtggaagtgggtgtcgcaagggctgcaacttacgcgttgctgtgaagggcataaggaaggttatctgaagttgtaggggaagttgagacagcaggcgtagatgggtgtggcaccctggcatatgtgtgaaccggtagatgtttgactcgtgtattttgtgttttcctacatgactgggtgcaattttctgcatttacctggtatttctcctggaggaaatgcgcataaatagacataaaatttgagttatgctcaaattcctccctaacatgagtggcattggaacaaatttgcattttctttttttctttttccttttctttttctttctttcttttttttcttttttgagacagagtctcgctctgttgcccaggctggagtgcagtggcacaatctcggctcagtgcaacctccgtttcccaggttcaagcgattctcatgcctcagccccccaagtagctggggttgcggatgtgtaccaccatgcctggctaattttttttttggttttatttttaagtagagacggggtttcaccatgttggcctagcctcatgtgatccatccgcctcggcctcctaaagtgttgggattacaggcgtgagccgccacgcctggccttcttgtttttttattgttttatatagagacgaggtctcactctattgcccgggctggtctcaaattcctgggctcaagtgatcctcccgcctcagcctcctgtggagctgggactgcaggcacgtgccaccatgcccaactaatttttgtatttttttgtaggtttttgccatgttgcccaggctggtcttgaaatcctgggctcaagcaatcctcccgccttggcctcccaaagtgctaggattacaggagtgagccacagtgcttgaggcaaatttgcattttccaaccaagtgtcgtagcagagctgactgtattttatttgatgtctaaaacatctcagtttgtgatcccactgcccaacagtaggcatttttgactcaagcattttgcaaataaggagatggccgatggggaattggtggaaaatagaagcagtaagaggcacactgggtagtcccatctctcccttccaagaactgtagatgtgtggctcagctggtgtccttatagacagggagttcgaatatcagttctatctttgaagggctggctggactttgtcatcatctaaattgggcattttattggtgatagctgaactcagaaggagtaaaatactgagttgaggatttgtttcttttcttttctttttttgacaaggtctcactctgttgcccaggctggagtgcagtggcatgatcacagctcactgcagctttgaactcccagtttcaggcagtcctcctgcctcagcctcctgagtagctgagactataggtgtgcatcatcatacctggctaatttttgtactttttgtaaaggtgggctttcaccatgttgcccagactggtctctaactcctgggcttaagtgattcgcctgccttggcctcccaaagtgctgggattacaggtgtgagccactgtacctagctgagcatttgtttcttatgtgacaaaagtgcaagggatacatagacatggatgaaattaaaaaatgtgatgttaagtgaaaaagcaagttttacaaggagaaagtatgattgatagaacgtctataaacagctaaaatgaaaaaacgtatgtgctaaaactatagagaaaggggaagaaatggtaggaagtggtgaggggaaggaggaaggttcgactggggaggcaaacacgaggtagccactcttctgtttcttaaacttggtagtgggcacatgggtactcgcttttattagtattcttttaactctatataagtgcgtgatggattcatttctctatttcctaaatagttcataacaatcttttaaagaactttcaggaaccaaatggaggtttgacccagcagtagcaaagtcttcatgttactatagtagagctggaaattcttaacataaggatacagtatttttcccagttcttggaggagagggtcagagtaaaaagtaaatataaataaataaatcatgggtaaaaagaatctcctcccagtcagcacccaactaaatatggaaactgacttcagttgagacatgaagctgttcttcattcattctagcaaagatattgactgaactatttggaaaacatgtttatcattgtctgaggtgatctgccataagctgctatatggcacactgtgtaagaatgaactttgaatgtgatgcacttatgtatatttaaaaaattgctcatcctccctagcatttgtttctaaaacattttgattacttagagtgaaaaattcctttggaaacattttttaaaatgcaaatttaggtcaggtacgggggctcatgcctgtaatcccagctacttaggaggctgaggtgggaggattgcttgaggccaggagttcgaggctgcagtaagctatgattgcaccactgcactccagcccggacaacagagcaagaccttgtttctaaaacagaaaaaagaagcaaatttaaagaaggttttttttattttatgtaataaatgctctctataaaagttctataaagcacatttaaaggtgaatgcttgcctgtaatcccagcactttcagaggccaaggtgggaagattgcttgagcccaggagttcaagaccagcctgggcaatgtagtgagacctcatctctacaaaaaaatgaaaataagcggcagagtgtggtggctcacacctgtaatcccagcactttgggaggctgagctgggtggatcacttgaggccagaaatttgagaccagcctggccaacatggcaaaaccccgtctctactaaaaatacaaaaattagccggcgtggtggcacgtgccagtaatcccagctacttgggaggttgaggcacgagaatcgcttgaacctgggagatagaggttgcagtgagctgagatcacaccactgcactccagtctgggtgacagagcaagattctgtctcataaaaaaaaaataaaaatagccaggtttggtggtgcactcctgtagtcccagctactctggggactgaggtgagaggatcacttgagcccaggaaattgagactgcagtgagctgtgattgtgccactgtactccagcctgggtgacagagccagaccctgcctcaaaaaaaaaaaaaaaaaaaaaaaaaaaaaaaagagtgaatactcagcttttgttgcacgtgggacttgagagagaactgggtaagggtgtcctctttctacttgcttccttttgtcagtagaaccactgtcgtgtcaactatatgagaaatcataccctctcagaacttactctgtgttgatgtttcagtttattaaaaaacataaaacataaacactcttacaaatatttatttatcggaaagagttctggttttcaggttaacaccagcaagtcacaaatccgctgcagtacatctcgttaaagccctgctcgcttcagtctctatgaattcaaattaaagcaagtgattggattttgccatctactgggaatgaatttgtcttatttagtccctaatttgatcatgagaattttataaaatcatgttagagaattacaaaatacctattacattgttcaattcaccacatgtcatggctggcaaaggctcaggtaatttagatgcttgtaattttctaaatggtattacgcttttaaactatacccttgggtccaaatccacattaactaactgacaaaaaattatagataattttatttgaggcaacacaaaagggcagaattgtggcaggcgtaataaaacatcccttaaataaagggatctgagatcccagagcacgggctcaattaagctaactaccactagttaaggacgggtctaaccaccactagtttgtctgccacgagttcaaggctagttcaggaaacaccatctgactgtatagctaggagaccttgcacatgttctgtaggaaggagctcactgagtccttcaggaacatacacactcttggatgagctcacttcatgaccctccccaaatcgcccaaggtgacatgatgctcagtagaaggacctggtgaaagaacaaagagtgtttcacggctctcccttaaatactgtattgagaaataaggaatctctgtgctgctcttttcaggaatcaagcagtgctctccacctgggctgcattttcgagtcacctacagaggctgtaaaaatcctcataccctggatgcacctcagaccaattatatcaaatctctggggtgagagccagccagcagtgttttctaattccccaggtgactctgatgagtgccacggttgagaacgactgtagtagctatttgagaaactgattacttggcagagcaatgcccacaaggaggtgttttgaagttacataaataacactgacaagagataaccttgtcccattatgtattacataatgggaaaaccagaaattgaccacagatttcattgactgattcacttggtgtctaattaatctgtgattacaggcttgtaagttgctaacccggcagtaaacattcagtccatttcagccaattgggggacgggttggaggtagaaaagttgtttgatcattgatgatgcttctatatctaagagaataccattttggcaggggagaggcccttggtgtatgaagttaatcactgtgataggcacccagttgaattctaaaagcattaggcaaagactcaagtgaacgtttaggaagaaagccattatttggtatttataaaatgcagcaggtctggaaatggagcaagataacactccctatagtcaaagtcctttacaataaaagagggtaggatttgatagaagagaaggggtcatgatggattcaaacatctttacatcccccaaacatatatcattggaatgttgagcgtcttcttcattttctactgttgtattaagaatattttcaaacatacagaaaagttgaaagaattggacagtaaaaattcattaattcattgcctccagcaggggttggcaaacttttcctataaaagaaagagagtcaatatattaggccttggaggccaatgggcaagatggagcaactattctcaccagaaagctagtagtcttttttttttttttttttttttttttttttttttttacatactacttttaaaaatgttaaaactacacttggctcgtgggtcatacaaaaataggtagtgggccagatttggaccacagtctgtagtttgtcaacccctgacctaaagttcaactgtcattttgctcttgtaggggcaaacacctttttaggggtttgcggctgggcctgcgaattaaattgacatataagacagatcaacaggagaaaagcatacatgtttatttaatgaattttacatgacatgggagccttcataaggagtgaagacccaaagatgaagttagggttgaatacttatgtgctgaattggacgagtagtaatctatgaaagtgtgacgaggcagaggagcctgggctggggggttagctgggtgaagtggccaggaggatgagggttagtctaacaaggttggttcatgcagatttccctcagcctcaacttcctgtctttgatgataagaatgatgcttccttctagtatcggaagggcatctttcacatgggaatttcatctccagcttttaagaaacaaaatgggccagttgcggtggctcatgcctgtaatcccagcactttgggaggccaaggcgggcggatcacaagatcaggagatggagtccatcctggctaacagggtgaaaccccatctctactaaaagtacaaaaaattagccgggcatgatggcgggtgactgtagtcccagctactcaggaggctgaggcaggagaatggcgtgaacccaggaggcagagcttgcagtgagccgagaccgcaccactgcactccagcctgggcaacagtgcaagactccatctcaaaaaaaaaaaaaaaaaagaaaaagaaacagaatggtcaggtgatgttcttgttcttgtacctgctgtttttcaagagcctttaacccaaaatagtcagtttgccagagtggcatattttggggtggcatattccttttttttttttttttttgaaacaggatcttgctctgtcacccaggctacagtgtagtggcacgatcacggctcactgcagccttgaccttccgggctcaagtgattctcctacctcagcctcccaagtagctaggaccacaggtgcatgtcatcatgccaagctaattttaatttctttttttttttctttgcagagatggggtctctctatgttgcccaggctggttttgaactcctgggctcaagcgatcctcccacctcggcctcccaaagtgctgggattacaggtgtgagccactgtgcccagcctggggtagcatattcttaactacttcactctccttgccttgtcacatagtcagccagctctccatctcttaatctaggatatatttcagagtcaaaagttaacagttaacatcaataggtacatgtctcttctcaacataacaaaaggtaatgtgaacaggataaaatgccataaatcaagtgagaccttgttaatgatttattcagtcctctttaggatcttttggtactctaggactccttacgatttaccatgcattgagtttttaatatttcagttaatataaaattatagttaaatcaaaaatgaaaatggtttctgttccatgctattgagtgaatctaaactttgaacgtgtctctcagaggaattatagctcttttcctagccatggattgaaggagttcattccctcttgttctccatcctctgtttcagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgagccagctcagcttccatctgcagcgaaactttcttctcaaagccccctcctgctgtctgacttgcaggtttgcacgtttgttttcatggaaggccttgaagcttatgtagaactatttgttttgtaggtgctttcagctgcagcggctgctggagtctctgttgcctttggtgcaccaattggaggcgtgcttttcagtctagaagaggtgagaatgggcagctgagggaattcgtgattttgagcagcaaggcccgttgagggttagaatcaaagaagtattggataagattccggcagttaattaaggagccacaatttccactgttttttttttgttttgtttttgtttttgtttttgtttttgttttttttgagactgagtctcactctgtcacccaggctgcagtgcaatggcgcaatcttggctcactacaacctccgcttcccgggttgaagcaattctcctgtcccagcctcctgagtagctgggactataggtgcacgccaccacgcctggctcatttttgtgtttttagtagagatgggggtttcaccatattggtcaggctggtcttgaactcctgacctcaggtgatccacctgcctcggcctcccaaagtactgggattacaggcgtgagccacaatacccggccaccagcgataaattcctgttttcaagtattgtttcaaaaattgccaaggtgattttttaaaaagatttacagtattctccctctcataaccaacttaattaagcatttttgattttggtaacccaaacgggttattccaggggttggcaaacgtttctgtaaaaggccaggtagtaaatgtttttggttttgtgggccatgcaatttctgttgtagctgctcagctctgctgtcatagcatgaaagcagctgtgaacaatacgtacacaaatgggcatgtctgcatttccatagatgtttccttatgggcactgaaatttgaattttatggttttcacatgtcacaaaatattgttcttcttttgaatatttcaaatcaaaagattttttcacctttttcaatcaattaaaaatgtaaaaaccattcttaactcatgtgccatacaaatgcattcactgggctgcacgtgacttgcagcccagagttttccaaaccctgatctactctgttttctgtagaatccaatccagaggtttatttgcttctaggggagtctctgtgccatgaacagaattatgattaaatacttttctcttaaaaatatagcccaaacccaccttgattagtgtccattccacttctagacatagttagattcctccaggtatctttgctgatgcgttttggtcacattaagtccaggctcatggaatgagtgtgtccactcttggacttagagtgtgactttcctgccaaccagagggcttggctctgagcagctctttctccggccagtctttaattttccactttttcatctcaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaaggtaagtgaaagggaaggaagatggggtggggacccatgtccttctggggacagcaccctactctctaaaataaaattgcggtgggaaaaaaaggggaactggcctttcttgaatgttctcatgtgccaggcacttgacattcctttaatcaataggaaataacttctaataaacaataagcttatgaaatagagattttaatcccattttacaactgaggaaactaaggctctgagatcttaagtggcttgatcagacccacagcttatgggagacagagctaggcatcaaacccacttcacacattcccagaacaggtggtggtgaccacaggtttcctgccgctggccaggtgatgccaggtggtggaaaaagcccaggtttggctcagtttggctcattaaacatgcattgagtatcagctgtatcttaggcatcgtgctaagtctgagggatacagaacccaaacagaaagctgcccttgcagagcacacagctctgggagaaagagatgcagacctggagttctgacattgtgatgagcaccacgctggtatgacgggagcacagagtgagtgtgtcccccgtctgggtagggctgggcatgacaggggctctttgcacacatcctctttgaagaacagagctgtggatgacagcacatgctttcttttcctcctccctccctccctccctccctcccttccttcccttccttcccttctcttccctccccttcccttcccttttcccttttccctttcctcttccccctttcccctttcccccttcccttcctttcgtcttgttcccaggctggaatacagtggcatgatcacagctcactgcagcctcaacctcctgggctcaaatgatcctcccatctcagcctcccaagtagctgggatcataggcgtgaaccaccacacttggtgatttaaaaaaattttttgtacagatgaggctcttgctgtgttgccctggctggtcccaaactcccaggctccagtgatcctcctgcctcagcctcccaaagtgctgggatcataggcatgagccaccacaccacacccaacagcacatgccttcattactcttgttcctaaagccagagaagagacagctggtttcctctttcattgtgttaaaatcatttgttaaaatcattatgttaaaatactttaaaagcccctcctaaagaactttcttttatggaacctgggattttgttattatagctttttttttttttttgaaatgaggtaaaacccataaaacataaatgatcattttaaagtatacagttcagtggcattacatacattcacaatattgtgcaattaacacctgtatttagctttagaacattttcatcccccaaacggaaatcccatctccattaacagtcattccccatttttccctcctgcagccccggcaaccactaatctgtctctagattcgcctattttggacacttcatataaatgatatcatataatatgtggcctttggtgactggcttttttcgtttagtgcaatgttttcaaggttcattcacattgtagcatgtgtcactacttcatttttatggctgaatagtattccattctatggagatcccacattttgtttatccactcatcctttgatggacatttgtgttgtttccaccttttggctattatgaataatgctatcattacttacttaaagaaacttttattagagtatatcgttcatatagagaagtgtacagcttgatggagtttcataaaacacacacacacacctgtgtaaccagcacccaggaccagaagcagaacattatccacctcccagagcccccttttgtgttccattactattgctttctgtgtggcatttctatgaattgtcttttaattttatttatttttattaaaaatataaaatagagaccaagctccctatgtttcccaggctggtcttaaacccctgagctccagtgatcctcctgctttggcctcccaaagtgctaggattacacacatgcgccattgtgccctgcctgaattgtcttttttttttttttttttttttggagacagggtctcactctgttgtccaggctggagtgcagtggcacaatcatgggtcactgcagcctcgaccttctgggctcaagtgatcctcctgcctcagcccactgggactacagacacgtgccaccatgcccagctgatttttgtattttttgtagagatggggtcttgccatgttgaccaggctggtctggaactcctgggctcaagtgatccgcctgccttggcctcccaaagcgttagaattacaggcgtgagccatcacacccagcctgaattgtcttttttttttttttttttaaatttaatggtcgggcatggtggctcatgcctgtaatccaagcactttgggaggccaaggtgggtggatcacttgaggtcaggagttcaagaccagcctggctaatatagtgaaaccccatttcttctaaaaatacaaaaattagctgggcgtggtgacacacgcctgtggtcccagctactcgggaggctgaggcataagaatcacttgaacgcaggaggcagaggctgcagtgagctgagatcacgccactgcacacgggcctgggcgacagagcgagattccgtctcaaaaaaaaaaaaaaaaaaaaaaagaaaaaaattctaagaagttgtttacttgagtgtgtcatagtggtcaaatacaaacctgaatttgggccttaagaacaaggatgagtaggccttattaaacagctggctgtctctgatctgtcatctcctagcaaagggatttgttttcatgtctcaggaagatgctggtaacattttatgatgcttgctgagaaaagtctcctttgatgttacagggatataaatgatgtagaataaggggaagctcagaaaggaatgatttcctaaggagtattctgactctagaaatcacacccaaggatccaaacttcacttgaattaggttaaagttctgcttccatcctcagatgggtaaccacctggggctggctggcatcattgcagctgctgcccatggtcagcggtcacgtgtcatttcagcgaacacagggagtcaggcttgttctatagtacatgtgtggtcattagataaactaaaatgtatcttcatccagcagggtagagaacacgctggtaccaagatctcttagtttacattctatttctttgctgcccctatcctggcttgaaaatattcagaatacttattagaaaatgtacttcattaggaagagggaattgcctccctcgtctctctctgacaggtattcagctaccacctactagagagggcagggagccattgaagtgctttctggaagatccagggtggctgcaatgatggacttagcttctttattttacctgggagcagtcgcaggcccttcttttccattttcatgctgtggcttgacatttaattttaaaagccattctgaatgacatggcaaggggcgagagaaagtggtgtctcaactgacagatgctcactttgaatgttatttgcagtggggcttatcattctttaatccacagcaggcaaacccagccagcttttgaaggagagggaatcaaagtataaaattgcgttctctctaagttgcagtagatatgactgactaggcaggtcaaattatttgtcccacctttccccagctgacctattttgcagagttgcacctcctctgaagactgaagctaaatgcaagcccgtcgagggggaatgtgtttcttgggggtcgtgaagcggggacttggtctttttccctcatgttgcttttctctgtgtctcctcaagatcccgtcgggcctcttcatccccagcatggctgtgggcgcgatagcgggcaggatggtgggaattggcgtggagcagctggcctaccatcaccatgactggatcatcttcaggaactggtgcagacccggtgcagactgtgtcacgccagggctgtacgcaatggtgggagctgcggcctgcctcggtacgaccatgggtggggcagggagggggaccggggaactaatctggcttagaggactgccaagaaggaagacatggacttgaacattttctttactcaggataggctgggttgtgtggctataacaagtaaacccctaaatcacaatggcttaacgcaccaaggctatgtctcgctcactatgcagacacacacacacacacacaaacagatgccctcaacttatgatggggttaacatcctgataaatgcatcataaactgaaaatattataagttgaaaatgcattgaatacacctaacctaccaaacgttgtagcttagcttagcctaccttaaacatgttcagaacacttacatttgcctacatctgggcacaatcatctaacacaaagcctattttataatgaagttgaatatctcttgtaatttattgaatattgtactggaagtgagaaacagatggttgcctgtgtacttgaggcatggtttctactgaatgcctgttgcttttgtaccacggaaagtggcaaaattgtaagttaaaccatcgtaagtcagggactgtctgtaaataaaaatcttggtttagcagaaggcgcttctccacctaatcattcaggggcacaaaggtgggtctgtcccctgtctatagtccttaagaatttctgtgatattctgtttatggggttcttgaagagcaccatgcttgcttagtcagaagcttgcagagcccatgtaggatccactcaccaaaaagcttgtgtgggccacggtgaatagacaacccgggatccgtcattggagcagaggccccagtgagatgcaacttcaggctccccaacgcaaagccacatttgacagggcctggcctgggttccagaggcccagtgtaggaagcatgtaggagagtctgcttggaacaggtgtgaggggaatttacagcctgtctgtcattttccccaaatcatgcttccgtgagctgcccggcttgcactttggaatcttactcctcccctctgttgcaggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataagtgagtaaagagagggaagctcacattttaccaagagccgaatggcatcctttgtacccctaacattatccaagatttttgaggtgatgtgcattaagccaggggctctcaagctttcacatgtctctgggtcacccaggggtctggctcaaaagcagattctgattgagcaggtcttgggtgggatccgatactacatccctcacaagttccccattaacgccgatattgctggtccccacgtcacactgtaaggaaaaaggctttaaacccaagtcttgggtagacattcttggttgcaaagtgactgcatgtttgcaagcagccccctggccctgctccgctgctgcctttcagcaattgttggctaaagctgagaaggaagagaggcgacagcctggagtggcccgggctgagctgtctcagagactttcaggtgtaccaaccatccggctgagatcacgagttctctgccccagacaccccttgccaccacacaagtcttttgcttcactttgtgatatgatgtcagattccacagttagaggcccttgtgggtaaatgtgcagacatcgctgaaaccaattgcgtgagatgattttcctcttgtgtttgaatgacaatcagctgcactgaggggcaggctgttgagttgggggaggggagtatgggatgatgcccaggtcagggtgtcccaacgacaggtggatcagagaagcaagcccatgggccccatcagccgagggatggctccaacagaagggtaaacaggaggtaggagaattcctaagacagaggggcctagggctgcgggctgagggccagaggtctggttgtgagttgctgggaccccaggcaaggagaagctgtgagccttggaggggtagagtcctgctgggcctcaaggtggcaggggcaaggaccagcatagcacatccacgggcacgctcaccatccttgctctgtgatctgtacaacattccagcatctcatgatagaccagggcccatggcgtggctcccatgtgcacacgacagttttactatatatcttctagagtattcttgaagcttgtcaatgggactttccctggtctgatgttggaatggcccactgttaatacatctccaccaggcaactgcttacttctctccctgtcctttgtttcctgtttccaaggcacctcccttaaacctcttcccagtgttacatagctttaaaatatctttaaggcatcttcatcaaaggctttataacaataagttgagataagctatcctctcccattttagcttgacactcaaacatttttacctcccccaaagtaaaaattgattttgtattttagacaccgtagcaagtttgtgcttaagtgttcggcgatgcttctccttattataggtcctgttgcttaacgggtaggtaggtgcctttgtgtaaatattgccttataaataatgaggtttttttaaggttaagtaggattgggtttgtttaaaaatactgtaatcagcagcctttaaaaattttttcattccctaggatcttttaagcaaaggttgaaatttaaaaactaaggtaataaatgtcacagaatctattatctattgtatagctccaggcacacctgctaagaggcagcttactaattttgctgaaacccattactgtaatcaagtgggaagcagtaattgtcatcaaccagttagagaagaaatttaagcttaccaaccaagtactcttctcgaagctatgtttggaatgtctgaagaggcaccacacggtgtaaatactacctatatgctttcaatcagaccgataataatatagaaggtgctatttacatggtttgtgcagagggaaggagtgttttgctctgaggaatcagaaaagctgtttttctggcctgtggaaatagaagagcccctgtactctggtggagaaatacaggtgcatgacctgtatttgaggaatcttgtgccattttatgagtatagaaatatgacagcatttagctagacactatcccatgccaatttcacttcctagaggaattgggagcaaagattatagacagatccaagatagtatggatcagaaaagaaaggtaagtgaggtaaataaggatttttcttacatatcatgtttaaaaattgtagcaactgctcacatgaagctgaaaatgttttgttatgttttggaatgccaaagcatggcgttatctttgttagagagcacgtcgttagcaccacctaggcaacgtgactctcttcaccatcacatactagcacacggggctgtatgcgactcttgctcaagttcctggcaaatgggcctttacctctcattgctctgcaaatatgaggactcgcctgtacttagcagggctcaggtgcttcttgtcttgagttctgcagttaagtagaggttcaaagaggactcagcggggagttgcagagatgattaaagggtggaaagttagagtttcagggaagagttaaggaaactctcaggtttttttggtctggtggatgatttattaggctggtacaaaagtagttgcggtttttgccgttactttcaatggcaagaaccgcaattacttttgcaccaacctaatgattctccagcatgtggaagacgcttagttgcagaaaggggtctacatccagcactgaacaagaagctaagtgtcaggtctgtcagacaagggagaaagaggtttctgcccgggagggctgttagttactggactaggtcatggagaatagtggtgtcatctacacctttctgttggggatgtgtgtgtgtgtgtgtgtatatatatatatatatatatacacacacacacatagagggacttctccatgctttagtagacagacaataacttgtaaaacaatctgctttttcttctgtataatctttacttttttatcatatcatctttgtactacttctgtggttgctttcaattttccattttaacctatctcattaattatatctgtcttatggacgcatttaaaaaaattttttgagacagggtctcgctgtttcacccaggctggagtgcagtggcgcgatcatagctcactgcagcctctacccactgggctcaagcagtcttcctgcttcagcctccggagaagctaggactacaggcttgcaccaccatgcctggctaagcatttttaattaacaggatgatagactattacttccctaaaaacacagttcaagtgggagtactcctcctcagcactgctgacatttggggcttgatgattctctgtgctggggctgtcttgtgcactcttgggtgctgagcagcatcccagggctccacccactggatgtcagcagcacttgccctctcctattgtgataaccaaaaatgtctttagacattgccaaatgtcccctgagggtggaggcagaattgctcccagttgagaaccattgctctaaagccactcaatagcctaatgaatatgtgattatttccaattttgaaaaatttcttggcctatcacatagtttgtgaaatttctcttacccatactttattatttaccatctctacatctggcatatgaacatattgcttctaggaaatggaatgttgagtaaccttagcaggtgctcataaaatatacattccttcatttttttttttttttcactaagtcttgctctgtttcccaggctggagtgcagtggcgacatctcggctcaccccagcctccacctcccagattcaagcaattctcctgcctcagcctcccgagtagatgggactacaggcgcatgccaccaggcgtggctaatttttgtatttttagtagggacggagcttcaccatgttggtcaggctggtctcgaactcctgatcttaagtgatccgcccacctcagcctcccaaagtgctgggattacaggcatgagccactgtgcctggcctaaaatgtacattcttttttaagagctgtggccactgagactcattctagtagaatatatgacaaacctcctacattaaagacagttttaaaaacagtttaactatttttaaaacatttaaaaatgaagtttattacattttttcaaaatgaaagtaatacacactccaaatattggggaaatcagaagaaaaaggaaacatttaaaaagccacctacattcttatcaccaaagaagacatgattgatatttagtgcatttcctttttgtcttttaggtcttttaaaaagatgcattttcggttgtattgttttggtttctttttcaacacagactcccaagtgttcctagggtctgtgggtctcttttcttgtagcactggctcatcccctgggtgaggagttagttggtttatcctttcacacaggaaatatttcttaagtgtccaccatgtgctgataccatcctagaagctcagagtccagggatgacagcacactgcctctgccctctgtgaacttacatgcaggcattttggtgtctgatgatttctggtccaaactgagagcagatgtttcaccctggtagagaattgcaaagagctttcttgctggttgttcttccattcacaggcttttgcctgttcttagcacctctacccacaaagtttgaagcctcctgtaagtctgtaatagagttccaaagtggcctagcagaacctttctgaggagagtagcagttgccactgtgggaacagcaaggtgcatagctcaggcttctggctctgaccctagctgatgcctatatttttgcttggcagtaaataccttgtgtgctttccttcctgatgcctcctatgtgagataggttcagttttatgtggcaggcagaaccagatacactgacatttagtagacctactcatccgttcattcatatgtgcatttggcaaatatctgttttgtgtctactgtgtgttaggcattgtccaggcactgggagtgcactggtgagcaagagttcattgagctagtggctgttagaatcagggcttctaacccaatcagtaggttcaaaggagatataagcatgttatttattttattgtagcaagtggatcgaccatttattaaattgtatttggttttagaaggggttcagcaaatccatgtcatcaactcttgattggggtttgcaacttgatccaatcctgacattcactcagtggttgaaattgatggaaatcctgttagtgggactttaagagaatcggctggtctatgggaatgagcaaataagtgtgtgttgccagttgcctccctgccttagtgggtaaggacagaatcatcttggtttaggagagaagtacgtagtatatatcgaacagtctacatttgaaaacgcgttgtgcctcagagtcgtctggtatttgtggcagaatcataccccatttgatgtaacttgatttaacctgacccatgtaatgtgaaggcatttgcccagcaggccctctgttcctcttttaaacagagaccctttttcagactcagcctgaccccagatgctgccagttttccattagagtactctattgcactaaatggccttagaggaggcagttagaattttatttttgaaagaacaatataggtgaatagtagtctttgagaaggtaagaagtgtattatgggaaccaggatccattttaaagcaagccttgctgtacattttccctaaccttttcccatgaaccaaaagaaagattaaaattccaacagaaggaaaatcgccttggagaaatatcttgagaccgatggatttatttcatgtgtggcttaaaatagcctgggtttctagcaccgcgttaagctgtatttctaatgagttcctgttaccctacttttcttcagctttctttcacatggccttttctatagacagaaataggctaattgctaccataacagttttactatctttctttgagggatccacaaaatggcccatttttaagacaggagatccgaagggttgaggggggatgcagcttttctggggttgtttctttggacccaagggtcgcgtttgggattgagctgcatttctgggctgtgagcctgggctggccgtattggtttcttgttcctcccaggattcataatgccatttgggccagttataagttagttcgtaaaaagaaaaacaatgtattaaggtcatcgggcagctaagtaagtttcttgtcacctcaaactccagcccatgatgaggtgaaggagcgtaaggaaagccagagtggagggccctgggctgtttggggtgcccggagtctgcggtgaagcagtgaatgtccccaaaggggccatctgggtcaggcccatcttgccagactttggcaacaaatgatccggtcacagcaggggaccctcacacagcattagctgcagagagatgccaattccacagatgtttggctaaagccccttattaagaatgtgtggttcatcctccaaaccccttttctgtgggattctagatggtgtgtgtgagtgtggggtggggaattgctcagcaaggggtttttgtgtggctcattgttcctgctcaccccattctagagaacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggtgagtagccggacatgtggccagaatgacctagggagaaaaagatgagtgagacatggtctcagccctgaagaatgtggagggccatggggtggaatagtccttgacagagaatggcagtaagctgtggtgaatgtgttgaggaggaaatgtacagggagcttgggactgagggctgggcagccgtgcagccagagaagggggtggtccaggctggactgctgcctgggctgagggaggttgagtaaaaaggggtggagccacaggagaagggcttggtgttgcttttctaccaccccatgtgacacttggcttagggaggaggttctgctataacgtgatgtatgcggtcctcaaaatcacagcactacgcaaaaagtgctccatgcaaaccacaggacttgtgggaaaaatggggttaggtacacaacagtcaaaaacttcatcagtgatatatgacataaaagaggtggaagcctaataagaatggtagtaccgagccaggtgcagtgagtggctcgtgcctgtaatctcagcacttcgggaggctgaggtggaggatcacttgagcccaggagttcgagaccagcctgggtcgcaagaccctatctctacagataaatttttataaaatcagccaagtgtgcccatagtcccagctacttgggaggctgagacaggagcatcacttgagcccaggcttccaaggctgcagtggcccaggattgcaccactgcactccagccttggcagcagaatgagaccctgtcttgtaaaaagaatagtggtagtaccatgttacacattagttaaatggttaagaaatacagggatacaacagaaatatgtcacttcatcttaaaaaggcctgaagttggctgtggggtgggtttcacaagctgtgccacttccgaattaccgggaaggggtggaaggaggggagcctgaactcaaggggaagtggtcacagcaggtgtggatgggcatggctcttcacgcatgcatgaactgaggtcgcttgtggatgtttgggggccgggcatgtgcattttgtgtatgccgatcccactgggttcagctgggtacagtttcctgcatttgcctagagcttctcatggatgaaatcacacataagcaaaggtaaaattcatattatgctcagattgttcctgatatatcaatttgtttgaaacaactttgttttcgaaacaaacatgattggagaatggagagatttgatggccccatggcattgtccctgctgccacttttgttttgtgttgtcacaaatcaggaaaccaacaatgcaaagatcgagggtccactgtagtagcaccagagaagcagttccttaaaggtcattccttggcctctgagtgtcacaagttccatggtgtcagaagcttgtgtaagggaaggggtcggcttggtcagggtagcctggaacctagggttatctgcccattttattcctttatgggctgggagtaggaggcggggaatgggttctggagacattggtacctaataaagtttaggcctttatagactccagaggctcaactatctaatatagcttatatttccagagccagcacactctagtttaacacagcagttctcaactgggatgattttacctcccagagacattgggcaatgtctggagacaatttggggtgtcatgactggagggagggatgctattggcatctagtgagtagaggtcaggggcgctgctaaacatcctgcagtgaacaggacagctccacaacaaaacatctggcccaaaatgtcactagtcgtgcagttgagtgaccttggactggatgtgcctgtatagccaaatgagcaatcctattcattccactttcttcctgctgtcctggtagcaagcacacagggggacaggctttgcaatttgcagatttacccagagaactcctggccagcagagtgagcatcctccttagctctgactacagacagagcagtgtcttgcatgtgggaggtgcaatcaatagggaaaaataaatgagtccttgtgtttgacaaggctagggatcatttctgctgatgaattttaaaggagctcaagtggtttttcaaacttgagtgtggatcaaaataccctggaggattaaacctccaggttaaatccagatttctgggccctgccacagaggtactgatccctggaagtctagggtgaggcccaagaatattctttcctaacaagctcccaggtgatgctgcaactgccggtctggggaccccaccttgagaaccactgaagtcgatttatgcacttgagtttccagtactcttggtataaacaccactgtgattgcccatgctgtctcaagtgtgtagcagtttctcctttcctttaaaacaataatccaaagtcaattatcgttggaatttcagctcaggcaggaaactctgcccttaatgcccgctcacacctcatagagccccatgaggtcttcctgtgaagatctgggtgccgaaattggctctgaatgtgcttcaagaaagcaaaatcgcactctctctcgctctacatcttttacacaaacacagatgctgctgcgttagtgctggcaagggatgcttgtctgcggggcctttcatctccttgggcttcttgccagggcaggcacgtctctggccagctctcatgtttgatgtgctcgcccaccctgtaccttccctgctcgggatggccacgagcctgagctccaccgctggcctggatcacctgcagcatttctcaggcctggggttcaaggggcatcataaaactggaccaggaatcggaatgccgcaatctaggaagcctccagttgctaagagtgaatttgggtgagattttccctatgaaagttctagaaaggaaaagtgagtaagggagatggtgtcagattttccccaagccctgctaggtggtccacaggggcctggacaggatagctttcgcagaagagcccagctgctcgaatttgaattatgtccttggtcatagatctggccatttataattcgctgaattcgcttcaactgctactcaaaggggctggaagttcaaacacttgatttaaatcaaataggacatttcatgccactaacgaagcctgctggatttgatgttacctccttctgggttgatgttcagctttcttcttttgtgataattaccatcgcgggccagggcacaatttatgcacgaacccaaggcagctcctgaattcatatttccctagtgctgttataatcaacttaacttttagacattacagtcacagagctttaaaaggaggttttcagaactgcaaatgcttgatcttttgatactgtctccagggtgaagacaaggaaacaaaaaccaggatttatagatatgggagggttccgtgtgtgtgtgtgtgtgtgtgtgtgtgtgtgtgtgtgtgtatgtgagtgtgtgtgtgttatagttatcatcactttgcaaacactaacaagtcttatttttttcaaagcaacattggtttaatcaacattatattgagcatctattttagctgggaactgtagggggcacaaaaagtgtttaaaaaaaaaaaagccaaggagcttgttatctactaaagaacatggacataatccagtttaagtggtgctacccaaggcaggcgctccggggggactgttctgttttttcttttttaatttaatttaatttaaagttccgggatacatgtgcaggaagtgcagtcttgctacataggtaaacgtgtgccatggtggtttcctgcacctaccaacccatcacctaggtaggtagccccatatgcattagctatttatcctgatgctctccctccccacatccacgacaggccccagtatgtgctgttcctctccctgtgtccatgtgttctcattgttcagctcccacttgtaagtgagaacatacagtgtttggttttctgttcctgtgttattttgctcaggataatggcttccagctccatccatgtccctgcaaaggacatgatctcattcctttttatggctgcatcgtattccatggtatatatgtgccacattttctttatccagtctatcactgatgagcatttgggttggttccatgtctttgctattgtgaatggtgctgcagcgaacatacgtgtgtatgtatttttataatagagtgatttatattcctttgggtatatactcagtaatgggattgctgggtcaaatggtatttctggttctaggtctttggggaatcgccacactgtcctccataatggttgaactaatttacattcccaccaacagtgtaaaagcattcctgtttctccacactcttgctccacaccagcatctgttgtttcttgactttaataattgccattctgactgatgtgagatggcatctcattgtgggtttgatttgcatttccctaatgatcagtgatgtggagctttttctcatatgtttgttggctatataaatgtcttcttttgagaagtgtctgttcatgtcctttgcccactttttgatggggttgtttttttcttgtaaatttgtttaagttccttgtagattctgcatattagacctctgtcagatggatagattgcaaaatttctcccattctgtaggttgtccgttcactctgatgatagtttcttttgctgtgcagaagctctttagtttaattagatcccatttgtcaacttttgcttttgttgcaattgcttttgaggttttcgttatgaaatctttgcccatgactatgtcctgaatggtattgcctagattttttttctaggctttttatcgttttgggttttacatttaaatctttaatctatcttgagttaatttttgtgtaaggtataaggaaggggttcagtttcaattttctgcatatagctaaccaattctcccagcatcatttattaaatagggagtcctttccccattgattgttagctttgtcaaagatcaggtggttgtagatatgtggtcttatttttgagatctctattctgttccattgatctatgtaccagtactgtactgttttggatactgtggccatgtagtatagtttgaagttgggtggcatgatgcctccagctttgttctttttgcttaggattttctgggctatatggactctccacctcaaaacaacagaatatacattcttcttggcgccacatgacacttactctaaaatcaatcacataattggaagtgaaacactcctcagcaaatgcaaaacaactgaaatcataacaagcggtctctcagaccacagtgcaatcagattagaactcaagattaagaaactcactcaaaaccaccacacaactacatggaaattgaacaacctgctcctgaatgactcctgggtaaataataaaattaaggcagaactcaagaaattctttgaaaccaatgagaacaaagagacaacataccagaatctcttggacacagctacagcagtgttaagagggaaatttatagcactaaatgcccatatcaaaaagctagaaagatctcaagtcaacaccctaacatcataactaaaagaactagagaaccaagagcagacaaaccccaaagctagcagaagacaagaaataagcaagatcagagcagaactgaaggagacagagatacaaaaaacccttcgaaaaatcaacaaacccaacaaatccaggagttgtttttttgaaaaaattaataaaatagactgctagctagagtaataaagaagaaaagagagaagaatcgaatagacacaacaaaaaatgatacaggggatatcatcactgaccccacaggaatacaaacaaccatcagagaatactgtatcacctctatgtaaataaactagaaaatctagaagaaatagataaattcctggatgcatacaccctcccaagactgaaccaggaagaagttgaacccctgaatagaccaagttctgaaattgaggcagtaataaatagcctaccaaccaaaaaaatcccaggaccagacagatttacagctgaattctttgtaccagaggtacaaagaggaactggtaccatttcttcagaaactattccaaacaattgaaaaggagggactcctcccgaactcattttatgaggccagcatcatcctgataccaaaacctggcagagatacaacaaaaaaagaaaacttcaggccaatatccctaatgaacattgatgcaaaaatcctcaataaaaaaaaataatggcaaactgaacccggcagcatatcaaaaggcttattcaccacgatcaagtcagcttcatccctggggtgcaaggctggttcaacatacacaaatcaataaacgtaattcatcacacaagcagaatgaaagacaaaaaccacatggttatctcaatagatgcagaaaaggccttcgataaaaataacatcccttcatgttaaaaactctcaataaactaggtattgatggaacatacctcaaaataataagagccatttatgacaaacccacagccaatatcatactgagtgggcaaaacctggaagcattccccttgaaaaccagcacaaaacaaagatgctctctctcaccattcctatttaacatattgtacaattcacccatttaaaatgcatgattcagtggtttttagtagaaaatgggttgtgcattaatcaccacaattttagatcattttcatcaccccaaaaagaaaccccacaccccttagctgttacctcctataccacagtccttggcaaccactactctatattttctgtctctgtggacttgcctattctggacatttcatgtcaatacagtcatgcactatgtggccttttgtatttggcttctttcactgagcatcatgttttcaaggttcgtccacactgaagatgtgtctgtacttctttccttgttagggctgaatcatcttgcattgtgtggatagaccacattttgctgatcaattcattagttgatggacatttggtttccctttttttcttttttttaaattatttttaatttttgtgggtacataggagtatatatttatgggtatatggtatattttgatacaggcatgtaatgcataataatcatatcagggtaaatggggtctcccagcacctcaagcatttatccttcgggttacaaacattccaattcttttagttatttttaaatgtacagttaaattattgattgtagtcaccctgttgcactatcaaatactagatcgtattcattcttttaaactattttttgtacccattaaccatcctccatcccctcctcccccctcccccattccccttagttttcaaatgaggaggtgagactctaagaagcaaaacactgctcagggttaaagggaattggttgcagagccagtcccatctggattcttccaggtctcctatctcctgaggcacaatcagctgccaggtaccgggaggacctttgatggagaaccctgccagccgaccctgacccttgaggacatcaatcccctccgtacagcaccctctgggaccaacgacagtggggagtagacctgggcgtgatgggaagatatgtggcagcatccttaagtatccagattcctggaatggctgcattttgggatacctgttcagtaaaatacagaggatatggggccaggtaacgggattcctgtgtcccatgctgacggtgtattatagattcacccacagaggtctatttgtgtctgaaagcttctggctgggagtaatagtcaaagtgtttaagagctggtgccagataatgaactgatttgttatgaattgtggggagttcactgcagttctataaggtatgaggttggcagggtacatcccagggtgtctagctcagtggctataaaccaaccggtgtagaactattttagtactttttaatctggatggtggttctcaaccaggggctatcttgtcccccctccacaggagacatttggcattgtctggagacattttggttgccataatgggggatggggatgctgctgcatctagtgggtagaggcccaggatgctgctgtatgttctacagtgcacagaatggcctatctgcaacaaataattagccaacctaaatgtcactagtgccaaggtggagaaaccctgcgtaaagccttcccaggtggagggctggatgggtggaaggagtcctattggcccagcttgcattttgctgctaccgcatgggagggggcctcactggggattcctatctgcctgtaaatagaggcccttcccagtaacaaagccgcctttcctagctgtcactgctttcttgaaattaattagaattatcagagctagaacaaaatttcctgactctgggaggaaaccttgtttaaaaacatttatttaaatttttgtgggtacatagtagatgtgtatatttatggaacacatgagatttttaaaatatatatatatatatattttattatactttaagttctagggtacatgtgcacaacgtgcaggtttgttacatatgtatacatgtgccatgttggtgtgctgcacccattaactcatcatttacattaggtatatctcctaatgctatccctcccccgtccccccaccccactacaggccccggtgtgtgatgttccccttcctgtgtccatgtgttctcattgttcaattcccacctatgagtgagaacatgcggtgtttgtttttttgtccttgtgatagtttgctcagaatgatggtttccagcttcatccatgtccctacaaaggacatgaactcatccttttttatggctgcatagtattccatagtgtatatgtgccacattttcttaatctagtctatcattgttggacatttgggttggttccaagtctttgctattgtgaatagtgctgcaataaacatacatgtgcatgtgtctttatagcagcatgatttatattcctttgggtatggaacacatgagatgttttgatactggcatgcaatgcataataatcacatcatagagaatggggcatccaccccctcaagcatttaccctttgtgttacaaactatccagctgtactcttttcatacacctgtttgctatttgtatgtcttcttttgagaaatgtctatccaaatattttgcccgtttttttgatcagattattagatttttccctatagagttgtttgagctccttatatattctgcttattaatcccttgtcagatgggtagtttgctagtgttttctcccattctgtgggttgtctcttcactttgttgattgggaaacctttatttcttatgtgggcctctggctctgacatgcctcaagtctggaggcctggactgctcttctcagcagcaatacatggctgccaaagcaaaagggcaactctaatgagaccggggcccactaaagcttttgcaaccgtagaagcagggtgatttggcgaagtattgggtaacagtgcccttgagaaaatgtgtatctctggttgattgattgcaatgggccctcattatgacagttgagcccgaagcagctaaaacaaatcaggatggaaagaaatggtttcaggctctgccagctggacccagcaaccttcctgtgtgaggagaccagagcccttgttgggccttgaatctgtcaactgtgttcatactcacagatgggttttcccaggagaactcagcatctcaccgcaaagaagagtgctaacatttgtttcctttaggtagctcttgtttcaggattataacaacatttaggcttacagaacaattgagcaaaatatgcagagttctcatatatccccttcactcccctcagtttcccctattgtcaatatcttgcattactgttgtatttgttgtaattgatgaaccaatatcaatacattattattaactaacatccatagtttactttagagtgtactctgtgtcatatatttctgtggattttgacaaatatataatatcatgtgtccaccattacaggatgatacagagtagtttcactgccctaaaaatcccctgtgctctgcctatttatccctctcttccacccaccaaaccctgacaaccactgatctttttactgtctccatagtttagccttttccagaatgttgcatattatgtagttggaatcattcagtatgtagccttttcagactggcttctttcactcagcaatacacattttgatttttctccacgtcttttcatgacttgatagcacttttgtttttattgctgaagaatatccattgtctggatatgccatggttcagtttatccagtcacctactaaagaaaatgttggttgcttccaggttttggcaattatgaatgaagcagacgtcttctaagacgttttctttacataactaccaaaccatgatgatgtaaaattaacagtaactcaatatatcatccaatatccagttgatattcattcaaatatcaactcagaattccatcaaggtttgtgcattgcattcttttgcctttttagtctcttgtctagaacagtttcctgccttgttgttgtttttttaatgagagatttttaaacataattccaaattttattttagacacaggagatacatgtgcaggtttgttacttgcaaagatttcctttgaagagtccagaccagtagtctcacattctgggtctgattacttcctcatgattcagtttggcataagtcgtttttggcagcattccaacataggtaacgctatggagtctgcttttctgactttgttgatgataagctccattgctcggatgaggtggtgatggccagaaccctccattgtaaagtgacatttttctctttgttcataatctgtaggaaagtactttgagaccatgtgaattttctgttttccagcaaccattcgcccagtgattttggtatccattgacaattattgcctaagctaactattacattgggggttgcaaagtattaattatcaaattctgtcctgcttcctacgtttatcaagtattcctccccatttaagaaaaacaatccctgtagggtcatgatatattcttttaatgtttttgtaattcatattgtcattattctgtttgcttagcatgctctttcactattttcctctctcctaaagatgttgccatgagatggaggggaaggggtcttatttgctgtctctctcagtgtgatacatagggaaaccaacacaagaaacggataccttttccaagactgtttaaggtccagtgttgtcagagccaaaaaagtcagaattctggcctgacagtttgaataatcagtgtctatttcaccaggtgtaactgatttgaatactgcttagaatacttacatcccttcttcatattcactaagagataaatttgactaattttgccttaattaaataaatgacagtatattacagttaggttttctgatttcttttgtatattatcatattacacagagtagaaacccattattttaatagctataaagtattttaatgcaagactaccagagtttgcttctgcataccccttttttggggggtacagtggagatacagtgagtagtgttttgcaaacttatgtgggaatggagcttctttttttccaaagaagttgttcacttctccttctctcagacctttcattttacccaagggacatgatgtgttcctgcaggtggtcatttagtaaaataatgaaacaaggcttgctatgaatggttgtgcaaatgtgcactgtataatccagagggcacaatttctactgcagtgtttgtgagcagtgctccttggcactgtgtgatatacagtcttggtggtcccatacaatggactctgggaagtggcattctttttgtaagttgaaagcaatggaattttggaagagaaggcaatttacgtatatagtcagagataaatgtcaactttatcctcccagtaagaattacaaatagaatcactttttatcttgtacttaaaatttcttatacttaaaataccttacacttggcattcctgtggtgtggtcaagttttgacaatgcctttcataaacccttttaaaattgattatagtcttgaaatttaagaggatatagtagtcatcataggtttactgccgtaataaacaagcttgcaatctctgtggcctaatgcaataaaggtttatttttctcacatgttacatccactgtggattgcaggtgggctctggacctaggtgtttgaatctggtggctcctaagtcaatcctcagagcccttcactggctcctgtgcctctggctgccagatgagaagagagagtggggggaaatgcacaggagacctgggagcagcatctgtcacttccacccacaggcattggccagtgctccctccattggctctgcctaaccacaagggaggctgggaaatgttgtctgtctctgtgtccacatggaaaaggcactggggtttagggagagggatgagtcgtcgtttcaaggctgacctcttttctctattttgtttcttctccaggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcgtgtccttgtcattgcccttccggttttcattcttgctaaacccctgtgaatgttcttctaaccttcctgttccccaccccttttctcagatttgacctagaattcccagcccaaatccataatttcttagctctaatacgaattttcatgttggacaaaaacctagctacaaatgggtttctatggaacttctaattaatgtgcaaaatacatattttctccaggttaagaaattttaagtcagatcatgctgacacaataagaaaatttgtttgtgtaattcattgacctcttccttccaaaataacatcaagtagccacctcagtgtgacaatatccagtcaatagtagagaatttaatccttggtcctataaaagaataaaattcattgtcgtatttatagcacgtaagccttgagtaacaggtcttaatgttagtgttggtgttgtggtttctgcggaacgtttacaagtgaagttggattctcctgggctttaaatccaaaaagtcttaatgaccgcttcatgtagttcccctcttattcccctgtggtctcctcagagccagcgtgtgctgggaaagagtattagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaattatgcttccgggccaaggtcaccgagggggaccttgggatttgtgtcctccccagtgcttagagtagagatacctgcaaattcatggcaaacagttggaagagttacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcactgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgag

SEQ ID NO: 16938 - DNA, 70770 bp, Human
tttaactttgatgtgtatctgtgatggttagttttgtgtgtcaacttgactgagccatgggatactcctaacaggttgaatgttatttctgggtgtatctgtgaaggtgtttctggaagagatcaggatctgagttggtggactgattaaagcagatggctctcctcaatgtggctgggcctcatccagtccatccagggtcagaatagaagaaaaacggagaggaagggaggactttttctctttgcctgattgagctggaatattgatcttctgccctctgtgcttctggttctcaggcctttagacctgggctgcaatctataccatcggccctccagctcttaggcctttgactttcatcagctttcctgggtctccagcttgcagagagcagatcatggggcttctcagcctccacaatcacatgaaccagtacctgataataaattggttctggtttttccagagaaccctgattaatatactatctgtgcattcacttaggagaaacaaagtcattaaatgtgaaaaaaaaaaaagaactgagtcactcagaagaatcatactatagttgcccatcatatattataaagaacaaagtattctaaattatttacgaataagaattctataaagaaaatgactgattatctgcgcttacacaaaatatttcatggaaattttattaccgtgctcttttttttttttaatttaaccatcattatgttgtgcattcatcatctggagtttttagttgtttagaattccctgttggcagccaaattcctgtctgggaaaatgtatgagccagccttcattttccacgatgactttccaaggaaccattacaattaagagaatgtaagttactcatctccaataactgtacatgaagcaatattccgaggatttgttaactgtctttgacaggagatcatctactcacagtaggtgcttaacaaatgccatcttgaatgaatgaagaccctttctcacagtaacaaagttgggtccaggctccttcatttttgctcagcaagatgaagctaaggaaacaggaaataagtcatcaaccaaatcatagtaacaaatcgttctattccattctccataattcacccttcagtccaggggaacactaacaattgcccctccagatacaaagaaattgcctcctctgaagacagctgcctcacctaaggccacatttccttccaggttgccccacttccaatgagtcactgattggcaatccataaaggtcagctctcttgcctcaactcagcatacctctgacagatcgtcccatcttcccgtctcccttgaggtttgactggggttgctgctgacccagtgatataggagttaagaagaaagtacttaggcagatagtgaaggtatgggagtcctcagtaaggtcttccttttaatgaaaagcagcccccaaatcattttcttttctaacaaaaagcaacctggaaaatcgagctgcagacacagacaagcaagctgaaagcttgcacaggcaaataccggcagttgtgccaataaaaatatactacctggggccggcgctgtggctcacgcctgtaatcccagctactcaggaggctgaggcaggagaatcgcctgaacttaggaggcggaggctgtggtgagccaagatggcgccattgcactccagcctgggcaacaagagcgaaactccgactcaaaaagcgacaacagcagcaacaacaacaacaaaaaacactacctgggattaggcatgttctaaatggcagctccatcttctctttttgccacccatgtttacagaaacgagtggacaagacggcccctgccaagtgggaagcctatttgcataacaagattagggtggggtgaccagccttccctgcgcgctacgtaaacgtcacccctggtcgaaccaatctctgggctccacgtaaatcagacaccgcctcctcaagcctgcccgtaaaacctgctgccgtcagtcacgggccagcctttcccttaaggatgtctgagagctggtctcctcactcttttcttccgcctattaaactttccgcttcttaactcacccatgtgtgtccatgtcgttaatcatcttgacgagagatgatgaaccccggatatttaccccagacagtgatgccgcttcaccagcattgcactctacttccccgcttcctgatcctgcctcagcttctcctctccacaggtattgatcccaagaacaacccgtaagaaatgtcctgcacgctaatctccatctcagagtcagcttcccagggaatccagcaattacgaagcattcagcttaattttgttgattgctttatgattttgtgtgtgtgtgtgtgttttaatgttgaaatgtaacatatattcaaaagtgtggataaagtctccatgacgattagtttcctgtgtcatcatgggggccaggctttagtgcctttttttttttttttttttttttttttttgtggtgagacagagttttgctcttgtcacccagactggaatgcagtggcgcgatctcggttcactacaacctcctgggttcaagtgattctcctgcttcagcctcccaagtagctgggattacaggtgcccgccaccaagccaggctaatttttgtatttttagtacggatggggtttcaccatgttggccaggctggtcttgaactcctgacctcaagtgatcttcctgcctcggcctcccaaagtgctgggattacaggcgtgagccactgcacccggcctttactgcccatttatttaatcaaacactaatctaggtagtgctgcaaaggtattttgtagatgtagttaacatctacaatcagttggctttacataaatcttacttttcatactgtgaatgggccttatacaatcagaagccttaagagcaaaaactgaattttcctagagaagaaaaaattctgcctaaagtctgcaacatcgtttcctgcctgagtttcagcctgccagcttctcctacggattctggacttgccagccccacaatcatgtaagccaatatgctaaaataaatttcttaatataattcttaatgtatatatccttttgattctgtttttctggagaaatctggcttatacaggctcttaacatgattgtttatctgtcaatttttattttatggctatgttattaggtataaacaaatttacgattatttcatattaaacctgaaacgttgattattctgaaacgagccagtctttgctttggttttgtaacttttgctttgcatagtagttttaccatcccttacttactttcaacctgtcgatatctttatatttaaagtaagcagcttgtttagctttgcttgatattattaccttctctgatgagctttatatttcaatttcaatatttagtctgtttatatttactgtaattcaaggttaaatctaccatcttaccattgattcctattttctctgttctatgattttttttgtccttccttaaagtttttgggcttatttaaatttttctaattacatttcttcttctattagcttgttatttatatgtttttttaaaaaattggtgttttctctaattggtgcaacatgcattcttgacttactaaagtgctatcggtgtgtgttttaaaggcgctactgtaaatgtgtatacaagtaatttttatctagatttaccacatagacattcttatgactgctctttgttacttcctgaatttccatgctttgctctactacatgttatttaccataataaatgcataacatttattacctatagctctaaaggcaaacaggcagtgcggttccagttttatagataaggaaaccaaagctcagggaaatatagtgagaaagagtatagcttgatagctaaaagcataaactctggaatccaattgaatattccgcttactggccgggcagggtggctcacacctgtaatctcagcactttgggaggccgaggcgggcggatcacgaggtcaggaaatccagatcatcctggctaacacggtgaaatcccatctctactaaaaatacaaaaaattagccgggagtggtggcaggtgcctgtagttccagctactggggaggctgaggcaggagaatggcgtgaacccgggaggcagatcttgcagtgagccgagatcgggccactgcaccccagcctgggcaacagagcgagacaccgtctcaaaaaaaaaaacaaaaaagaatattccgcttactgatcttatcattttgagaaagttatttcatgctgtaagcttctctttatctataaaatatcaaataataagaataagaacaacacttacctcattctggttgtgagggtgaattaagaaacgttgaatgtttcatgagacgtctggcgcattgtaagaacaagccacaagttcatgttggttatgatgatacccagcagtgccgtaatacgcacgtcatccactgttgctgcccagcccactgtgctcctctaagggaaacgctgccttctaaagcatgttgaaggagggagaaataagcaatcattgagaaagtggtggcaccactttggccagggatgagatctgacccaagggcagccagaatatcaggcagcctgtgtccttcaaagtggcctggcttctacaacaaatctctgctctaaagggattatggtgactatctaagaccatcaactctctcccattagcatctgaacagagaaagactggaagaatgggctggttggtagctatgggagaaatatcagaacatataaagggaaagggaacagtaccctgagagcagtggctggaacacagctggcactgtattcttgcaacaaatcctgactactgggtaagccaacaagactgaaagggcttgcccagcacatcttcccagagttgtacagttgttaagtggtggagatgatacttactctcaatagttcagaccctgaagacatggtttttctgctctgccattcagccttcccattgattatctaggttgtctagaaaattatctagacaactatctagactgagatatgggacagagatatgcataaagtgcatttatgttgcctaaactttgtaaatggcatgaaataaaagctaaatggactattaggaaatcaggtttttgttgttgttgctgtttaggaaaaacatttgaatggaaagcataacaggattgacgagtctaattttaatttttagacctaagtcactaatatccttattgaaatatggattcatctagattgaatttaattttactattttgcatataattacagagtcttggaaactgtgggggaaagtgtgcccagtcaatctctgctgtctataaataagaaaccagtaacatttaattcagagaaagtaaatgttggctcataaaggagcagaatattcctcctctgtaaaataaggataataatagtgactgttaacattcactggaccatctcactcccattcccatccagaactcaggcctccctgaattccaaagcaatgccctggtgatagagaaagttctccagattggagttttgggaaatgttataaatgacttaatgtatcaatgcacaatgaaagtagaactatggtatcttaagtctcattccaagaagaaatcatcctagagggtgatgacacagtcacccaatgtatagtataattccttttctaatcctgttccaatacaagcctggaaacttagaccccaaggttataaacaatggctgttactgggaaaaactgaaagctgacttttgaaatataaaaggttttctttcatgttgtcatatcaattttctgttctattttgtattacctttatacttgtaaaaccctcttttcactgtgagatacacaaatattctgctgcatattcttctaagatttttatggtggcttatttttgacatttaaatatttaatccacctggtatttctttgggggtaatgtgtcagaatacatgtctgggtttacttcattatattaatgtaggtattcttttcccagagtttctgtttcatttcattgttccaataatctattcttgtgccaaaaccacatattttgtctatattagtgttatgtttctatatataacagggcaaatctcactggttaatcttttctgttttgcatttaaaaaattttttctgagctctacttataaattcattcttctagatgaatcttagttttacttgaacacatttaataataaatctcagtggaagtttaagtgcaattgtgttaatcctataaatgaatttggaaaaaatcgacatttttccaatgtcatttttgctactactaccatgactactactaccattactgtagtctagctacctgtagcctcccaagtaaacagactacaggcacatgcctctatgcgtgcctattttttttttttttttgtaaaaatgtgatcttgcaatgatgcccaggctagtctccaactcctggcctcaaacgatcctcctgcctcagcctcccaaagttctgagattaccagcatgagccactgtgcccagttttcttaatgtagttataagttttttgtttttattttttactagcctttatattgtttgcaaaattatatataaagctatgtaggcacttaatagtttgtgttgctattgtaagtggaaaattatcttcattaaatattatgaatagttttatcctagttttcagaacaaccgttaaattttatacattcattttgtgtttagccacttaatttttaaattggggagtgattttcttggcagagaaccatcatattttgtaaatgttaaccaaaaaaggtaaactttttctctttcctaatgttgcatatcttaatatgttggctaaaatttctagaacattcaatgataatgatggtagcaatcctctggttatttggttcttggtttcagtgagaacatgtaaatatttcattcctgggtatggctttggctattaatttaatatagagattctgtctcatattgagaaataatacttatgttcttggttatgctgcctgcttctcctcgcctctgataataatgactaaactaatagtagtaatagtaatgatggcagtagtaatagtagcaatgatagtagtagtaatggtggtggtggtagtagtagtaacggtaggagtaaatagtagcagtagtagtaatgacagcagtagtagtaatggtggtggtagtagtagtaatgatagtagtaatggtggtggtaatagtaatgatagtagtagtagtaatggtgatactactagtagtagtaatggtaggagtaggagtagtaattatagaagcagtagtagtaatgatagcattagtagtagtaatggtggaggtggtagtagtagtaatgatagtcgtggtaatggtaatagtagtggtaatgatagtattagtagtgatggtagtgatgatagtggtggtagtactaatggtagtggtaatagtagtgacaatagtagttatgttattagtagtagtaatggtagtagttttgatagtagtggcagcagtagtgatagcagctagcatttactaagcactcattaatacttcacaaacatttaatataaatagtcatcttaatatctataatgtagcactgttattaatcctaattacacataaaatgcagaggcttaaagacatcaactttccaatgagtgctagagctcagcttcaacccttggtctgcaagagtctagagtgtggaacactaatttttggttacacaaagagctgtggtcctcatgctccatgtgccctctctcacagggatagcctactcatgttggctctgcctgtgccccaggatgatcacccatgcagacagcagcccccaggctcccttgctggctgccctctgattgtgtttggccagcaaggatcactggcatgctattgagggtgaggagagagaagtaaaggtacttcatcctctccatctgtcacaggtgtgataggctggggctggtgttacaggcagtaaaggaatttaccaagacagttgtgggttaagaaagtcagatttgttagagaaagtacaaagatacaagagagcaacaggcagcacagcagagaagtttgataaggttatgctggagaggctatgtacagatagggtcatgctgctggggctacctgtggaacaaggtatttgggaacaggatgttgtgcaagtaggttgtttgtggttaggtgtttctcagaaaaatggcttgtcagccatctcttagaacagtggctctccccaatcctcattcctgttcctgccagctagagcccttttcttgtatctattaacttaccaggactccatgttccccgctgacagaacaacaatgacaaatctttggcattggtatggaggtcttatcttccaactgcttcctgctgactgtgggcacagtgtgggccctacctgtgattattggtctgttaggggaccctgtgggttattgtcctgagttatgggacttagtctattaaatgctgctggaggatagaactcaggaagaaagagcgtgttaatatggaattgatatctagtgagtctagaggagattcatggggttttctgagggtgattggctgatatccttgcatcattaggagtttgctgtggaattgctacattctggaagaaacaaatttaaccagtaaattaaagagacaaaggactgaagaggagaagtagaagtataaatgcagctgtcctagtaaaggaaggaaccatgtaagggagaggagagcaaacttagaaagagttacacaacctcagatataaggaatctcaagccgtttagaagaattatgaccaaagaggtcaacctataaaatactactgggggcagaggtcccatttggaagccagtaggattcctgatctggaagtttataaagtggccatgctgtattacacaagaaaattcgatgtttccttttgagagtctgggagtcaagtttatcccaatgttttagaatgcagcccatcggtgagtctgagagaatggaagggctttgtcccatggggggattggaaaataatgtctactggggacacaaaccacaatttctcttggggcctccagccaaggaaagggggttccacttatgtccactgaggagccttgagaggcactttccaaaggggcatcccacctattagaaaggacctcccagcatgagagccttacactggatggatgaacacagggtgagcagccccaggtcagtccacgtatgaattatactgggtgctgaatccaggtataaggggcaaaggttgagggaaggctcactgttctggtgctatttgggatcatgttgcttaaaatgtccagaaaaggatggctggctttcttcacaggagaaatttagagtgagaaggacggggtctgagttccccaaaatgtgtgtgcgtttgccctggtcaagctgccgctgcctattgtgctgcatgtagggactggggacttttgaccagaagggttaggagagagccatcctcccttccaagcaaggcagccaaacctggttcactccttggcctttaggccacaccagggaatggccctggccagtggccatcagctgctagagggatactagagtttgtccaccagaagacgggaaaggaaagtaaactctaaactctcactcgatcgggcagtgacggtcaaacttctttccactgggaccttctgatccaccagggagtagctgcagtggggggccatcagatgtctccaggcttggatgctgtccactaagaggttggagttggagaagagaaaaaacagtgaacaggggagaggtctccatatggaccaccaaaatgctgctggtgtgactggctgggtccagcattgcaggcagtgaaagaatttaccaagacagtcatggataaagaaaggcagatttattgtagaaagtacgaagatacactgcaagagaacaatgaggtgcacagcagagaggaggttgtctcgaagagtcaggggctggagggaagttttataggcttgtgctggagagggtacgtgctgataaggtcatgctgctgggtctatgtgcaaaacaaggtatttgggaacagggtgttgtgcaagtgggttgttgttggttaaccagttctcagaacgatggcttgtcagccatttcttagaatgatggctctcccccatccttgctcctgttcctgccagttagggctcctttttttttttttcgttttgagacggagtcttgctctcactgcccaggctggagggcagtggcgcgatctcgacccactgcaagctccgcctcccgggttcacgccattctcctgcctcagcctcccgagtagctgggactacaggtgcctgccaccacgcctggctattttttttttttttgtatttttagtagagacggggtttcaccgtgttagccaggatggtctcgatctcctgacctcatgatccgctagcctcagcctcccatagtgctgggattacaggcgtgagccaccgcgcccagccccctttcttatatctatcaacttatgaggactacatgctcttcttgcctaggtatgaaacctatagtagtagtggagttcacaataatagcttcttcaccatagcctccacactgggtcccagcactagctcctcccttttttccttttgacctgggtgatgacagcttatcatggttgcaagcattatcccttatatatttccttaaccttaccaagcccattgtaagttgtcttttccttacagtttctattaaaaatccttgtggggaccatgactgattcagagcatctatttgtttttaattaaaaatatatcttgtaaaatgctgagaaggtaaaataggagaatatttcaatgaccttgaatttggcaatgacttcttaaatccaaaagcacaatccataaaaaaattgataagttggactttgttaaaatttcaaacttctgttctgtaaatgacactgttcagagaatgaaaaaataagccatagactgggaggattttgtgaaacacatgtcagatgcaggctagtatttaagatatacaaagaactcttaaaactcaatagtaagaaacaaacagtccaattaaaaaataggcaaaagatctcaacagataccttaccaaagaagatatacagatggaaaataagcttgtggaaagatgctcaacatcattagagactttcaaattaaaacgagatattactacacacccattagaatgaccaaaatcccaaacataaacaccaccaaatgctgatgagaatgttgtgcagcagatcctcttactcattgctagtgggaatgcaaaatggtatggccacttggaaagtgattttggcagtttcttacaaaattaggcatactcctactcagtagtaacactccctcatatttacccatatgaattagaaacttacatacagaaaaaaaaacctggacatgaatgtttacagcagctttcctcttaactaccgacatttagaagcaacccagatgtgttttaataggtgactggacaaataaactatggtacatccacatccatacaatggaatactatttagtaatgaaaagaaatgagttgtcaagccacaaaaagacatggaggagccttaaacacatgttgttaagtgaaagaagccaatctgaaaaggctacatattgtatgattcctactctatgacgttttggaaaaggcaaaactttggagacagtaaaaagatgagtggttgctggggactggaggacagggagagatgaataggtagtacaagggggatttttaaggcagtgaaactattattacataagatactttagtggtgggtactcatcactatacacttgtcaaaatccctagaatgtacaataccaagagtgaaacctaaagtaacctattgattttagttaataatagtgtatcaatattggctcatcaattataataaatgtgccacatcaatgcaagatattgataatagaggaaactgtggtagggagagggagtatatgggaactttgtattttctactcaatatatctgtaaagctaaaactactctaaaacataaagcttattaatttttaaatgtatcttaattattaatgtgttttcagcatgggtagaaataattgtgtagttttccctttgaactgtagctatatcaattcaactgatagattgcctagtgtgaagtaagtctgcatacctagaataattctacttaaaatggtatggccttatttttatttagcattgaaattgatttgttagaatttcctttagaatttttgcacctatattcataagtgagagtgtcgcatgtgctatttttttagttgcatggttgtagtgctttctcaagcttggtaacaagttaatttaatgtcaaaaataaattgagattcaaatatagccaattattatgcatatgtactctattatatatagcataaagtaattttatgtgatacaacctaatcttgtaaaatcttgtagtaaattttaaaatttctgaataatccttttagtaatatgcatagtaataggcctattcagatattctacttcttaagtaaaatattataatttatatttggccagaaattatacttttcattaaaactatcaaatttatttatggaaggcatatttttgcagtttctcttatttttgtagtttcctttgaatctgtagtcatgtcattttttcactctcacatttgtgctttttaatttgaatcaaatttatttaattaaaataataaacattgaaagtaaatacacgtcttttgttgggtttttattattaaaataaccacctttaagatttattaatttatcaatttaactgttttccctttttttgataatttaatttcagcatttatttttggtaacccaatctcctgtgaatcttagattttattattttcttaatttcttatgatgaataagtagttttaaaatttttaaatatttattatttaataaggctatttaaggatatgaatttgcttcagaaaagaaacttgagctcatctgctaagttttagcagtttaactgtaatgtaccttagtatgattttcttttttcttaaaccctacttggggtttgctgagctacttagggtttcttgaatttttgaattgatgtattaatattttatccattttggcaaatgctttgccattatatcttcagttgttgcttttggcccattgtctctctcccgcttcccctcttagttctattacacatatgcagttttcctaagactcatccatctttggtccttccctgtttctcaaggaagacccttcaaggatttgggctgagagactagtgggtcactctccctcaaacatggaagactgtggcaaatccactatctagatttgagcttggatctttagctcccatatcctgcagctttaaatgtggcaaacatcttggaggactagttggtaggcccagtccctctggggaaatacagtctctcaagcacttggagaataaagcagattttactctgtcttttaggaacccttagcctagctctcgagtcctccatgttcatctccagcacacagagaatttcttggggaaaacacctattaagtctgtgcttctcaagttatataatcttttgcgcccataccagccctgagtgaccaacaaaaacatctccggtttctctccctggtgtgggccaaatctgatcatgaggccttactaaacattagcaaaattcctactgttctagaagtctcctcctgtgaaattccagttcatctaattattgtttctacaactgtatggcgacttgaaacaagattttggtcatttgtctggctttttgtccagtaattgtgttgggaacattgggcaatcacaacatctacattccacttggaagttgaagtcatagtacaagttgttttttttttttttttttttttttttttttttgagagggagtctcactctgtagcccaggctggactgcagtggcgcaatcttggctcactgcaagctccgcctcctgggttcatgtcattctcctgccttagcctcctgagtagctgggactacaggcgcctgccacaacgcctggctattttttatttttttttttgtatttttagtagagatggtgtttcaccgtgttagccaagatggtctcgatcttctgacctcgtgatccgcccgccttggcctcccaaagtgctaggattacaggtgtgagccactgcgcccggccaacaagttgtttttttttttttaaacagctctattgagaaataattcatatgtgacacaatccacccatttaaagtatatgattcaatgacttttagtatattcacagagttctgcaattacaacaatcaattttagaacattttcatgacaatacaaataaaccttgcaccccttaaaaatcaccctcaattgctccagcccctgtagcccaaggcaagcattaatctacttcattttatataaattcctttattttggaaatttaatataaacagaatcataccatatggggttctttgtgactggcttctttcacttagcttcatgtcttcaagatttgtctcagctgtagcacatgtcagcacttcatttcttttttttttttttttatcacggaagcatgtttcattataagaatataccacatttttaaatccattcatcagttcatgaatatttgggtagtttccactttttggctattatgaacaatgctactatggccatttgtatacaaggtttcgtgtggatgtatgttttcatttctcttggtatatacctgggagtggaattgccaccctgttttccaaagtggctgcaccattttacattcatagcagcagtgtatgaggattccagtttctccatccgtattcttgccaacacctgtttttatccatcttttttgttataggcatcgtcacaggtgtgaagtggtatctcattgtggatttgatttcgattttgcagatggctgatgatgtcaagcaatccttgatgtgcttattggccatttgtatatctccttaaaagaactgtctattcaaatcctttgctaatttttaaaagtgagttatttacccttctattattgagttgtaataattctttacatattctaggtacgagtcccttgtaacagtggtcgccaacatttttgacaccagagaccagtttcatgaaagatatttttcacaaaattggaacagggggtgggaagcgcagggggaggggcacggtttagggatgaaaccgttgcacctcagatcatcaaacattggggtctcataaagagtgtgcaaccttgattcctcatgatatggtttggctgtgcccccacccaaaatctcatctggaattataattcacataatctctgtaatccccatgtgtcaagggtaagacccggtggaggtaattggatcatgggggtggtttcccccaagctgttcttgtgatagtaagtgagttctcatgagatctgatggttttataagtgtctggcatttcccctgcttgcactcactccatcctgctgccctgtgaagaaggtgcctgcttctcctttgccttccaccatgattgtaagtttcctgagacctccccagccattgattgtaagtttcctgagacctccccagccatgccgaactgtgagtcaattaaacctctttactttataaattacccagtctcaggtattttttcatagcagcatgagaatggactaatacaccttgcaggcacagttcgcaatagggtttgcacttccatgagaatctaatgccgctgctgatctgacaggaggcagagcccaggcagtaatgctcacttccctcaactcatctcctgctgtgcagcctggttcctaacaggccagggactggtacagtctgtggtctggggcttggggacccctgctttataagatacatgatttgtaaaaattttctcccattatgtggattttcctttcactttcttgatggcattctttgaaacacataagtttttaattttgatgatgtccaatttttgtatttttttcttttgcagcttatactttcgatgtcttatctaggaaaccattgtctattctaagatcatgaggatttatgcttattttcttctaacagttttagagttttagctcctccattttgctaatttttgtatgtgagataggacttcaactcattctttcttgtgtggctatctagttcttccagctccacttgctgaaaggccttttcttttcccatttaattgtcttggtacagaaattttaacatatagttttacatggtcattactttctaaatggtttgtagtagtaactttcattttctttttctttttagctaatatttacaatgttttctttttattctaaaattactggattttttgaaatgttttattcccattagtttttatttttattacatagtcatgatagagtgtgtcatatacaaataaaatttttttaaatcctgtagactacataagatatagtttttgttaaggttttccaaaaccttggaaaggtatattgtttaatatacactaattaaatctaattaattacattattaaagtcctctaccatcttaggtatatttttggtcatcttgatttatattatttcttcttcttcttctttttttttttttttttttttgaggttggagcaagagtttaatgaacaattgaagaaagctctccaccacggacagggggcccaaaagagggttgccctatttttggtcttcttgatttataaatactgagagcaaagcattaaaaattatttcttatcccttgtatttccaaatacttttatttattgtaaagataaatgtttaattaattaaattttatgacaattttatcatcactgtgatttttaaaaatgtatccatataaaatgaccatctttgcatcatctaatgcttttttacttggaattctacactgttactttcttttgatttgtgttgtttgagataccttttcacaagcctaaatttttaattctctttgttattttatttattgtattaatttttccctttaataagaaaggtttaatattttatttaaattttaactatgaaaatttactttcataattgataactgtcatattttattataaatagtaataataaacattatttgagcttcgattgtgagccagacactgagaaatactttttgaacattatcttattaatcttcaaaattaacctatggttaggtttgttataacccacattttatagatgagaaaataatagactttagggagttagcatttcatacctttattttcctgcttgtgtgcttttattttcttgtttccgctttttgtaagttgattatttttaatgtctttgtacttctaataactagaaagaggtatattttgtttttaattatctgataagtttcttcaaatctgagaacatgcacttgaaccaatatttatctaattagtattgccaacataaaacagtttctattgatgcttctttatagaaaattaggaaactggctgctttttattccttggccttcttctccagctaatttttaactttggttgtaataatctaatattttaaaagtgcgtaagtgtgtttgtggctgtgtgttgtgagagacagagggaaagactggagactcttctttttcaggagcattttcaaaatatttaccctatggtttcaagagtattttcaataattgcaacttttaaaaatgaacctgaatgttctttatttaccacaattttcatattaccaagttttttactttgctctgatgtactacatattcaattattatttttttatttttctccaaaatggcatggaagtgaactacttcctaaagacttgactatttactttgacctttacagatgagtgaaaatttgtttagtttatattcttgggttacaatctttcttttttaaatctctgtaaatgttacttttatttatatctgatgttcattgctatggaaaagtctgagacaaatattatttttattaaattgtaggtagattgacttttctgctgaaatacttggggagtgagcttttataaattttacaaaactgtgtccaggtctatggttttagtcaactgataatagatgaagtattttgattcacagatttaaattcttcaggtgaaaacatgttcttttattttagctttgattatttttcctgttctatttgttatattaaaacatacagacacacacacacagagaatataatttattaattctttcttttatttttattgtctctggattttgagtattttcttcccttcaaagttttgtttcatctgagtactatgtggtttcaattttacatttatatattagatcttttagaatttcctcttaagtataatgtgaagtatgggtccacgtttttctcttacaaatgaaaccaattgtttcaacattatttacaagaaagttcataatttccccaataaataatgaaagttcataatttctacagtaattaatgaaagctcattattcccccaaatttatacattcccaaatgaaagtctgtgtataacaaaggatgcattcatcctttatcaaacacaaattttttatatacttggatctactttctattctgtttcattggtctgtctattcatggaacatttccagaatcgtttaaatgcagcagctcaatgctatattttaatacctgatagggttagggctgccccccacccagtttatcttccttttcaggagtttcttagctattatcccatctttatatttcatgtgaattttagaatcgaatgtctagctcgagggggaaaaaacaaacttcttgctattttcattgtgattgtattgtttattcattctttttgggaaaattggcaagtttataatgttgacttgttctgtccatgaacaaggggcattttccttatggttcaagttgatcatgggtcttccaggagagttttcaaggcttattcatgagttttttttccacatttcttgcaactttttttttttttaaagacagagtcttgctctgtcgcccagactgagcacactggcgcgatctcggctcaccggaacttcacctcttggggtcaagcgattcttctgcctcagcctcccgattagctgggattacaagcttgcaccaccatgcctgactaatatttttattattagtagagacaggatgtcaccatattggctaggctggtctcaatctcctgacttcgtgatccgcccaccttggcctcccaaagtgctaggattacaggcatgagccaccgcacctggccacaacatttattttaagtattttatatttttttgttgcccttgtaagtggggtatattttttcgttgctttcttctaccgtgtggaggtggccacagtgcttcctgatgtataacacttcttcctataacttctagcttttgctatcttttcccctttaccagcaagcctccacattgcctgcttctttactagaagacttacacctatggtcctttgaaacatcaagcctctttctttcaattccacagtagccagtggatccctgaggcctcatgtccctgttctctatgtcccatctcagtacactcctgagatccacccctattcttcttgggggggtgctttttcttttcctccctgctacatcctcaaatgcagtcacacctcttccatccttgtccatcagagagactttagtcaggagtctgaaactgattctgctggtttgagaggttcttcccattacacttagagtctaaactattctttgtcttccagttttgttgtacatgagggttaggggtgatatttcttaatatcctcattgaacggtttgatttcaaaggttatatggagagacacagattcaggcagctactattgaaggtggggaatgctacctgcagcttttcagtttgaagagcatgtcatcattgtttgtttttgtttatggtgatagcaagttaagtaagtactatatcaatactaagcaagagaacgccaataagcctcaaataatttggtcaactagcttagaaattagatattaatttaatgccatttttcctttgtaatttaagttctcttgcaaattccatcttgtaagaaccaagagtggttcctttcccttgtccccttttccacccccagaactctttaattaattgatatttagctttgcattaccattgaaaattcactaagaaattgcatacctagtttattagagattataaacatatttatgagataaaacactcagtacaactctcactgaaattagtgtggtacatcaaatgatcatcagtcagtaattctggctatgaggttgacaaagaaacaaagtgatagatgtatatatatatacaataagataaaatatgcagagaactcttttccttacatatttgaaatcaagaaattttccctcagagtaaggcatcaaaaactttccttttttgtcagcctgtggaggagataaattgcttttgaaaattcgaagatggagaaatcccattttcaaaacagcttggtggaattcagttagcttttgatatattattgcctctgatgtttctagatgcctatttattaaagtaaatgcatagacaaagaaagactatttttactttgttcaatcaaaggtgagcttaagggagcaaaatagggttacctcaaataagtttctacaaagatgaaggattttatgtgtgggtggatcatttttttcctgagaaattaattactatctttagtcatataatcattatttcctttgaatatgacctttttcagcattctttttgacaaataaaattttgattttgaataatcactaagataccattatttgaattacatttaatattttaaacaaatgaactcaacattctagttttaaaaattaataaactcaaaaagtctgggatctactacagtaggatccctcttgcccctccctaattcttttaattagtgatgtcacattgtaaatttgcctttttttcttatcccttctgcgtatagatgtgtaatttcttggtgctcaatttgtatttgcattttcttgtatatacacagagctcaggtactaaaactttcccctcatggctccctgctgatccctggagcttagagctcactttttctcactggggctatctcttctcatagttggccccaatcaaaagagatggagaacttctgccttgtttcctctttggtccattttccgtaagcctttctctcttccacattcctcctgctatctgcttgctgcctccccggtggggccggagtttggctgaggttagaacaaacagcctgtctgaaatcatgtttgacatcaataatgtctccataccttgtaactttttccaggtttttctaatgcaaggtccagtatctttctgaaaaagagaatgttcagataactaatttcagtctcacctatcaccatttaacgtgacactcgcgttctctaacgtctagtgcaacatggtgtctctaaatatactcacaactgcccatttccatgtgtatctgaagagttggaactggaaatgcctcttttaatataattcaccactttctccaattaatataatttaccactctagatgagaaagtgatccttcatctccacaaattgggggcatattcctgccctgagtaccccacagggacctgtgatcattcactacttggggagaagtaaagacatttctatgtcctatatttcaaactactttggcctccgttttttttataggtcaatttgctgaaccccttaaatcactcaggctagccattttggttcatattgtttggagatccatgaaaataaaagaatagactgtcaagttttgtccaagatttctcctcagaaagacttcatctaagtaatacaaaatgtatactttgcttaatagctgaattgtcaagcatatttattttatgatgtaattaagaccaattcatggatttacaaggaaatcatattcagttctacaagagaaaggactttctaacacccaaacccctggaatgtaaagtaagtgggttgaggactgggggtgggtgtggatggggttgggttcagcagaagtcagctggtccctggtgattgaatggattccagtgcagcacgaggaactttaaacaaagcaggctctcaggtcccttccttctctgacagctaagactctgagataaccaagcacaggacaaaagctacataatgtttcagacaaaccaaataaaaataccattttcaaaggtatcctcagatgactcacattgaaggatttagatttagtcttgcatattttcccactgcacacttggttttatcattgcacttgggtttattattcttgctttgcctcattcttctttctgtctgtctcatcaaagtctttctcatcatttgaaacaatgagcaagaagaacacaaacgtcttcctcatttcttttcctaacacgatctcaggtggaatggaagggtgatggaggtgacagcagatatatcagatgtatactgttgtgatatgcttgcaaaatgcctagatgacaaggtggaagggaaataaataagtgtagcctacctttttttccccatcttcagcactgctatatttttctttttctttttctttttttttgacatttttcatcgttataaatgcctaggggaatttagtaataacataaagggccagtttataccctccttagggagccaacatactaatgagaaaagtatatatacaagtacatagaaatcttatgctccaaagggtagaataaaatgaaaataaaagtaatttagagtgaaagcaaaaggcattgataaaagtgtagactgcccccactcccccgccacccaccccacaatctgtcaagagctaactgtatggctttgaaccagactctctgggacttagtttcctcatttgttaaaaaaaaaaaaaaaagaaagaaagaaaaagaaaaaagccctgagaatcttccagttccaacatgcaaatttttgtgattttatgagttgccatgattttgtggacagcatatcaataactagccagaagtgggaaatatctggaggttgttctaatctgtggaggcctggatccctcctaagacacccctgatggccacagtcagactgagccttctgctggacagattgctagactcctgcatcatggtatgtcttagctttttatgcctcaaagatatttcagcacttttctgctggctttcctcctccatagagaatgggcagatagagaagtcaatacatcagcatttccttcctctttactaataacacaaaaatggttttactaatagcaacaagtagatggtggcttatttatagatttttctttttcttgcttagaagctggtgaaggctctcaggtaaaggaaatgacttgggacatctggctcctgttctgacatgtaaatactttggaaatcataattttattcttacaacaaaaaagctggactttttcttggaaaatcaattatatttcttggaaccacgagagaattgtggctttagggcaaactgccacccccaaatctggggaaatatagccaagatctgctcacctggagcagaagccacatgaggcataaactcataggaacactcaaatggaaattttgataaaccaggagtgtagactagcatgagagtcagaaacttccaggggtccccagtcctcagggaccccataccatcattggctttacctttaggaaattcacaggttctcaagatgaagatctgcaagatctcttcaaggttttggcaagagaagggggagagtaatctttgtgaaatgtgtctgcaacaaaggcctatgctccaagagaaaatactttgccagagtcatattccagtggaaagcaccccccaaactttctgtctactttatagggggcaaaagatccccatagtcaacaaggaccatggcttccaggaaatgggttggggaggctgcagacaggaaagggagtaggaggcagggggaagggacggtaccaaaggagaaagcttgtaacggttatagccccaagacacagccccattaaaagactgagatttattaataaaattagagaatgcttctcctcccctgcaccttaccatcacatcagcgggaatacagcacagctgaaagaggtgacacaaactctctctaagaaggagtacttagggaagcccaaaggtaagagatgagacaaagaaaaagacactagagaaatctgaaacctctggctatatttatatttgtaacatacaactatagcaaacactaaagacaaacgaacttctctgccagacgaccattaattcttatactaaatgcctatttacttcacttcctagtactcgatacattgtatctgactttcaacaaaaaattataagacatgtcaaatgacaagaaaaaaacattctgaagagacaaaacaatattaagaactagactcagatatgaaacatatgttgtaattattatggaatttaaagtaactgattaatatattaaggtaattaatggaaaaaatagacatgaaagaacaggtggataatgaagtagagagatggaaactctagaaaagtatcaaaaggaaatgctagaaatgaaaaacactaacagaaatgaagaatgcctctgataggctcattagtggattagacacagccaaagaaagaatcagtgagcttgaagatagatcaatgaaaactttccaaactgaaattcaaagagaaaaaagaatgataaaagcagaacagaacaattaagaactgtgggacaatttcaaaagatgcaatatatatgtaattagaatactagtaggagaagaaacataggatggagcagaagaaatatgtaaagaaacaatgactgagaactttccaaaagtaatgcaaaacaccaagccacagagtacaccaaacaggataagtgacaaacaaacaaaatacacatgtaggcatatcatattcaaacttcagaaaaccaaaaacaaagaaaaaatcctgaaagaaaaaaaacttagatgtagacagaaaaaatgcaaacttcactgttttacttatcatctgagagattttggactttattggatttaaacattgttggttttctcactttgcacaatggatggaataatgttaaataattataggtactatgtttttctttatagaagtgaagatcaaacaaggtcacatgtttatgaggaagcaccttttaattgctgcattctctaaatatgaagagttacaatgattaacgaattgcatccttgtcacccctccaagcacattgagataagctttctcaacaaggagaatcttgagatgtagtttgaatcacaaggcattacctaatggatataaaattggatagtgtttttggcttagatgggagcagatctgacgtttccaaggtaaaggttaatggagaaggtgagaagagagtgagatgcaagctcatgaaataaatggttggcgtaggagctacccagttgagatgtgctggaatcaagcaggcaatgcagatctatatagaaaaaaaactctcagaattcctagggaggtatctgaagccaagaattacgactttttaatttttttgaacttactagggcaaaaatataccagcagcaaaaagatcagaaaaacagactttagtaagagagaaactgaaataaataaatgacatttgcattgagcattaaagtttacaaaacactttcacatgcattgttattatttgggtttcataaccaacagtgcttagactctgataagttaagagattttacaacattgcttgacatcaattatggttgaataattattctccctgcttttaaactctgaaccaaatggctcatgaaaatacgtttctataaggacaggaggtagtggtgacaagcagagaaaattttcatatagacatttaaaatttcaagattgtgccaaaataaattatttatataacagtttataaaacacttgtgtgcaatgatctcaggtaggcagtagtggttgtgctctttcttgtttagattaaaagtcaggaaacaaatctgtaaagtgccatgcccatcatgccacccacagctattgaatgtcagggctgagattcggagaatttgagagttctaactcccagcttgccttagtcaggtcaggctgccatagcaaagtgtcatagagatggtggcttataaacaacaggcatgtgtccaagatcagggagccagcagggttgggttctggtgaggactcccttccaagtttgcagacagctgccttctatttgtgtcctcacagtggggagacagggtgagagagagctctcgggggtcccttttaaaaaggcactaatctaatttatgagggccccctctcatgacctaatctcttcctaaaggccccacctcctattcccatcacattggtgttaagattccaatatatgaattttaagggaacacatttagtccattgcacaacctgatgttggttttaatttgctttccttgctgttgtctttttcctttctcacaagcacacccctcatttgaccttcacaagaaaaaagtgatgttctactttcaatcatcctaacattttaatttcatgagttcatttctaatcaaatctatttctttaataactcatttaagaaagggattctttttgattttccttcctaccatgtgcctaaacccgcctttagaaaaaaatttgttaaggaatctttggtggataattttcttaaatgacccatggctattttagacacctggattagagggttcttccttatccctcatctcagaagtctaaatgcagagaacccactcccatcaacaattcttgatatgtggctccatcagctctatgatcaattctatggctcaaaaccctgttcttgcaatctgactgcattttacttcaaatgggaatctgggctataaatagcatgccaaaatttctcacatcggctacaatggtgacaattttttttttaatttatagtatatattgactcttttctgttctgaaacaaatcttaatagagctttttgctaccatcgctctctgcacacagggcttccttctggtttagatttagcacagtgatgttgagacataatcgtgccgccacaccatggctaattcaacatcatttaagctgcactgaaaagttagatgttgtttctatctgactgcatcgctgcacagtactgctgggttgcattccactttccacctctgagtcattggccatccatctgtgttgtctcaggcccatcctacccagccctgaattaggaggaaggcatcgatgtgtactgatagcatatcttagtgtctgaggtgtgtgaactttacatgctcacttattaataaaaagattagtgaatgtagcatcaacaggcattttgaatgtcacagatattttccatggagatgggcagaactaataaaagcttaaatggagttgccatatttcatttcatcttttaaatgataactaaacacttgcagagcatttcagagtttacaagctctctatgttatttcctttgattcatatgaagtacatatggggagagattagagatggggacagtcagatggagctgagaagagtgacactgagtgctcagcttaagggggaaggggcctcaaggctgccgggaccttctctcctctccattgctcactgggttactctcacttccgtttaacaccctgtagatagatcctcatttaagatagtgttttttggtgctgttctatattccattttccaaccatttgagaaactgatgaaggctattgacttattccctaggaaatgtatacacatgcaccttccattttacataaatttcaggaaattcaagacctccagaagctcagtcatcactctctgaggtaagacccttagggggagtcaggaccccagaccctgagctatatccctatccatgatctgtcttatgagctccagacccacatttccaaccaaccaagatgaataatgtctttcttctgccaagataacctccctctttggccccttcttttctgatggtttcctttcatctccatccccatgccccctacctttgttcaggtccgtgtatctcccttgaaccatcccttaatccctgagcctgtctccacctttaattctcactccaatccatgctttgtctttccacccaccagagtctcttcagggtagtcatttgcttaaaacctttcagaggccctgtaacccaggagctaaatgccaagctctttagcacagcttatcagaagcgtctcggggagacagccagctcttcctgccttaaaaacctttcttaagtcccttcctttccatccatacaagtggcctgagtcccctgccttgtgaaaaaactctctactgctcgtatgcatcgagctcttcctctcagccacatgtgcattgttgggaatgctctttcagtctcatatcccatttctctatatgttgaactcatacccattcttcaagatccacctcttcagtggaaccttcccaactcctccaggcagagatagctgctctctcctctgtgttcctgtggaaactgtatacacgttgataggggcccttggtacattctgatgatgcacattcagaccgaatctgcatttgattagaatctgaggtttttgagagctggaccaggcgtcactttgatttttattctcctactttctaccccactcaaagaaaattttacaacacctggaatgtagtagaaactcagtgtatgcaaggatgactggcgctgctgaaacgctccagaaagctggctatggggaaacagatttcagtcatttcatttcacttcagtttcttattttggtccatttttccatttcacagcctcccactgcctctaaaccacagatagaaatgaaatttaaagaaggaacttaagtcaagagttaattatactcagtccttttagaaagctctagttttaatatcctgaacacctacatttaggccctgtttcaacacatgtggaaatgctataaagagaaacaaagtcccacaaagcaatagaggcgatgaacctgattcaccgctgtcagttatccaaacaagcctggttgacatgtctgattgctggataattaccttccccattcctttgcctatatcaatgtgcctagtgtataaaatacaatcctgggaacatttcaggctaaagggagggatgttgtttgaatacctatgagtaaatacgatgcacattaaacattaaaacatacttagtttccatagcattgttttcttttaggagatcaacttcatgagccttctctacctgagagaggactacaaatactgttttattccatgatcaatcagctgagtgtagaaagaaatatattacctcttcctcaggtaaatcatatttcctcttctaaaggatggttcagttttcctttcttaagggggagatcctgaggaaagatacccaatcatgtcaacctcagtctaagtttaccttgttttcaatgagtggaggctcacccaaaaagaaaaaaagtgaaggcttaacatggattattcaacgactggattaactgagtccattacagtgaatctccattacggtgaatggagattcactgtaacactggccaccaggctttgaatcaaccattcatataaagttagattttaaaacattgtttacaaaagaacaaccttattaagaaggcggattgtcataccagtgttttcaccctgacactttcaatccctaactaccatgtcttttattaacttaatatgtggcatttatttggggtttgttgacaagcaagtacatgggaagagaatagaagacaaaaataaataaataaatagatgtggaagacaatgatagcagctaatgtacgaaattagcccacagactctgatcttatagtctcacctgctaagtgtaatgtacggctcttaatgtggaccaagaaacatgttatttaaacgctgccctaaccatcacccccgccaaccaaaaaaagtctaaatatggacggtgcactttctaccttgttttgaacacctaagacaacaaaatagataatgagactcaaatcaactgttgtattccagctataaagaatgacaaaaataagcgatcgatcctttgggcacactgagtttagctccctccgctctgaaaactgctttaatttttcacaacacatttagcaggcaatcatctatcccctagtctaataacattgggtacattttataattagccataaaatacttctttttgccaagcccagaaattaagtttgagcctcaagagtgcaaaaactcttagcagccagaaacggccttttcttggtagttcacagtgtgcattttccgttgccttgacaactgtctggctggggcttccttgcttggagaacgaggacgcctttgcctgatagaaccgttcagaaatgataatgaacactaagcaaaatgatgccggcaacagcaagtttgatacatgaatgtcagaattctgcctgaattacatctgcaagaaggatagaagggagggagggacagaagacagaagggctaggaaagggttgcaatattgaccaattttaatttttaaaaagttggggctaagttcagcactcagccatgctataaagaagggactgactgtgaagcaataagatacacaaaatttgtaagactcactctggcctctgatagttttgtcagaatacaatcagcatagatgctctgatgtttcatccagtaaagaccagaaaagcacaagagaacgtgaaaaatccatgttctgttgggtcacaaacatctctggctcaactcgtgatttttgtttaggttttttcccacttttatccttcagggcagtgagtctttgtcatttggggttgggacaaccctatcctgttgcaattcatcagcccctggctgttcctgatagacagggatgatcgcagtttcacttttcttttttttttttttttccttatatggatcgtgcttttattaaaaaaaatttttaatatcttcatgactttttattttattttattttattatgctttaagttttagggtacatgtgcacaatgtgcaggttagttacatatgtatacatgtgccatgctggtgtgctgcacccattaactcatcatttaacatttggtgtatctcctaatgctatccctcccctctcccctgaccccacaacagcccccagagtgtgatgttccccttcctgtgtccatgtgttctcattgttcaattcccacctatgagtgagaatatgtggtgtttggttttttgttcttgcgatagtttactgagaaggatgatttccaatttcatccatgtcactacaaaggacatgaactcatcattttttatggctgcatagtattccatggggtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggactcgccacacttttcaatttaaagtgcagatggtggagttttgctttgaggagtttctgacagcatttggaatcacgaaaaggctttggggtttcctgacgtctcacttaaaaattactcgtttttagtagcaagtacaaattctagatttcaaagtttgccaactttccttgaatcttaatttaaaatacataatgccaacttcacatacgcacatcacttaacagttaacaaaatcattttatcctcataatctttttccaagctacacaaaaaaaatcctatgagtattaccatcctcattgtaggggtaattgaagtgtggctgacaactggacagtcttgggagcacctgtttgactaactttaaggcccataaagaggcttctttctggggatgaggctctgacccatagagctagaccccatgggttatgtgtaccacaagatgtgatgttcaattttatgggtcaacttgcctagtccacattacccagaaatttgatcaaacaccaggctgcatgttgctgtgaagatgtttttttaatggactctaagtaaaacaggttacccttgctatagtttggatatttatcccctctaaacctcatgtcgaaatttgattactagtctttaaggtggggcctaatgggaggtgtttgggctggggagggttggatccttcatgaatagattgatgccgtccttgaagaggaccaatctaagccttgtctttttccctcttataattttaaatttggaaaggataaattaaggccaagaactgtgggttcagagttaaagaaccagcagaaagtctacaaacttctatgactaaggttcctgggaatgtactggtcgtcctttccccaaatctgacatgtttgaagtttccttcaaactagaagattcaaactagaatcttccagtatctttgctctcaaaattaaaagcacatagtctctctttttttttcttttgttatttaaagttagccagaattgctttttattctttgcaaccaagataagctttgcttttacggcacatatacggaatacctccatgttttgtttggtgttatagtctccctctggttggtgcgccccttagataaagaggtcgtttttcttcccagtctccttatcttcagcacctggcagtccctgacacatagaaggtcttccgtatatgtttgctaagccaaagcattcgttttttattgctgccttaacaaattgccacaaatttagcatcttaaaacagtgtctatctattatctcacagttttgtaggttagaagtccacacatagtggggttcagcttgttctctgctctgggtctcataggccaaaatcaaggtattagtggggctgtgttccttcctggaggtttggggaataaatctgcttccaaagtcgttccgggtgcattcccttgcttgcttccttgcgggcatcgttctcggcttctaaagcccacccacattcctcggtggtcccttcctccatcttcatcttcaaaactagcaatggcagacaaagttctcatgtttccagtcccaccagcccttctgctgcatctctctggcttcctcttctgcttttaagagctaatgtgattacattggacctactcagtaacccaagataattgccatattttcaggtcaggtgattagcctccttaatttgggttgcaaagtcccttcacagcattacctggattagcgcttgattatataaccaggggacgacatcttagaaagacagctttagaattctgtccaccatagtgaaagaatgaggtcagttccagatacgtccaagccaggcaggaacggggcgcagcagcggcaccctggcttcctctcttccagagccctttgcttccagttaaccttatctgtgtggctcccagggaggagattagcttccagcagtactctggccctggtctttggcttttaaagaacatggaggtctttactgccaacaataaatgcattctaccaatattttttttcagcaaacgatatattaaaaatataatacatcatgtccaagtggagtttattccaaaaactaccagactgatttaacattcaaaaagcagccagtgtaattaacatattaacagactaaaaaggaaaaaaaaatgtatatattcaatagataacagaaaaagcatttgacaaaagtcaagatctattcgtgaaaaaaaaaacttgtgatcacctaggaacctgcctttaaccaataaaggatattgaaataattaattataattatacctattagtgaaagactttccatcttttcccctaagatcttcaacaagtcaaggaggttctctcactcctggtatccagcattgttctgggttcctagtctgtgcaatatggcagaaaaaaaaaaaaaagcatacagactagaaaagaagaaataaaactgtctctagttatagatattattctctacagatattattctctacatacaaaaatctaaaaaagaaactagggaataaaagaaagcttctagatttggtaagcaagttgatccaagtcacaggacacaaggtcaacatacaaatattaatttatatacactagaaacgaaccactggaaaccaatttttttaaaataaatttacagtggctcctaaagtgaaatacttaggtataaatctttttttttgtttagtgtgtagaatctgcatgctgacaactataaaaattctgataaatcaaacaagatctaactaaatggaaagatatgccatggtcaaaattagaatacttaatattgttaagatgtcagttctccttaatttgatctataggttcaatgcaatcccaatcaaaatccaagaaagcttttttggtagctactgaaaaactcattctaaatatatatggaaaagcacagtatctagaataaccaaaacaattttgaaaaagaagaaaaatgttggaagactcatagcaccaaatttcaagacttatgatgactctacaataattaagataatataatatttttaaaaggccagacatacatatcaatgaaacagaaatgagaacccagaaatagatccacgtaagaatagccaattaattttggacaaaggtacaaaattaattcaatgtagagagaatagtattttcaacaaatggtgctggaattatgaaaaaatttcatattcatgtgaatatttcatttatatttttaaaaagaatattaaactatgcttcatattttatacaaaaaaagtaactcaaagttgataatagacttatttaaattgtagaactataaaacttatagaagagaacatggaagcaaattgtaatgacctttggttagacaaaaagtatttaaatataataccaaagcacaatttataaaagaaaaaataatggccaggcacagtggctcatgcctgtaatcccagcactttgggaggctgaggcaggcagaccacttaaggtcaggagttcaagaccggactggccaacatggtgaaaccccgtgtctactaaaagtacaaaaattagctgggcatggtggtgggtgcctgtaatcccagctactcaggagactaaggtaggagaattgcttgaacccaggaggtagagattgtagtgagccaagatcataccattgcactccagcctgggtgacagagtgagactctatctcaaggaaaagaaaaagaaaaaaaaggaaagaaaaggaagaaagaaagagttggactttataaaagttaaaaatgttttctctgaaaaggacacgcttaaaaaattagaaagacaatccacaaactgggagaagatatttgcaaatcacatttctaacaaaggacatgtgtccagaatacaataaagaactctcaaaactcaaaaataagaaaatgaacaacccaatattttttaaataggcaagtaatctaaacaggcatgtaaataaagatggtgcataagcatatgaaaaatgattaacatcatcagtcatttgggaaatgtaaataacaccacaaggtaataccactgcctgcctattagaatggctaagccccataaatcttgataatactatatgccagcaaggaggcagagcaaatggaactctcatatgttgctattcgctcaaagcaaaaatggccaaccacattgataaacagttgagcattttcttatagtgttcaacttgcacctaccatatgactcagcaatcccaatcctagttatttacccaagaaaaggaaaatatatgttcacataaagacctgtatgtggatctatatagaatctttattcatagtggccaaaagctggacacaacccatgtgaccttcaaacaaggatggataaactatggtacacctgtatcatggaatactactgaggaataaatagaaacaaattgttaatttaaacaacaacatggattaatcttaaattcttttcagtatgtgaaagaagttcatcccaaaggctgcatattgtttgattctatttatacaacattctggaagaggtgaagcttacagcttccatctttataagatggaaaacagatcagtggttgccatgagttgagtgatggtggggaggacaaactacaagcagggatcatgaggaaattaggggagtgggaatggaattgtgctctaagaaactatagcagtaaatagatgactatcactttgtcaaaatgcataaaactatatgtcacaaagagtgacatacaaatttgatgtacagaattacaattttgttatatgtaagttaaatttttaaaatcaaccagcatgttggctgaatggaagggggggcagttgagaagaaacacagacagtaagaaagaaacccaactgtgtcagaaattaatcaatcaccaaggctcactgagacaggtgggggacaaaagagctgacctaggtatctttggaaaccctgttttgactcgatactggaaggctaaagacaacaagaactatactccatgctgtattttatttggtaaatttgtttgtctctgggttatgagttagcaaaacaagaaatgtatggtagatgctgtgagtcaggctctcacagtcagggaaaggcattacaaataaggaagaaggctagagtgaaccatgtggtgctgaattggagtccaaagtatcaatacaaacttgtgtttacttaaaatatataaacagataaatatatgcagaaataaacatagatacatatatacatatgggttggtacatatgacatgcatttcctagttctgtctgctgagatgacctagtggaaatgacattctagtagcaatgagcacatctattgcccagatcttggttctaaatttgactttgcaataaaaggaaacaggacttttgaagtattggttaattccaaagctggagcaaagaatatataagacgagcatagaggatttgtggtaccagagagtaaagaagcagtcaaacaaaagaaatagaagcttgcaatagggggcacgagccagcctgtaagagctcccagcggccaaagctgaaacaatttgatcaggaaaataaattgttatagtattgcattattgcattcttatccaaagaataaaataaataatgctgagttcatactgatataaataagtaactgaataaataaatagatgggggagaaggaataacacttccttctagagaaattgcaattaataaatgtagaaagaatgtggaaaatacaaccagtaacaaaaatttctccagtcaagatctacacatggataccaaaattagtgagcaaaatttaaaaaaaaagaagttatttttatagcctcaaaggacccccttcaacataaatgtctattaatcacaaaaagaaaaataggaactttccagtggataattttgacaggcacacaccaccctagcctagtaatcgaggttaactccatccaccttagcctaaaaattgaggttaacaccaccaatagtaaaacagatagtcatcacgtactctctgacctgatgccctgagaagggcccatcacctctgttattcaaccccaaaatgtacaagctcaatctcatcgtgagaaaacataagacacaccaaaactgaaggacgttctatgaaataaccgaccaatgctctttaaaagtaagaaggtcatgaaagtaaagggaacaccaaggagctgtcacagatccaatccaggatatcaccctgtttttaattgtcatgtctccttggaaaaaaccaataaataaatgggggagaaggaataacacttccttctagagaaacagcaattaataagtgtagaaagaatgcagaaaatggccaggcaggatggctcacgcctgtaatcccaggagtttgggaggccgagaagggcggatcacctgaggtcaggagttcaagaccagcctggcccacatggcaaaaccccatatctactaaaaatacagaattacctgggcgtggtggtgcacacctgtaatcccagctacttgggaggctgaggcaggagaatcgcttgaacctgggaggcagagcttgcagtgagctgagatcgcaccgttgcactccagcctgggcaaaaggggcaaaactctgtctcaaagaacaaaaaagtgcagaaaatacaaccagtaataaaaatgtggaccaaaccaagtagatgtgacaattaaatacagggtgatatcctggattggctctggatcagaaaaaggaccgtggcagaaacactggagaaaactgaataaagtctgcagtttagttagtagcattgtatcaatgttaatttcttagtcgtcatcttggttgtatggttttgttagatgctaacattaggataagctggattagggggatacggaactctgtactatttttgcaactttactgtaagtctaaaagtatctcaaaattaaaagttttttttttttttaaaggaaatgggttaattttcactgtgaatgttctaatacttgcaagctatttatctctgggtgaggtgtcttctctccacagaagctactttgattctctcctgccagcctgatactgattaatgttttgggcaaatgtgttcttccctttttgagattctgttgttcaccagctcagtgcccatactattcatgtccattaccacataggcaaacacactaaatgtgctgtcagtttctgcctcctatttatagtcctcatgtttcaaacaatggaactgttgatccaatagatgctgctatgtctcctgaaatcagacagcttgtgcaggagtcatttaattaaaactttcagacagaagtacaattgtctgttgggaaggggtgcacaaaggaggttcaaggcctaatcttagagggatcaacacaaaacccagttgcttttgtggttgctgagtgataagtgcttatggccttggccctaacaaactcagtctccttccccagtcaggcatcagtgggaacaggctgcttggctggtggggggtgtctgtagggaggtggggaggaaggggcagcgaaactattccctgagcctagaccacagcttggcatcttctcctaggcttgtacagcccaaggcattttgtgttatgaggaactcccagggattttcccaaagtcttagaaactgcctaagttgtgggatgtagaggggggtgtgtatgcctgggggtggagtgagggtcattgctcacactgtaggaggttgactagaaaggaaaaaacaggatcaagccgaattgatctcctggatcctttcgctctattccaaaaatagaaatagcaaatgtcactgaggttgggcaacatgctccacccagattacccaggatttgtgatctgagtcaatgagcagtgccagcttggcggggaggtattgaggaagggcttagtttcttcccaagacatgctgctgggtcagaacctggtcagcaccacctcctttgctgattcagtttgtcctcatctctgattgggtttgccaaagtctcccaaccatggaggggtagattcttgcacagagcagagtgacttgaacattagaagttgggttataaattagaagacggaaagactgaaaactatcagtaataagctttacaaatctgggatgaaggagccagtgtttgatttcctcattagcatccagctcagaatttgcaacaatcaatgagttgaatatttggtgagggaacccctttctcaattgagctcatgcagagacacacgatctgactctttccttttctgtcctgaaaacaggtgcccaggaggcatgtgtacatctgcatattcttctaattgtatgtacttgcatatatattcatacctgaagttctgcttgttttcatttgggacacatgggaagtgctccctcccattgcaaaccacagaggcatctgctaaaatctgctgtgtcccctgtgcgggtgttagcgatgcattcagcctagcagcacagccagaaaaagcagcatgaactggagtgaaaggtgaacagttgacactttgagagatgctgcttgagctagtgaaaaatcttacaagagttaccaaaatagtcagtagacctctccagatgaagtaagctcaagagagtaaatttgactattataatacagtgtattattcttgctgttaaaggatgattagaaacacgcaaataaagttatgcatttcactttgtttttcatttcaccctggaccatgtcctcccagcacacgggacaaaagataaagggagatagcatcctgactgatgatgacataaagcagggaagcctttttcaggttcaggcctaagacatcctaagatatgactgagtcttcgttctctgcaaaacaaaaggcggtgggtgggcggggggcgcgttaaatcaaacttattttctgaactcaaggcatgtagtcctcaaagcagtattcccgcatgaacatctacctcctgaaaatagggaacagcccaccatgggcgctcagagtgaaagcaatgtgtttctactgtcacttccactttctaattgtgagtcaggaacccatggtctgaacaaattaacaacagtagtgtgtgttgtggggaggaaggtgacatcagaggacaagcacaaaaggaaaatcaaaatcaatttctttttatagacatggagtctcgccctgtcacccaggctggagtgcagaggtgcgacctcagcttactgccaacctccgctgcccgggttcaagtgattctcttgcctcagcctcccgagtagctgggactacagacatccaccaccatgtccgactaattttttttgtatttttagtagagacagggtttcatcatgttggccagctgttctcgatctcctgacctcaggcaatccacctgcctcggcctcccaaagtgctgggattacaggcgtgagacaccgcgcctgacctcaaaatctactttttaatattaaaaacttgaaacagtaacatttaagtctaatatgtggttacgtgacatagatagttacatctgatacacatatgcacagtgtctctctctcatacacacatacaattacacaaatacactgtcacatgcacacactctgcttgcagctgtgcacattctgcggttgctgggtaagaaacattacatttattcttactgctcataagactgcacatcgtgctacaggctgatgcatggaaaagaagctgccccagccagggacatccacggagaggagacagccccgtgtctgtggagcagctttgagaacaggacaaggccaagtgtgcatgaacagattcagctccccaaaacccggccgcttaaggacatgcaaggtgctgttctggttcctgctaatgcagaacctcgcccccactaaggacagtgagtgacagtctggcatgcagtagaggacgggcatgtaaacccgtgtgtgctttggaagtacagtgtgttagggacaaagggtcatatcataatagccttaagtaggaaaggactcgttccaactggagtcagggaaggaaacctcagagagggtggctcggtgggggaggcaggattcgagttcagttgtgacaagtgaatcaaatttctataggtgaggaggaggggaagagcatttccaagagaggaaacagcgcaatcagatgtcactggtacatttgatgtaagggtttactgggaaaatggtttcttcaactctccaaaggcctggcccttatcattccatattgaatatgttgctgggactctctgaggattcttttaaaatccccaacgttttgttaataatgatagtggctcagcaagttggttctctgctgcattcagaagctctaagacgtgagctgcaggctgcaatcccctctgagagtggctgcgactcagttgtgtacagtcacgctgccgaggacagaaatatgaaagtcagtcattgtcacccacatgtttaaaactgtggcaaattgtactgatcacaggagcaatttcctccaactattggaattaaatattctcagagtaattccttttaaatccagatgcaaatcctttagtgtctatagatattaaataagaacctgcaggctctgacttaagtttcctactgttatcactctcatattctcagtagataagagccaaatgtcactgggtgccgagtaaatatgggaagctcagatacattgcttttatcaatgtttggctggcttattcggtttaaagcctgaaccaaaataataacacatttagaggacctgactgtccttaaaatgaaattattatactgaagaaggaaaatatcaggccatgcttctacccagtgggacaagaggaagaagtctagaatgcagcttttgggtagccaacaacttgaaatttcttaaaacaggacaaagaaagcccagcaacatgaatgagttattccctttatttgagataagaaaagccactaaccctgagctgaggatatttttacctgttttcttcttccattaaagttggggttctcttacaagtccaagtgaattttagacacatggaaccgatcaactttgaatccctgggaatattttccttaagagtggtggtattacctgtctttatattgaactcttagggacttctgccttgccatatctctcccttgtctctgaagacctagacctttctttttccttccttcctattttacttcctgtgactgtgtcttgatgatcgtattagcttcttgttctcaacttttttatcctcactacgtggagataaatgtatgtcactgaagttcttaaataagtggagtcataagaaaaacatggactactaatctgaaactacgatagagtttgaacctgtggtttgaaaaacagaaaattttgaaaatggtaaagaccaaaattatggtactgtggttcatagtgaagtcagtgagagacagtttagaggatgcccactgtccgatggggtatctgcctggtcccctagatcctctcaaccatgacatctgctaccactccctaatccaggccttccaggtagctgctcataagccctttctagagagtgattgggactaccaagcgtaagctgcaaagagcaatcggacatttatatgaatgctatgtagaacaaataccagagccctgcttttaattcttcagattatattattgaggttgttatgatttgattaattacgtatcctctgaagaacctgtattgtacgctagtcatctgtccaaacagaatgacaacaggtgtgcacacaggtatgcaaacaactatctagattgtcagaagccacagccaaatgaagggaggatgatttaccccattccctttagtctcagtggggcagctttccagctacctgttttatgaataaagcagtatttggtcctgcacaccctggagacatgacccacagagaaggcctgttttcttcttccgaaggctgtcaggggtaccaggcagggccctgcctcagttttttgttgtttgttttttaataaaagttgaggccaggtgcagtggctcacgcctgtaatcccagcactttgggaggccaaggcgggtggatcacgaggtcaggagttcgagaccaggctggccaaaatggtgaaaccccatctctactaaaaatacaagaattagcccggcttggtggcatgcacctgtagtcccagctactcaggaagctgagtcaggagaattgcttgaacccgggaggcggagattgcagtgagccgagatcataccactgcattccagcctgggcgacagagcaagactctgtctcaaaaaaaaaaaaaaagttgaaggagcacagaaaatgagaatgtgtaggaatgtatgacatgttatgagagtgactacagatggaccatgccaggtcaaacagaggggccaagagggcagtagaagtctccaagcaaaacaccattgctgggagtcagacgtgacctcaggcccgggctgaccagattcaccttgcgtaatccactctgtgtttcatccttgtcatgaagaaaggacttctgttaagtacttactggttgatttgaaagcttttgacttaaagtcagctcctatttaaaatatcacacccaagggcccattataatctttgaaaactttgtaaatcttcattcctgtctttgtactggcttagtaccaagacagcaatcaaatagaagaaaaaaacacagtggggcaactggagcaaaccatctagtcgaataaatgcactttactttaagctaactcaattgcaaatattgagtgcaacaatgtgaaacaagagatgaaacatatatcttaacttaaaaaaaaaactgtttgtaaatgtcttatttggcttcatgctgctacatggaaatacttccaacaaaacgctcctactgcagataaaaggagcaaatgtgctcactcgctaacctccttcctttggccattaaggcaaaaacaaaggtaaagcaccatgtttataacctttaactatgtgacaggatattatttcatagaaattacctgaaaatattgtgcacacgtgcaaaataaaatggaaagttgagacacagtcccaataatccaagtgagcaggataatttttcccagacatctgcaaatccttaagtcattatgtaaatgtggatgtctaaacttgcgggcctttgtaaatctggaatcattgtgcctgcagctgcaagcagctgagagtgcaagaggcaaaaatcaccatggttcagactgcgggctttggagacagactagatgaaaccaaatttcggtctgccactccgtagctatgagcaaatcctgaccacatgggcttctgtttccttatctttaccataagtttctctgcattagagcactaatgcagagtagcacctggcactgagtaaactcagaatggatattggctatttccactaagaaatcatggggttcgggtgggtgggatattgattgcctcaattcacaaatggccttgctgaggaccagaaagaatgcagggccctataaataggtgatgtcctcctgaggaacatagccatgctcacctgccttgagcagctcctgcagagaggccacctctctaggcccattagtcactgcagaaaggtgcactgcaggcatatataacattctatatgccaattaatatatagtatgactatcgtagggtcatcattttagctcaaacattatgcagaggtgcaaacgtttccttcagaagccagcaccacgtgacagctcagaagctgcagcaagtgctttacgatccaaacccaccaggagagactcttgaaaggacaaccaccaataggaatgtcaatgaaaatccattgcgttactatctcacaaccgccatgcatggtcgtgtgtgtgagtgtgtgtgtgtgtgtgtgtgtgtgtgtgtgtgtaggcttgtgagaccacattcttccttcaggataaaggttttgatcacaccactgtatgattgtatacagacataaattgtatgcatatattattgtattaatgcttttatatactgcaacatacagttttaaaagaatgagataaaagttactagcataaaagtttaaatattttctttctccttgtggactcctgaagaccacgcatgatatgaatcattgcagatggtccagttagcctgtctcaggaataattctagaatctgagccatctctgttaacactatcagctgaataatgagtatctctgcttacaagttcacttggaagtcaaattggaggacattgatttgactcagaaagacctactaccattcctgggataacaccttcaagagctgagtcccctgatgtggggcagctggtcaaccttgcaggtgtggaacaacaaaagaactagaaggagtgcaaggcctgggggaggagagaggcaagcatgggggttattgttgtcagcaaaatgttaatgtcctttcccaaaggcatccttttgctcagcattctagactttctccttgtaaacatcataaacatatttaaagccatcataaaaatgccatttggatcaaagtgatgcagtgtcatctccctctccacatccgaatttttggattattactcccaagtcgttattacggccgtactaatgtgggaaggccgagctggcgtgctgccaggaatttttattcttttccatccgcctcccactgacaaatctacagatccatctccccagcttcccttcctactacagtgaacgccatgggctgattcctccgcgtgtgccttggggtccatctcctatattctccccaaatattctctccccaaatattatttctgtctctcctctgtcctttcattcccccattcccccttagctgtctctctcgctctcccttctctgtctctgtcattcctcctctctctctctcctttctctctctcattcctcctctctctctcccttctctctatctctctgtctcattcctcttctctctcttccttctctctctctttctatctctctctgtctttctcatttctcctctctctctctccccttctctctatctctctgttcctctctctctctctctctctctctccaggtccacttatcctccccgaccagatcgttcacatcagtatacaaacttgactcatcttttttaaaaatttaggtaaaatatacatatataatttaccatctttacattttcttttctttttttttttttttgagacagagtctcatcactctgtcgcccaggcaggagtgcagtggtgcgatcttggctcactgcaacctccgcctcccaggttcaagtgattcccctgcctcagcctcctgagtagctgggactacaggcacgtgaccaccatgtccagctaattttttgtatttttagtagagaatggggtctcaacatattggccaggctggtctcgaactcctgaccttggcctcccaatatgctgggattacaggcatgagccaccaagcccagcccatctttaccatttttaagtgtacagtttaaagacatttaatgattttttcccactttacccctttgtactcctcccatgcccagcctctggtaaccgccaatctattctctatcttcatgagatccactttttagctcccacagataagaacatgtgatatttgtctttctgtgcctggcttatctcacataacataatggcccccagttccatccatgtggctgcaaatgacaggggttttattttgttaagggcctaataatgttacactgtgtatatataccacattttctttatccattcatctgttgtggacacttaggttgattccatattttggctatggctattgtgaatagtgctgagataaacatgagagtgtagatatctattcaatatattgatttcctgtcttatagatatatatccagtactggaattgcagggtcataagaaagttctattttctattttttaaggaacctccatactcttcttcatagtggctgtactaatttacattcccaccagcaacgtatgagaattcccctttcttcattcccaccagcatccatcgttgccttttttttttttttgaatagtgcatattgttttttatcttcatttttttttctttcagtttttatttttagttccagggtacatgtgcagggtatgcaggtttgttacgtaggtaaatgtgtgccatggtggtatgctgcatctatcagcctatcacctaggtattaagcccagcatgcattagctatttttccttaatgctgttgcctgtcttttttatacaaaccatttcaacttgagtgagatgatactacattatggttttgatttgcatttatctgatgattagcaatgtcaaacatttaaaaaatataactgtaggccatttgtatgtcttctttttgaaaaatgtttgtcccaattttttgcccatttttaaaaatgaaattatttgtttctttgctatttagttgtttgagttctttatatattcaggttattagtcccttgtcagttagattgcaaagattttctctctatctgtggtttgtctattcagtttgttgtttcctgtgtggtgcagaagctttttagcattatgtaattccaattgtctatttttgctctggttgcctgtgcttttgagaacttacacaagaaatatttgctcagaccaatgtcacggggtggttccccagtgttttcttctagtagtttcatagtttcagatctaaaattcaagtctataatctattttgatttgatttctgtgtatgatgagagatagggggctattttcattcttttgtatatggatatctagttttcccagcaccacttatggaagagactgtcttttccccattgtaagttcttggtgcctttgttgaagatgagttggttgcaatgggtggatttatatctgggttctctattctgctccactggtccatgtgtctgtttttgcaccagcaccatactgttttggttactaccgctttgtaataaatttgaaaggtaatgtgacaccccagctttgttctttgatccatctttaaaagccatctcttcactctcacccattctagatccactctccacttctgtttctagtgaacaagttgtctgaatttaatcgcctcacccctgcctccgcatcctattcccatctggcttccatccttgccaccctactaatgcagacttaccaaggaccagcatccattcaacattgccaaattcgtggcacctgtctgtcattcttccactagtcctctcagctgcccacatcctccgttgcagcccatgcctggctcctggcccttctgatgctgtgctctcatggttttctccttgccctactgggggtccttatctgacacctttgccatgtcctcctcctttcccacccaacctcacatactgtggtgtctttgatttggacttagtcttgcttctccagccacactcacttcttacatccactcagttccatgttgcatgttgtcacctgtcttctttctttcttttttagggacaatctcactctgtcacccaggagtgcagtggtgcgatcacagctcactgcagcctcaaactcctgaactcaagcgatcctcccacctcaacctcttaaggaacggggactacaagtgcacaccactatacacggcttcttcttcttcttccttctttttctttcttcttcttcctcttcctcttcttcttcttcttctcattattattattattattttggtagagatggggtctcaccatgttgcccaggctggtatttaattacgaggactacaagtgcacaccactatacacggcttcttcttcttccttcttcttcttccttcttcttcctcttcctcttcttcttcttcttcttctcattattattattattattttggtagagatggggtctcaccatgttgcccaggctggtattgaattcctgggctcaagtgatcctcctgccttggatctgtattcttctagtccagaaagtcatcactagctcagtctcctcttctgaaccctagacttacatagtcaattgcctgctagtatctccacttaaatgtcttatagacatttcaaatttaatatgaccaaaacgtcagtctggtttccaccctccatagtccatttctccctgagttttctcaccttggtatgtggactcattgccctctggctgatctaggagtccaccctgtggtcctccccctcctccatatccactcagccaccaagcccagtgtattagtttcctgttgctgctgtaacaaattggcataaacttgcagcttaaacaacagaaatgtgttataagtctggcatgagtctcactgggttaaagccaaggcattggcagtgccgtgctcccttctgaaggctctaaagcaaagtccgtttccttgctcattcaggttagtgggagaatcatcttctggaagctgtaggactgagatctcacttcctcaatggctgccagctgagataatttcccagtgtccaggggtcacccacattctgtggctcacagcgtctttccttcatcttcaaagccatgaagggcggggcaagttactctcacgctttgaatctcttcttctgtctcatctctctgattcagctgggaaagatgattctctacctttacgggattgtgtgtttagattggacccactaaaataatctaggataatctcaaacccatcacaggacttcactttttttctgccaatgattataatttgtatttattttgtctttcaaatttacatttgacttgtttattatctctacccccaagttgaacaaaacttgttcaaatgaaaaatggcagccaactgttttgtctagagcatggacctgtctcacctgtgagagcacagtgctaacagagttgcagccattgtttgttgactggctaagtgaaccacacaccaaatcctgagtcacagccgcacactctgtaggagaggaaaattctcgctggatggtttgtacatgctattgccttattagattaagcaaaagaaaaggggaaaataagtctgctaagggccaggaatgtcctccagattctagaaagcagaaaaacaaaccaagtggagaacaaaagggagaaagggggaaaatattactctacctttaaaactaggaccacctgaatttttgctctgtggaaggcagagatgaggtagagaacaaattatatgactctgagctggtattgtcatcaactactgaagaccaaagggcgttatggtcagagaggtggagggtcctgctaaccacatgcccacaacaaaccgccatcaccattagccaatcttgcttcctcatgtttagtttatgaaggtgtgtgtatgtgactaggagcaatcttttattattgacttttacagtcttgtgttgaccttctagagacaattccttcattgcttcaggggagataaactttgcttaaataattaaggtctgagttacttggttatttggttttcatcaccatacgcaccttttcttagccaggtttctggctgagacagtttccatctaaaatctgcttgttccgcacctctatcctgatgagcatttcaaaataagcagcttgagctccctggctacatatctagaacaatgactcttgcctggggcagttttgacccccaggggacatttggcactgctggaagaaatttttggatgtcacaactttggggcagtagtttggtggtcctggcccccaaagactagggatgcagctaaacctcctacaatgcacagggcataccctaccacaaagaaatattgggtctcgaatgtcaactgtgccatggttgagaaatcctgtgctcagaaggaaaaaagagcatatctcaatcatacacttaattatattttggctgcataacagagaggtgagggagcaggaggtgctgccatggcaaaggcacatttggccactcagatgagacacagagttttattcctttttccaaccactgacctcaagtttggcatcttcagcccaaataactcattatagcttactcagccctccttattccaaagcaacaaatatagcaatatagcaactgactctcacttgaccctcactgtggcatgtgatgcttctgactgtttcttcctttgtgaactccctcttcccttggtctataagaccacactttctcctgttgtcattttccatcatttcctccatcttctttgtgagctggtctgcccatccaaagacagtggtgtcttctcttcattctacattatctcccaagacatgttcattcgctttacatttccaactcgacctacatgataataactcccaaatgtactatataccctcttggatggcaaacagccatgtgtacacaatatgccaggaacaaaactagcacataattatttattgagttaaataattgaataaacatctactttgctccaaacaccttggcaagttatggctcagtcaacctttggtcttaaaagagcaacaactcttgtttccagatccaatttgccacaatccttttttgtgtcatttaatgttcactaaggatttggcaattaaaaaataagtaatatatcaatatcccttctgcatggaaatcaaaggccttaataaaacatttgtgtaaatcaattttcttcttaaatcaccttttttttccaattacatagtgtcagtgaaagccaaaacaagtattttttcaaatttttgaccataaagtaattgtatattcctactcatttctgcaaatcatcattagttttacaacatatagcaaagctgaaagcatctaacgcctgttagtgctaaccttatgcataagcatgctcacataccaagggcatgggtctgcctggatggccagacataaacaattaaattagtgagtggactaagtgtttggggtcatgatgcaattatggaagaccaggaaacattgatatattcaattggattgagtataggcatttataaagccaaggataattttaaagaaaacaaaaccagatgtatgcataaatctttaaaaatgcaagttgttgaactaagcatgatcattcccccttccctgaaagatttttagcattttttccctcctattagtagtttccctaacagagaagcaatgaccaagtaccaaaagttaaggaaatataaacggggggcgggggaagggagcaaaaactgaacactgacacgattttacatattatgctaattaagatttcagcttggtggaaacccaaacatatggattcctttcggcagcagagcaccagggcttgagcaagcaccatcagagggtcttggtgagtgggctgacactgccaagcactcattctaggtcaggctgcttctgggttttttttgttgttgttgctgttgtttacaggtactcatttacgacagccacatcggctcaatactattgctattcccattttacaaatcccttatatgtgcaacatcgaatggttccctctagtaaaatcacaccccacataataacaagtatgtgcaggttgaagggttgaaggatgaggaagccaggatggcccaggggccatgtgtctcatttacggaagacacagcagtgaatggaacagacaagaccctctgcccttgtggagctcacgtcctaaggagaaggaagtaatcaacaagattcatgagtagatatatagtatatttgaaaatgattatgtttaggaggaaaataaagcacagaagtggtatggagatttcagaggcagaggaaggtggcaatcttaaacaagatagacgacagcagcattcttgttgaaaacttacctgtcaatattttacaagggcaaaaaaagacccagggaaccatcccccaaaagaccacgtccatgaacctccaggtttcatgggaaacactaatctggtggaaagcctgaagacaatcagacctcatctttcccctccaaacacgcacttgcacacacggcaggaataataattgtctttctgccagtcattgcctggcttgcccaggcttactgtctagactcctctgtatacttatgccgctttcgtagctccaactaaagcccttggttccaccaatagaacacagctcaagagtccatctttgctctggtattgacattctgtatttctgcttgagcagtgacacagcaacatcagggttacaacaagatgggggtttcaggctgttgaacattgacagagggtggggacaatcctatcccttctgcctcttcccacagacctcgactacattgtttaattaaaaggtttcctgggctgggtgtggtggctcatgcctgtaaacccaacactttgagaggctgaggtgggtggatcatgaggtcaggagttcaagaccagcctggccaacatgatggaaccctgtctctactgaaaatacaaaaattagccaggcgtggtggtgtgcacctgtaatcccagctacttgggaggctgaggcaggagaatcacttgaacccaggaggcagaggttgcagtgagctgagatcatgccattgtactccagcctgggcaacagagtaagactgtctcaaataaataaatacattttaaaaaggtttttgggccctgcatttttctttcctcagttggttttttcactccctgctcttaggtgatgcccacaagttcttactatctgttaccctcaggtaaaagacatggcttttgcagatataatcaaaatgaggtcaaactaaattagggtgagccctaaatccgatgaattatgagagggagatctggagacacacagggaagaagcccatgtgataatgcaggcagacgttgaaggatgcagctccccaaaggatattgttcgcaaacaaattaaaagccaaaatgatggcatctgaaagataagccatcccaactgcagatctctagagctattaatgtagcatggctttgtcatctgaagtccagttttatggaagcctcagattcccctaaggactgccagcatttaagcacttagaggaaaatatcttctgcaattaccaggtgctcccaggcaatgggcagcaaatgaataccaccaagaagatccaaagagtcggatcccatgctcagtgaatggggtgagcatctttatcataaaggaaagtgcatcatgattagcttctggtggtaaaatcaggcagacaaggagaattgatgggaaaataaagaagaaagaggaggaaaagacacaggaggctgaaatacatgatgaagacaagcaaatgacaaccctgccaccagcaatctgactcagcaacaacattgccactgccagagacagacggtgcgtgattgacagggacaaaaggacttctgtggtgtggggaagtaaagtgcctcatacatcctggctactgactgctgtgggtggaatggtgtcacccagaaagatatgtccaagttctaatctccatggagtacctataaatgtgaacttatttggaaatatggcctttgcagatacagtatgatgatgtcagactaaatgagaatgagtcctaaatccaatgacttacaagagagagatttggaaatgcacagggaagaagtccaaatagtaacgcaggcagaggctggagtgatgcaacaacaagctgatgaatgcccaggatggctggcaacaccagcagctgaagaggcaagaaaggactctccctagagcattcagagggagtatggccctgatgaccccttgaattttttacttctggcctccagaagtgtgagagagtacatttctattggttttatttgtttgcttgttttgttttgttttgtttttgagatggagtctcactctgtcaccaggctggagtgcagtggcactatctcggtgcactgcaacctctgactccctggttcaagcgattctcctgcctcagcctcccaagtagctgggattataggcatgcaccaccacgcccagctaatttttgtatttttagtagagacggggtttcaccatgttggccaggatggtctcgatctcttgaccttgtgatccacccaccccggcctcccaaagtgctgggattacaggcgtgagccactgcgcccagcctttctattgtttttaggctgctcaagttgtgtccatgtttacagcaaccctgggaaactaatgcagataccagcctgacacctgaaaaaagttgtctcaaccagcgcaagacagtatctgagttctccttccagttgcagagttaacattgcatgtatttattttaactggcatcctaccttcacttcctgcctttactagattcaacctatggattatcatgctttacgaagcgtgtgttagagaagaaactatatgaaaaggtttatccatcagggaggcattttataggaactttaatattaagatgcaattgctaacagaggttaatactctgaattatcacagataaagagaggttgaaagagattgtagctcagtttatgttgccaaagtgttattttctttagaataaggtttctcaagtgcaactctcttgacactttgaactggataatgctttgttgtgggggcctgtcttgtgcattgtaggatgttgagcagcatcctggacctccactcactccctaggtgggttagggttagggttagcacctcaccccctcatcatgacaatcaaaatgtctccagacattgctcaatatccccaaggaagaggataaaatcacccccagtgagaacccctgatctagagtcagtctgtaccctctcctagcacaaattactgtagaagggagaaaaaaatcctcgtgaacctttcataaagaactagagatgggaaagtagatccaagccatagatgggtccaagataccaaaggtaactgggctaatcagaagatgagtctcttttaggaaggtaagaaaaacactccgtggaagatggactcagggcttgattctctaagtctgcagagaggctggggaatgacctcaaccaagtggcctttgtgtgcctcacttcatcttgatgagaagaaaaatgatctgaaattaatatcaacagattcccatgaaagcaagctctatacagatgtgcaacatgctctgtgccctcacaccttctacatgcaagtttgcatctgttaatacaaccggagccacaaggaaacatgacaaaataactggagtgcccggggaccatgataaactattaagaaactggtttgattgattgatgtcagctattttaaaagaaagcccacacttccagcaaaaacaaaatacgatacaagtgaaacttagattttaatgttctggggaagaataagtttagccttcaagtgtttggtcaatttggtcatccagaagatatcactgattttcaggagacactgaacagttgagatttcaccatagctaaattctgtatctgggcgcctaggtatttattttaagcaacccttcctcagaaatcatatgccaagattagtaaatgtcatagccactgaagttgtagaaggaattctaaaatactactgcagtaggggtggtagtctaaataattcagaccaaagtcttacatagtcaaaagtgacccaaattctttatagagcagaggtaaacatttgaaaataccacagatgactgtacaggagaccttatagaactgctacctatgaaaacatcacacttacccactagcaccctatgactccagacagagaataggtagattccagtccatgaggccctaatcaaaaattgtagaaaaatacaagactccactgagaacctcctgtcaaaaatcatacttcgtttaaacctgcaaggattgggttttaaatccctggacacatcccacccatttcccaccccagaaactccttttgtcagctggcattggcttggctgtgtgattgcatcttcaatcaaagctccttgtctgacaggttggatattttagacaccatttttttctaggtggtgtaagatattaatagtgatctcagcagagaattccatttccttacctatcctgggctcaaaaatgcctttaggacaatgtgctcacaaataggccccaaatcttgttccaaaacacagtttcccagatgccgtaagcccacctggctgggtttctgggtcccttgttcctgcatctttcttcaggacttgctgttcctccatgagtcaagaagcaggataacagtttattaaggggacagagacactcccttactgaataaatgggggctcctcagagtccgatccctggtctgggatttaggcagcctgggctctgagcaggagaggagtcaagggaagattagaaggtagcgttcagggacaaagcagacagcccaaccaaaatggcggtgtgcgggtgaggccgtgagatggaacaaggcacaacaaagccaggagcaggaggtgggatgagggactgggatgcagggctgagaggggggtgctccctgaggtgcccaagcatcactgtggggggtaggatcggttatatcagattcccccaaaattcatttgttaaagtcccaatgcccagaaaataaccttatttgaaaagagggtcactgaagatgtaacttaggtaagatgaggttctactggagtaggataggcccttaatccagtgtgactggtgtccttatgaaaatgggacatttgggcccagacgaacatacagggaagaggccatgtgatgacaaggcagagattggagtgatgttgctacaagccaaggaacccccagaagctggaggggaccctggagcagatccccactcacagcctcaaaaggaaccaaccctgccaacaccttcatctaggacttccagccttccgagctgtgggacaatacatctcagatatttcaactatccgatgtggggtactttggaaaattgccttaagaaactgacacttatggatatcttattgtggtatcactgtgatatggtttggctctgtgtccccacccaaatctcatgttgaattgtaatccccatgtgtcggggagggacctggtgggaggtgactgggtcatagggatggttacccccatgccgttctcatgatagtgaatgagttcccaggagatctgatggtttaaaagtgtgtgacagttcccccaccttgctctctctcctgacaccatgtaagacgtgccttgcctccccttcaccttctgccatgattgtaagtttcctgaggcctccctggccatgcagaactatgagtcaattaaacctcttttctttataaattacccagtctcaggtagttctttatagcagtgtgaaaacaggctaatacacactgtcacaaaccccttggtatgatcaaaggataattttattttatttattatgctttctggaacaacaccagaaaacattacttacctaaggcccaaaaggaaccttattgtagtcaagtgttttaatatttgcagtccttttatgcaacttaaaattgtgatcactttatacccagtagtttaaagagcatagaaatatatttgtgtgcctatttaacttataggtttttaacagaagaaaactttgcagccagaaactgatattatcctgttctcatctttgaaatccgctttaaaatcacattgtaacttctcttcattttacaagtttttccagcagcttttaggccaaaaccaataaaattttgacctgaattggcccaactatctgtatagattggagcctggtggtgctcagccttctgctgtttgataggttaatagtatgtgtcagggtgatatagaaggcaagataatcgctgtgctgagagtgtggagaaatttagatgaactaaattaaagcacattttcccccactgaaagcttttactctgacaaggtgcatcacttattaaaacttccaccttgtagagaactcagtttgtattttaaataacagcgctggacagtcatgaagtctcagtcctgtaatcccagcactttgggaggctgaagcattcagaccgcttgagcctaggaatttgagaccagcctaggcaatatggtgaaaccccatctctacaaataatataaaaattaatcgagcgtggtggtgagtgcctgtagtcccagctacccaggaggctcaggtgggaggattgcttgagtctaagagtttgagaccaggctgggcaacatagctagaccctgtaactaccaaaaaaacagttgctgggtgcagtggtgtgcacttgtagtcagtcctaagagtgctgagacaggaggatggcttgagcccaggaggtggaggctacagtgagccatgatcatcacgccccgcactctcccatcaaaaacataaaacaaaacaaaatcaaaaacaaataatagcaccaaagcaaggtgcaagtgtgtggacatttccaactcatagtttgaagccaataataacatactcttcagttgatctcatttagcagtgatacatttaggtaacaatacatcattttctcagagatgtgaattatatgatccaaaggctaagcatgtaaataggtatttggtaggtgaaatcacagcctccaaatgttatgggaaagagcccaagcctgggagtgaggtacatgcagacgcacgttcctaatgcctctttgtgctgttagatcagcaacactttccaattttcccttagtcagagtttatattattgctgttggtatcaaattagcttcatgtgtcccgtatttatttataagcttcctgacgacagttcagagagcaagacatccctgcagtgacagcatagttatagccatttgtagatctgtggatatcatatttgtctaacacatgatagaggaataatgaggaatttaaaatactgggaattgattttaaagaaagtatagagccacaaagatttgtatctgcaaactgatctagtgtgtgcctcttaatgctgggtgtgagggtttctgagagtcctctgctatctcaaccctgcaaagggatgcaaaacaaccattaaatccagccatgcaaaaaataatatgctgtcctctaaacatctcacgaagtctaaacctgcgctcagcagtttctccctcaaaaaaaaaagtgtctttcgaatatctctatttccatttatgaatgctgttataacccaagttacccaggcttagaaccttagagtcattcaataaaaacctttacaaatctctcggtattgagctacatacacggtggggtgctcccagcctgatgggaggtcagaaaccaatcctgctgaatgtgccacaagccatggcagccgaatgcagaaaagcccattggtccacagactgagatccttcgaagcagcctgagaggcggcgagacctccctctgactttctctgcacatccagtcacttcccaaagaggactgcatttgacctctctgaatgactagggggaagtggatgctcctccttcccctgagaaggaagctccaggagcctgtctttttttatttttatttatttatttttttgaggtggagttttgctcttgttgcccaggctggagtgcaatgacgcgatctcggctcactgcaacctccacctcccaggttcaagggattctcctgcctcagcctcccgagtagttgggactacaggcgactgccaccaagcccagtaatttttgtgtttttagtagagacagggtttcactatgttgaccaggctggtctcgaactcctgacctcgtgatccacccacctcagcctcccaaagagtatgtccttttatcactctcctcacaggttaaaaagtgagtttcaactgggcacattcagcaaaaggcaatcaaacaaagagtacttgtgtctccgctgaaacataagtatcagaaaaacaaaattattttctgtcttgtcaaggcttggcagttactaggtgctcaataaagtttgttgagggaaagaatgtaaaaaaaaaaaggaagaaatttccctttcttccaatggccaggcatgccagcaaccagggtaagtgaatctgttagggagacacaagcctggagtaagtgtgccaagggctagacagctggggagaggagagttgggggagaaggaagcacccagcccatctgactgcccacctaagttgtgtcctccaagccagcacttatcagggataaactcgtattttcatccctgcgtgccctgctctctccattcaaatacctcagaaatgacatcagaggggtgttgcttaaattccccctaaaactcccacatttcatgtatggaatgtatgtatagagggcatttgccatacgcctttagtacatgagctgagaaccccaagaaaaacaagaattggtgagattgaaaaggttgctgggggagtctggtcaaatggctgcttggaaccgctgcaaataggcactactggcaccaccataaacccatgccctctgaactcacagccagcagctagtgcagaacagagcttgttttaataaggaagaaccttagcaaaactgcttccaatctggcttgcagcacatgcctgctgccgtgggagccactgcagcttgatcctggactccaggagagcagccagcctggtgctgtcttggcatttgtgatgaaaacatacttgcccctttctggattacctcagtggggcctctaggcaaggcccctaaataatagtcagtgggctctgtgtggttcaggaggcaatggtgagttcatattctgttttgaatcggtaggaccaggccaacagagcagcatctgtcccacactccctgcttcactgtcccaaattccagtaggtgtatgcaggcattgagaggaatttgagggatgaatccctccttactatgtgccttgtccagaggctgtgtcacaaccattcccctcccaccaccagcctcctcaacacctccaatgctgccactcccattacctccatcaccaccatcaccattagcaccaccaccaccaccaccatgatcatcactaccacagcatcacaggcaacaccatcaccaatatcaccaccatcaccaccaccaaccatcaccaccaccatcaccatcactattaccattaccatcacagcccccacccctacctccatcacaacttttacctcctgctccatttccaccatcatggttactgtcacctccatgagcatcttcctgccaccaccatactgccatcataccatctctaccaccatcccactactgctatgatcaccacatcactccaccattaccccaatcaccaccaccgtgtgatctcaagttggctttgcaatttttagctgcataaactgtaatcctgaatttcgattttagagttccagaccagttttaattgtagaagtatagtagatttgaatcatcaacaaataaagaagaataaagccatgtattagctttatagtcaaaatacagacaaagaaattagatcatttcagtgaatcttccatgaaaattaaatgaaggaatggcagcacttttttaatgtctttttttagtggagtggcaaaaaaacaacttaattcagtgtttgtgaacccaaaggttagaagtgcactgacaagtcttgcatctggattactttatagatgccatatttgctagaagaatcaaggaggagctagaaggctatgaaagtgtacttcactttactagaagaaaaggagctgtagaagagttgtttatttttataatttttttgagacagggtcttgccctgttgctcctggagtgcagtgacaggatcatgggtcactcattgcagcctcaatctcctgggctcaagtgatcctcccacctcagcctcctgagtagctgggacaacaggcatgcaccaccatgccaagctaattttttaattttttagtttttgtagagacagggtcttgctatgctgcccaggctggtcttgaactcctagcctcaagtgatcttcctgcctcgccttatgagagtgagctactgcagctggcctgtttgttttttttaggcagtcaggctaattaaactggagggaaggagagtgatttcagtggaaggaaagctgatgtttcaaaggggaggcagggcatgcaggaagggagatgagattgggcagatgtgaaagggaggatgagctgcagatggaccctgagagaacagtggagctgtggatgcagtacttcaggacatcatccctcagtaggtgcaatatctaggcttgtctgtcatgctctaggtaagactgatgctgctagtttgtggagcaaggcatggaagagcaagtcatttgatacagaaggggaatgatctcaagatgcaggtccaactgtcagaaatgccactgcactttctggaaatagcaggggcaggagagggtcgcgatccatggagagaacccctacaattgtcaaacaaacaaataacaaaagatgaagcagagaaaaagggggatggtcctttttagatccctcaggaaggggctgtccaccctgctgcacattgtagtcaccaggaaagctctaaacactaccagtgcctggaagatcagcaccacctgtattcaccagggttctccaagaaacagaaccaacaggaagtggacagagatgagatagaggagatagagacagagagatagggataaagaaagagatggagatggagatagggatagagatgaagacagaggtagagatacatagagaaagagataaggatagagctagttatagacatagagatagaagagatagacatagagatagaggtaggtagagacagggatagagacagatagggatagtgatagagattgagatagagaaagatagggatagagacagagatagagatggggatagagatagagagacaggaatagagatcgagatagagatagacaggaatagatacagggatagagatgcagacacagatacagatagggatagagagagacagggatagggatagagagagagaagggatagagatagagggagatagggatagagatagagacagagagagatagaacagaaagagatagagatggaaataggacaagagagatagagataaaaatagagatagaggtagctagggatagagatagagacagaagtagatagagatagaggtagagacagagacaaagatcgagatggagatagggatagagagagataaagatagatataggaatggggatagagacagatagaaatagaaatagagataaacagagacagagatagagataaagggatagagagatagtgatggagatagagacagagagatttatttattttaaggaattggctcacaagactggaggctggcaagtttgaaatctgcagggtaggctgacaggctggaggttcagggcagagttgatgctgcggctcaagctgaagcttgtatggaggcagaattccctcttatttgggggaatctcagccttttctcataaagacttcaactgattgcatgaggtccacccacattatggagggtaatatgttttactcaacattcactgaaatgttaatttcacctaaaacattatttcacagcaacatctagactggcttttggccaaaaatctgggcaccatggcctagccaagttgacacatacaattagtcatcacacacccccaaagactcaattggttgggtacagtatggccctcaggattcttaaagtcccccaagggattccaagctgcagccaaaggtgaggagtggtgctccgggagcaaagactctcgaagcaataacagcagctttggtttggaaatgttctaaggatggttcttgattgaaaaccaacatgaggactagagggaaattgtcccctggaaccaggcttcccgggtcttagcaatttcaaaacaagaggcaatagaaacagttcactctgtcacagcactgcacacatgcctgtaagattcagtggcagccatgacactatagaggaccaactctcagagcagcctgaggggactccacacactgggctagaggggaaatgacacccaaggtgcaaaagaaagtgtgccacctctgtatatttctatactttgaaagaagatagcaatgtctcaaatatttctcaacaaatacctctctggggaaggagacaatatgtacaggttaagtagggccattattggtttggtgaagggacagttcttgcaatggagttaactgccccagtcacagtgctctgcaaccaaaggtatcctgcagagataaaaacaaggatgatttcttctctgtacatcaacctacactcagatcccatggagtttccatggcgtatttggcatcagtaacacgggccaagattttaccgagtgtgatgtcccgagagcatgtttggattaggtagttcctctagacaatgaagttagctggtgatggaatgtcagtgctgtgagaatcttggcggtgcaaagatcattttcttctctttcaagtgggaaatgagagattgacctaacctaatgcatcctctgaagtcctgaaggcattaagcacatcatgttgaagggtagcccagttcacatctgattgttgaagagatccagagaacagagaaacagatccagagaacagagatccaataaacagagaaagaaatggaggaaggccttaatttcattggacattaatataagactgggaattatagactttggatttgacttcacaagagcaagaatatttaattttagactttactgaagacacagaattatttgaactttaacttccaagcatatttattagttgcctcttttaatttctttctgagaatctctgctggtccttagagtggtgcaagctacttcagctctcagcctccaggcacaagggaggattggacttgtgtgccctcttgaactcaggtggtgcaatgtaactttctttggcccatgaaatgtgaccagtagggacatggtcccttccaggaaaagctgtaggcaccagtgtgtgcctagctaagctcagtttccctctggcacacggccagcagcattccacatggctgctgtgctctcagctgggcaccagagtgaagaccagggaggcacagggcagagcccaggctggccagtgaagtccatggaaacaaaccttcctagtgttaagccatgagatctgggaattgtttgctgctatttgagagccccagggtccagaatacagccagccaacctagcctaacctattaaaagagaatttaataaaagaagaggtttagattcaactttgggttgttggcattttattcccagatcatattaatgttgacatttaatcacattgcagaatctcagataagctacattgggcaatattgttggaaaagaatgcaaagaaagaaagaaaaaataaatttccaactttgacttcagtgtggctcaaacttaatttgaatattttactattctgacccaagtgacagcttctgagaacaaaatacatactccctggcagtagtccccggaagacactcaagacacagtggctgatattggggagtgggtggctgaaggcaggggcagcttttgccaagtgagcagccgcaagagcaagatggtgcctccctggccaaccagggacttaacacttcaatctaaaggttaagcattcagggagcaaaaaggcagggccctcttcttccctgtgcctcataattacatgaggagggaatgccacttgagcaactctcttcgtattccagtctcactagcccctcaccatgggggatggaggtctcagtctgtgggagattatattggctcatggcccatgattggtgaggctgatctactggaaaactataagtaactgagatttgatttcttttcttccctttccactcagaaccagagaggggcagcaattttgggcaaaatgtctgatttggaaataccaactttacctccatgggctccacaagaaatcagatgggagaagggacaagcagataagcgcaagcccatcaacctgaaggcataaaccacatccagccacctccttctgatcagcagcaaagctgacgttttgatctccatctgtctgattcttgtgtctacttctcagtttacaactccagtgggaaagaaagagctttatttacagacccataaaaatcccatcagtgtcgtcccctgctgagaggccatgtgagaccatatggaaaaacaacagccataatggcagcatggcagtggaagggtttgtcttgtgcccaggccttgcggtcatgcaagtttcttgtggatcctgttgggaccagccactcaccaaggctgagtaggtccacaaataatggggactttctaccagactcacagagaactgctgggtttttgggaagggtgtgcgtgtctttggggcatgcaagttggggttatagtggagacccagaggatgagaaaacttctctgcctcagcagaagagtggcagctgagagagaggcaagaaactcgcacccactgtggactggggcagagagattttgaggagaatgaaatccagaaactctgtgtggtattagtttgtatccagagggtgaccctcttctcaaggaaatgggtgtcatcaattttctacactattaaagatataaagttcttggcattactacgtaaaatttttaatgtaaaaagattacatcatagagtttctagcatctattctcaactttccactcccactgctggcatccagagcaggcctttattaccattcctctggttcatttgaaccaagcatggatacagagagagaagtggggggaaagatgagccctccccacctacttctccatctgtggccgctttgtctggaaggagagcgaggttctgtgtgggctaggagagaggcagaggtggccctcggctacagttcaccctgcatcccagcctcctccgtgggtctccaggctgggcagctgcagctccagctccatggcctgggggagggcaaatgtgatggagaagaatccaggaggctaggagtaactcttcccccttggagtgtgggagaccgtctcacaaggtcagggatcaaagagaaaaagaatgagctgaactggcctctgcaggagctagaggtaacaagtactggggcatgacattccctctggaaagcaagtcttttacaatttaagttgatggaactgaacaggaggaagatctgccttctgtaactagagagagacttgcaggagatgaccattgtctgaatgcttaactcacccttacaagcagtaattacaaggaaatgattggacctttctgcagctattggactggctctgatttccagcagatccgaggacacactgtgaacgtgagagcagcagagcatcagtgaaaaggccaacacctcacaatgtcatgtgcaatagcagtgtgtgtgtgtgtgtgtgtgtgtgtgtgtgtgagtttgcacatttgtgcattgtttgcatctgtgcctgtgtactcatgtgtgtgaatgcatgtgtttacgtgtgtgtgtgggggtggggggtgtgggtatgtgtggtgaaagagcctatacagaggcaagtaaaataccatccccttccttcctctgaaaatgtgtttctgtcttgggtcggggtgggatgaggtatgattgtgcacttaagggtcaggggtgtgacctgacagtttctgcgggtcatgctgtggagaaggaggcacatctatagccctcattgtcaatgagatctcaaaggggctctgacttggggtccccaaggctctctgcactggtcctgcaggctgtgttcctgcatggagaggcatggattttttattttattttatttttttagacagagtctcactctgtcaccaggctggagtgcagtggtgtgatcttggctcactacaacctccacctcccaggttcaagcgattctcctgcctcagcctcccgagtagctgggattacaggtgcacgccagcacatccagctaatttttgtttttttagtagagacagggtttcaccatgttggtcaggatggtcttgatctcttgatctcatgatccacccaccttggcctcccaaagtgctgtgattacaggtgtgaagtgattctttataaactgatgaagatgtcacagcttggtgagaaggagatggagatgcagacctaagtctgggaggtacctggaaagcaggcctccatgagagccagctgtgaacgcttcctgtgttcctgtttgctcttccagggttaggggagctttctgtttcattaaagtcttaaataatgtctttttttgagtgataatattttcaaagtcacaaattattaatcttaccaaccaatttacagagcagactcaccgatgaaagaaggaactagagaggcctcttacccacctcacccaattcctcctatttttttttcctaaagagatgacttagaggtcctatttccaggtcaatcgagttgaaggggaaatgtatttgtcagtatgttagcagtgaaagagacccagtaggacatgtatggaaacttatttcaaggaagtggcttacacgattgtgaagtcaggctgggcaagtctgaaatctgcagggcaggtgggcaggtcagaaactctccagcaggaagtc

SEQ ID NO: 16939 - DNA, 67620 bp, Human
caacacctacaaattgttagctgttatttgagtaggaaattaatttctccccagggtttgcagatggaggaggtgtcattattgagggcagttttcacctgatataatcaagagatgcgtattctctagagcacctgagaatccagctatagtttatgctactaacttacaaagtcattagaaaatatgcccccactttcttcaagtaatatttggagaaatatggcatgcttatgtggcagactttaaggtgtgaaaatatataattgtatgaaaaaataatacgtactgtagaaattttgaaaatgcagaaaagaaaaactgatctgtaatccttggtgtgctttaaaataaaatttataattctactgacttaaatttggggaaccattaatcatcttcatcaaggaccttatttttggagcagctaactttgcatgttgaagccaaaagttaaatgttggtagtcacctcaatcattcattgtgatgtaggggcatttaagcgatattccaggaactgggatattccggggactgggatgtcttttctcgttgcaggcacctacctgagggggtgggaaacatgcctctggggctctgggactcaggtgaagagggagtacagaagcctgggagattcctctctgcttcggaacgtcggtgccacccaatccatgatgggcagcaggggattttaaaaagggagccggagaacagagagagagagagacagtaagagactcagttatctaagctaaatatcccccaagtgcttcttgaaaaactagccctttgtccctaatgcccttgatcttgattttgaaatctatcagaagaatttgcataactggcatttgggcttctttgctagattttgtattcctttaatttaatttgtttgtttgtttgatttggttttgttttagagataaggtcttgttctgtcacccaggctggagtgccgtgggtgtgatcatagctcactgcagcctcaaactcctggctaaagggctcaagggatccttccacctcagccttccaagtcgctggaaatacagatacaggcgcctgccaacatgcctggctgtttttttttgtgttattgttgttggtaaagtcgtacctcagtatgttacccagactggtcttgaacttctgggctcacacaatcctcctgccttgacctcccaaggtgttgggattacaggtgtgagacactgccccggaccttctctaacttttaacacaattcaaaatacctatataaatattaacatgtataaacacaaatatatataaataaacacaaaatacctatgtaaacaaagagcctgttataaacagattattttggttttttccccaagcactttaaaatagttaataaacttcaagtcagtgacaagtaaataaaatagtgagacaattggcttgttgcagccatgagtattgagaagccagcggctatttccctacctccctggatgtcagtgaaactttagatggcccatggctggtcagtttctgttctttaggagaaacaggtgggaaagagagcacactggaaacagccactcttaaaggcatttctattgtatgacagtttacttaaaaaattttttttaacctgccaggaaaaaaaacaaagttgctctttacttaaaggcctctgtggctattctgacccttccagtttatttgtttgccaaaagccctttaaacccagcctcctcctagactgaggtggtgttttctgggcttttccagctcccaagagctcctccctcacttctttcgcctcctgctgctctgttaccggggccccacctcccttggccccaaggcatctctgcacaggtctccgattggtgcacagcacagcctggccttttagggactgttgtcgcgcgtttaaagtgatagggaaagggtccagtggctgcttttatcgaccaatcaaatattttcctgacagatcccaaaatattcctgggccaatggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctaacaggggtgtgttggggggagtcctctttccaactgtcgaaatggttatcaaagtgtttgttgctacatcttctgggtccatagcggtaggtgtctggtggactctttcttcctatactcttttctgaataacttagggttggaaatatggccaacgttggccttcagtttcttttttgcgtgtagtcagctgtggctctgcaataagtatgtgcgccctttgctttctgcatttgatttcatagtgttgaaaaagcatggaaagggtgtaatctggatggctgggtgtgaaaagggattcgagtaaggaggcgtgcttgacactagaatttttaacatgtgatttgtgttgtgttgccttgtgaatatcatagaagcagggacttttttgtatgtgtttctgccattcattctgcaaggcttaaactaatttaaaattgtaaataaatgatactttgtgtaacactgtttggagcggatgatgaaccagattgctaaaatgactctggggtgtaatcacttgtatatgccatgtaatgatgtaaccatactgaaagtgtaaagttagcatgtgtaatccattgtttgaggaaagtgatgtcacagtgaccagagcagacatctctcaggccacagttataaacactccaggcattcagacggccccaaaataagagctgaaagccgaccttcataaccagtgctttgtctaattttcttgagaccatctacctcttcaattctggccttcattctgtgcaagctggacctgccgtaagaaataggggtgatgaagtgacacatttctctttggaaatgggtcagactttgattttaggcttgaacctatatagtgtctgtctgtctggaactgatatttcgaccagcattttagcagcagttaggaaggctgtggagagaaaaaacagttttattaaacccaagagttagagaccagcaaggcggctgttccttttatatctagtttctggaggatctcaggtttcggctgggatttcagcagccactctgccagaaacagtacccagagtaagccattggctggggtgacagccccaaaggcagccgctgagtgccaccactcccagccccgaaagttcatgaggtttccagagagggtgagaagaaagcaagagaaaatagcttggctgtcccttttgctaagtacaactgagcagctattgttttagtgatctctagaacaaattagccgaaaaagatgagaacacactccaaatgtgaaactctgcgaaatcttttgtggctattgatgactgctgaaactttcagttgatctagaaggagtaaattttttggctattggataaaaaaatttttttgggggggaaaatggttttggtgggctctaaatacgttgttgatgctcattgctaaaaactttacctcttaccagccagtcctctatatattctgtagacctggtctacatattcttcagaagacaatcaataagttaatggatttttaaggtttatttgatgtcctgtgttcttgaagtttgggcccataatttagttagctttggatgacctggagaggcaatgttcatcccagggtcttggaaaagccattagttttggttccctaagcaaatgtttcagtgccacttgtaactgtatgaccttgggaaagttatttcaccttgttaagcctcaatttccttgtctgtaaaatgaggataagaatagtgcctacatcatagtgttgtcatgaggactgatgaaatgatgtgcgtgggtgccccgcatggtgtcaagtgtttatcagcactcaagaaatattctaatgattagtgaatgttatttatacttactagctgctattagttaatattagttgctactataattgttattattagttagttaatgaatattaattaggatttcagttacaattattagttactataattattagctaatattatttagtagatcagggtctatgatcagtatgtgtgagaagaattttccagaaccacatacatgagagaatttctgccttagccgtaagaatgagaattgattatccctgcgatgtcagtgctaatgatttttcatgggtagagaaatttcactcaaaacttcttggcaggaaaaccctagagtggcttcttgtgcccatgctactgtgtggcagtcagtctgccaagcctttcctacttatttcttcagcctgtacatttaaaaaatggattcttgcctgatacctcatcagtaagggcattctgacttctgttggttgaatgaaataaatgagaaaggaaaagcaaattgtaatctccttatgaggaattaaatacatgcagctgtgtattacatctcaattttaatagttgacttcaaagagctgtggcacattttaccacgttctggacggatttgggttaagagaccctggggagcaggagagggcgcgtgacttcttctaggaccctcctctcttccagaaggccacagtggggcaggggggacaaagggagagaggacagtccctgccgtctccaagatgcacagcccctggaaccgatctttaaggacagaccctcatagtggctcttgggcttcacagtcctttctccattttgattgacagtgtaaatatcgtgggaaaaatatgactcttgaattagatcgttgagtgtcattcttggaaaattcattcatttattggagcctcagcattgttataaaatagccatccaaatacctacctagatggcccgtgtgacagtgcactgggatggtagtgtgctatgtggtgcctgacagtgcaggttttcagcctaaggtacaaaatgcttttccatgcatcatcttcttcagttcccaccaaaacactgtgaggaaggcattgttacatccagtttgcagatgaagaaattggagatcagagcccttgctcagaaagcagccttccaagctaggatggaaacacaggtcgtctctggctcgaatccagtgtgctttatactacagtacagtgatctcagttggaaagtctcctaactgtacaagacaataaacgagaggtgccaagtgagtggcaataagaggtgctgctgtcagatcactctgacacagtctagtagctaacagtgtctgggtgactttaggacagagaacaatactttcttataagtaaatgtaacaggataggaaaacggagctctctgagtcttcactgaggtcccaaaggctccaaacaatgacacacaccccaaatacccccagatcctgtagagccactactcaggacagacagtgcagcctggggggccagcatgggccatggcaccctggagggtggagaaggggcaaagggggagaggtgaagagtaggagtgtgtccatgatgggaactgatggggtgctatgcacacccctccctctgggccataaagagatggactcttccaagagctgatactgtgtccctgggagtcagctcagcaggcgctgtgaggagctgcactttgcaggcccacaggagctccttgatcagggaccctgcaagggggaggattttggaggagaggggccccatgctagagccggggcacaggggtgcagcaagacgacagtgccggccaggttagctcatgtgctcactcccctcttccctcctctggcctggatcctaagacccttttctgcaggctcccagcccaggcagaactcaagtgccctgaatagcgtgataagcaatgcactgggctctgtttaaatgactagtgtttgggggattacagggggcaaacagatttcatttttcttcttctttttctccttttttggggatgagggctgagaaatggcacttaacacaatgccatgcgtccaacagtcccgcaatggacctggatgcaattgcctgtcttgtgaagcttaatcgcaagcatggtcttcccctcccattgtctccatctctttttgcctttctaatagaagaaacataagtcaagacttttggaaatatttttcatctattccaaaattatggaataaaatatagcttttttcccatcccacatcaagccctgaggcatggttgatagaaataatgttggtgaggtggcttggacctgggccagctgcctcccaggccaattcgtgctcccaagagggtatcttagaaggctttggagaaagagcagacaggggtttggaccgaataaaggagttgccttctgaatagttaattaaaagtaaaactgcctaaaatgaaggcatctctactctttgaaacagcaaagtcgtctctgaaaagatgtaagggaataagtgctttataaaatggcgtgaatagttatggacaggttggaaaagatgtgtagagaatgcgattaattaaaatgatgatttagtccaacaacctgtcatcaggtctgatgggattttgtaatgttgaaaattcagccgtgaaactgtggaatttggagcagtttccatgtggggtagcagtttccgtgtggggtagcagtttccatgcggggtagcagattccatgcggggtagcagatctagtgccaggcatccacggcacagctgtgggaggagggcaccttggtggggagcacgcacctcctcctttggttctcataggcctgatcctggggaattaccagagtccatatgccagaagtttaagagaaattccatcattccacacctttctgtctatctatatttatttgtccgtgcttgccccaaactgcagtacctttgttggcctgagtcttacagattgagtaagtgttgtgttgtggcaaacagagcctttaatttattgatccactgtctttagttccattgtcttttttatattgatggtataagtgttaaattaaatgcgtgattaccatttatataagtttatatgtgatttgtatacttatttatataaaattttataatatatattgactgtcaattttgttttaaaaattaacatagtaaatataaaatttaaaaaaattaagaattacttgatattaatttatattatataccatatataatcaaatcaccatcaagaccaaattatatataaatcatataaattatgtatattatgtaagttatattacattatattatataaattatataaaaatcatatatagttaaatataaaaatcttattattatattatattgttatatataaaagtcatatataagattattataatatagttacatatataaatcttattatatataagattattatatattatatagttacatctataaatcttatatataagattattatatattatatagttatatataaatcttatatataagattattatatattatatagttatatataaatcttatgtataagattatatattatatagttatatatataaatcttatatatatgattattatatattatatagttatatataaatcttatatataagattattatatattatatagttatataatttggtcttggaggtgatttggttctagggcttaagtatccagatttgtcttacctttccttatattatgaaacacccagccgggcactgtgggtcttgcctgtaatcccagcactttaggaggctgaggcaggtggatcacttgagcccaggattttgagaccagcctgggcagcatggtgaaactccatctctaccaaaaattagccagacgtggtggtgtgcgtccatagtgccagctattcgggaggctgaggtgggagaatcacttgaccctggggagattgagactgcagtgagccaagatcgtgccactgcgctccagcctgggcaacagagggagaccctgtgtcaaaagaaaaaacaagaaacaaaaaaaacaagaaacaaaaaaccccaaacaaagaaacaccctaacaccctatacatgagtcattaaatttgtcaaaagtgaataaaatagatattttggtttacatgtctctaagaaaggagttgagtttagttaaaagagggtttgcatccagatattagatttgggatagacatgtaccttttacagcatttgtttgaaaccctcaaagtgtagtccttcttgtaaacaaggcacatgaaaatgacaaggggctcttgtgctgtaaaacatttttgtgagttgtttttatatgagatggtattctattcagaagacttttaaaaaattgagatattagatactgtcatgtcaaagaaaatttttaaagtttatttatttatttattatttttattttttttaaaatttgagacagagtcttgctctgttgcccaggccagagtacagtggtgcaatattggctcactgcaacctctgcctcccggattcaagcgattctcctgcctcagcctcctgagtagcgggattacagatgcgtgccaccacacccagctaatttttgtatttttagtagagacaaggtttcgccatgttggccaggctggtctcaaactcctgacctcaggtgatccacctaccttggcctcccaagatgctgggattataggcatgagccactgtgcctggcctaaatctcactttttttttttttttttgagacagagtcttactctttcacccaggctggagtgcagtggcatgatctgggcttactgcaacctctgcctccggggttcaagtgatcctcccgcctcagcttcccaagtagctgggattacagacatgcgccaccacgcctggctcatttttgtatttttagtagagacgaggttttaccatgttggccaggctggtctcgaactcctggcctcagatgatctgcctgcctcagcttcctacagttctaggattacaggcctgagccaccgtacccggccaagttttaatcttactcttaataaatggccatacttttgcctcagtatcctgagtgtattctatatccatattgtaccaattagttctgtggttttttttttttcacccaaacaagcagtttaagaatctgttcacatgaaggacttggcacaatgtcttgtgcaaagtagagagtcaataaataactgttgattgattatttgttttattaccctttctttctcctccttccctccctctctccctacctaccttccttccttcttccttttttctttttctttctttttttttttgagacggagtctcactctgtcgccaggctggagtgcagtggcacgatatctgctcactgcaacctccgcctcctggattcaagcaattgtcctgtctcagcctcccaagtagcttgcactacaggtgcgtgccaccatgcccagctaatttttgtatttttagtagagacagggtttcaccatgttggccaggatagtctcgatctcttcactttgtgatccgtccaccttggcctcccaaagtgctgggattacaggcatgcaccgccatgcctgggcctttttctttctttctttctttttctttctgacagggtcttgttctattgccaaggcaggagtgcagtgatgtgatcatagctcattgcagcctccacctcccaggctcaagtgatcttcccacctcttgagtagctgggactacaggcatgcaccaccacacctgtctaatttttaaattttttgtagagatgtggtctctacaaaaactttttgtagaggccccatctcgacaaaaatttgtttgcccaggctggctggtcttgacctcctgggctcaagtgattcttccactttcagcctcccaaagtgctgggattataggtgtgagccactgcacctggtctgattacactttttgtaagtttctccctgtggttattaaaatggggtccacacagtctgctgtaacttatttgccagtgtttataaaagatggcatcatacattttcaggagtgaattctttgaagaaagaaaattgtaattgcttttgtaattgtttatggggaaggagttctaagtgtgagagatggccacgttggtaagaaatggctactggcagatacagtcattacgtgttacacaggtagagaaaggacattcaaccatgttcccttaggtgtggctgcactgaactcagagaggagccaggtgtgagtaggaaaggaggaatctgtgggagaaaagggttgttttgttgtgtggcttttttatgtgctgggagaaacatcctccagctttttctagcctctgcttgtgcccttcccctccagtagtctctgtgtgagctttttaatctcctgtaatatttctaaagctacttttagttcaatgtgactaatactcttattttcataactgaatgaaatgcattttagtgtgggtatacttgatatttgaatttcatagtaaagtatcttttttattttattattttgctttattttttaaaaattaaactaaaaaattttttttgagacagagtctcactctgtcgcccaggctggagtgcagggcttactgcaacctccgcctcccaggttcaagtgattctactgcctcagcctcccgagtagcagagatttcaggcgcatgccaccacgcccgggtaatttttgtatgtttagtagagatggggtttcaccatgttggtcaggctggtctcgaactcctgacctcgtgatccacccaccttggcctcccaaagtgttgggattacaggtgtgagccaccgcacccagccttctattcttctttaaacaaaatttttattttatttttaagagacagggtcccgctttgtcacccaagctggagtgcagtggcatgatcagcacactgtaacctcgaactcctgggctcaagcaatccttttgtctcagccttccaaaatgctgggattataggcgtgagccacattgtctggcctcttttttctcttctttcccttttcccaatcccttgtcttcccaattctgacttactttttggccattaaagctttgcaaaaaattaaaagtattttgaagactgcaaaaaagatacgagagcatctctattccaattaggtcatgtgaaaagacaacattacaactcatctagttttgtagattttttttttttttttttttgcgacagttttgctcttgttgcccaggctggagtgcagtggcgcaatcttggctcactgcaacctccacctcctgggttcaagcgattctcctgcttcagtctcccgagtagctgggattacaaggcatgcgccaccacgcctggctaattttgtatttttagtagagatggggtttctccatgttggtcaggctggtcttgaactcctgacctcaggtgatctgtccaccttggcctcctaaagtgctgggactataggtgtgagccactgtgcttggctgtttgtagatcttaattggcttttgtgattccagaatctggcagcagtcagaccaaaaaatggttcacaaagctctgccccaccacacgtgcaggttatatttatcgccagagaaaaggaaataacattcagaaaaaggatgtgaggtacagacagctaggttgggttataactcagtatttgccttatttgaaagtggtttgaacagttggccgcctgtgattggctgaagcttgtctgctgtcaatgactgaaactcagctctggttacaaaggcaaatttctagttaggttttcagtttgtttatgtactaagctaggttgcagttcattacctaggactcctatggagtcttctaaagcccaaatttagttttaacagttgattatacaataattaattaattattttatttatttatatttttttgggatggaatcttgctctgtcacccaggctggattgcagtggcatgatctcggctcactgcaacctccacctcccaggctcaagtgattctcctgcctcagcctctcaagtagctgggattacaggcgtgtgctaccatgcttggctaatttttgtatttttagtagagacaaggtttcaccacgttggtcaagctggtgtcgaacctctgacctcaagcgatccacctgccttggcctcccaaagtgctgggattacaggtgtgagccatcgcacccagcctgattatataataatttaagcattgatgatactaaaatttcagaatttaaatagtcatttggttgaccctttataacaaagaggtgtgattctattattttccttgtttgaatacttaacaaaattatttgtgttgtatagtataactagaggaaggatttaatttttgtaaatgtaagcaaaatatttttcataaacagcctaatatttctctactcttgaccagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggtgagtatgtgcttctattaaaaatcctgctgtgtgtgtgtttattagaaattttctaaagcagattaagtttgagtcagcatttgaaattattcacaactgtcaggtcatggtctatttctgccatccaatagctggatggtagatccattatgaataatcaatatttaagatttagaaaaggacagaaacaatatcatgatgattcagaagttttggggattatttcaggttctttgttttattttgaagaattgaggtcacatgttcagaaaatacatacatttagctaggaattctgttcagccttgcagtgtgcacacacgtgtatctgcagaggaacatggtaagttttctctgtcgcccaggctggagtgtagtggtgcaatcatggctcactgcagcctctttctcttgagctcaagcgatcctctcacttcagcctcttgagtagctgggactgcaggagtgcagtactccacccagctaatttctaaattttttgtagagacagggtctccctatgttgcccaggctgctctggaactcctggcctcaagtgatcctcctgccttggcctcccaaagtgctgggactacaggtgtgagccacggtgcccagcaagttttcacttttataaaattgatttgtagaaataaagtcttactatagatacaagatacatttgtgtaactttaattagtttgaaaactgttctgggcattttggttataacaacaattttgttttatacatttgatagttcatttcaccatgagatcactttttttccccagagtttatagatcatacttaataaatcaagtcgttggaaagaaatatttttaaaaaaggacttcagaatatgagaactgaaaattaacttagaggtcatctaagccatctagggtttttgcagatgaggaaatgagagctgtgtgaagtagagggaatgtctcagcgccatgcgcctgggactgctggagccaggtggaggaatcttatctgacctcttctcttgctgcacagaactgctggttctttaggttacttttttaaaaaattgtttactgccactgtctgttttataaatttataaatgaatgtccacactcattcatttacctattgtctgtggctgatttagcaccatggcagatttgaatagatgcagcagaggccatatgatccacaaagccaagaagatttactatctgcttgttcacagaaaagtttgcggacctctcatttgaaggatgaattgtgtagttgttgggggcttgtattagcttcctagggttgctgtatcaaactaccacacacacggtggctaaaaacaacagaaatttattctttcacagatctggagactggaagttcgaaatcaagatgtgggtgcagggttggttccttctgaaggctctgagggagaattcgttctatgcttctttcctagcttctaaagcttgccaccggttcttagcactccttggcttatggaagtgtctctgatctctgccctcatcctcacatggagtgtgtctctctgtgttcacatggccttctcataaggacagcagtcatgggaatagggcccgccctcatccagtatggccccatcttaactaattacaactacaaagatcctatttccaaataaggtaaccctctttttttttgagatggagtttctctcttgtctcccaggctggagtgcagcagtgcagtatcagctcactgcaacctctacctcctgggttcaagtgattctcctgcctcagcctcttgagtagctgagattacaggcgtgtgccactacgcctggctaatttttatagttttagtagagacaaggtttcaccacattggctgggctggtctcgaactcctgacctcaggtgatccacctgccttggcctcccaaagtgctgggattacaggtgtaagccaccgcgcccggcccaaataaagtcactttctggggttccaggctgacatggatttatgggggacactgttcagtccagcagagggctatacaaacttatgtggttgtgttagcattcttcagaggcttaaccaaaagtcctgtgggtgtggaagtattttcaaacaatcttaatgtggtagcatatattaaggtgaacatgtggtccagttcaaattcctcctcacccctcgctcctgtcctacccacatcttccccaccttcctttacctgacccacatttctcaaaattgtggctcttgttggataaggaaagggataatatttttttaggggggatggtggtgatgaggaattttatttcttataaaatcatttctattatataattgaaaaattaatatatatgcccactgaaaaattaaggtgattcaaaatggtatctagtgaaaattattcccctccatttctatttattatttatttatttaagagagagagtcttgctgtgttgcccaggctggagtgcagtggtgcaatcatgcctgggtaatttttaatttttaaaattttttgtagtgacaaaggggtctcactgtgttgcccaggctggtcttgaacacctggcctcaggcaaactcctggcctcccaaagtattgggattacaggcatgagccactgtgcctggtatcccctccaatttctgacccctgtcattctggctaccttcccctgagccaggctggctctgtgggcctgtgatctgggataccacacaggaccccatccacaggagggctctgtacttgtttaatgttctcctattgctgtcttgaaattctcaaccatttttgaaggaagggcctcatgttttcatcttgcactggctcttttgaattctgtagctcgtcctactctgaggcagccagtgttggcaatttcgtgtttgggtttgcagaaattttctatgtagatttacaactgaatgtcatttaaaaaatcagagtgtatcatatacgactttgttttcttgacttaataactgcatctcagagttcacagtatagctgcccatgcttattttatttgttttaattttatgatagggtctcactgtgtcacccaggttggagtgcagtggcgcaatcatagctcactgcagcctcaaactcctgagctcaagcgatcctcctgtgtcagactcctcagtagctgggactacaggtgtgcaccaccacacctcgctaatgttttttattttttgtagagatagggtctcactgtatttcccaggctggtctcacactcctggcttcaagtgatgcacccatcttgcctcccgtagtgttgggattataggtgtgagctgctgtgcctggctgccccatattttaatgtctgcaaaatgttccattgtgtgtgacaattttttggcttggtcctctaatgaaaaacattcaggttgttttcagcctctcccccttacaaacagtgctgtaggaattatctttatacataacagatctttgtatccggtatgagtgtgtatatatatatgtaggataaattcctggaagacatctgagttaaagtacatacgcgtctcacattttgatcaatattggcaaatgctcctctgttgcagttgtactagtttacatttccaccagctgagtttgagagtggctagttctccgtgactttgacaacactgtgcatagcatacttttgcaactttgacaatctgtttggtaaaacatgaattctcattgcttctacctggatttctttctttatgggtaaattgaacatcttttaaaactacatttataaattatctgtgctttttctatgatttacctatgcatattctttgctgttttccaattgggttataggtaatgtttactggtttgtaagagtctttgcatatgaaagaaagtagccctttgaccatatgtattacttcattctcacgctgctaataaagacgtacccaggactggataatttataaaggaaagaggtttaattgactcacagttcagcatggctggaaaggcctcaggaaacttacaatcatggtggaatgggaaggaagcatgcccttcttcacatgaccacagcagagagaagtgcagagtgaagatggggaaaagccccttataaaaccatcagatctcatgagaactcactcactatcatgagaacagcatgagggaaccactcccataattcagttacctctgactgggtcccttctatgagacagattatgggaactacaattcaagatgaaatttgggtggggacacagccaaaccatatcaccatagatgttgcaaatatttcctccacatttcttacttgtcttttgactttcaaaagggattttttttttgcaatgcagaacttaaattttttttgtgtagccaaatatattaaatcttttctctttgtgattcctgaattcagatttttgttaaggaaagctttctgtgctcagaaattatcagaagaatcatctcatgtttccttctagtacttttccagggaaaataagattttaaatgtcttagtttgcttattttaatcatccttttaaatttaagtgagttacagtagacacaagattaatgtaggtgtccaccaatgttaactcctaggataaaattactacagttattttctgctataaaaaagaagatttcaaagtcatctcttatcccagtttgctgtgatctagtaatttttttttcattttaattgcggaggagaaagaaaaggttttccaaataatgactgctatttttaagatgtattttcctataacaaatatggatctaatgaaataaatatacaaattatttcatgtttaactgtttctattctttttatttctaccttcagagaagtatttgtagtttaccttatgagaagctttgcttaatttgcttttctgtggtctatggacacacttacaaaagtatattcatgaagaagagggctttgtttccagaaagtaggtaaaaatgattatttttatttgtatgctcagattttaaaaggagactcaaaaattctgaaggatatgcaggctcaaaataatgttagtctagatagtcaatgtctctttctacatgattaaaatgtatataactattatttaagtggtctccctggcttctgaagattcttggtcagtcatatgccatgcctgatgatggcagcaggtggaaggagaccccagaggcaagcagtagatttcattgggcagtgaggggattggacatcaagggtagtcctcagtgccttcctgcccctgccagtttgaacttctgctactctatgcagagcaaatgaagatattatcctgagagccagggcagacaactgttagattgagaaaggagacaccacactggaagccaggcacagttgaggccaggctccccgcctgacagaggaatgtgaactggaaagagcagacacatctcttgatgacaagttggcatctgtgcattttagcccaggtaagggccggagtgcctgcctgggaccaagatagcctgggcctgactgaacacaaacaaagaagacctagatcgttcagcacagaggtgcccatttagcagaggtatgagtgtctccgggtactcagggctgtaaggaaacacaggatgcaaacccagttagggtggggagagggcttctcaacatatcgatgttactgaacaaactatgttatgttcctaaaatttattctgaaatatgccgtatgtgataagaaatacataatttaaaaaggagtgatacagtgagcaaccattgtatgcactatccagtttaagaaggacagtatactattaccagaaatgtggaagccctctgtgtgcctctctccctgatcccatcccttcccctctgcaccagtgatagtcattggaaagaaagggtcttgctttgtcacccaggctggagtgcagtggcacgatcatggctcactgcagcctcaacctcctgtactcgatcgatcctcttgcctcagcctcctgaatagctgggactataggtgtgcagcaccacacctagctaaattttgtattttttgtagagatggcatctccctatgctgctgaggctggtcttgaattcctgggctcaagcaatcctcctgccttgaccccccaacgtgctgggattactggtgtgaatcactatgcctagaccttatttttcatttaaaaacctttgtcttcttttacctccctgaatatgcacatagtttactatgacacatgtgttcccattgcaattccttattcccaaacaaatataattttcttttagagagcctcttgttcatctgggaagcttgctaggcttgggttcttctctgtgggaaatgtttcaatttccttaatgaatggactgtttaggctatctactttttcataagttggttttcataattctgtttctataaattctaagatgtctagttttttttttttttttgaatcagggtctttgtctgttgcccaggctggagtgcagtggtgccatcatggcccatggcagccttgagcttgtttttaagttttaaagtctagtataacattttttttcaaaagtaagaggaaggtacagaaatttcccatgtaccccctgttcccacacatgcagagcctcccccattatcaacatccccccaagttttaaataagatattcttaagacctgtttaaaataggtagttatgtcttctctttattcctaatgtttctgttgtgtcttctctgatttttttttttaagtttatgttgttcatagttttttgttcatttgtttgtttttggtcttttggcttattgattctttctgatctctctatacttatatctttatagctaatttttctcttatttttaaaatttctgcccttgcctgtatcattttttccttctatacacttttttttcctccccttaccttaatgttcagttagatgcttagctcacttttaacctttttttcttctctaatgtcaatatttaaggctagaaatttctcactgagtactgtcagttcattccatatattttgatatgcagtattttcttttttttaaatttaattttatttattattattattttttgagacggagttttgctcttgttgcccaggctggagtgcagtggcccgatctcagctcattgcaacctctgcctcccgagttcaagtgattgattcttctgcctcaggcttcctgagtagctgggattacaggcgccaccacgcccggttaattttttgtatttttagtagagacagggtgtcatcatgttggccaggttggtcttggactcctgacctcaggtgatccaccagccttggcctcccaaagtgcagggattatggacgtgagccgccacgcccagcctgcagtattttctttattgttaagtataaatgttaagatatttatacctttcttttttgacccatgcattgaaattatgagtacatttggagtttcttctactttattatatgcttttaatttttctcagttttgcagtttttttaatcctttcttgatgtaattttactaaagtctcttttttctaattttattttcccctttactcaattcaaataatctatccttttagtggttaacttagctattttaacatacatacttaaattagttaaagataatcagtaaccttacttttgtcccaaactttttttttttttaaagccagagtctggttctgtcacccaggctggagtgcagtcgtgcagtcttggctcactgcagcctccacctcccaggttcaagcaattctcctgcctcagcctcctgagtagctgggattacaggcacgcaccaccatgccctgctaatttttttggtatttttagtagagataggggttcaccatgttggccaggctggtcttgaactcctgaactcagatgatccgcccaccttggcctcccaaagtgctgggatgacagatgtgagccaccacacccagtctgtcccaaacattaaaagggcctttagacactttcaccctaatcactctgtttacatgtgtttggtttttcagtatttcagttggcctctcatcctgcttcacaaattaggcatttctatttgttggttgaacaatcaatgtttgttcagatttagatttacccacatatttactattaattttatctttacttcttgaatctgagatattccatctggaattattttcttcttcctgaatacatcctataagtttctttaagtgaagttctcttggtggtaacttctctaagtttttgtttgtttaaaaaaaggtattttccagacaatgtctttctttcaccttcatgcttgaaaaaatagttttactgagtctggaattctgggctgatgtttattttttctaaacacattgaaattattattttactttcacctggcctctaagttgctattgagaagtcagctgtcagtctcatcactattcttttattgggaaactttgttttttcctttttcttttcctccctttcttcttctgtccattctgtctccttttcttcttcctctttctcttcgtcttcttcttcccctctctctggttgcttttaataatatttctctacgatgtgtctaggtttagagttatttttatttatctagtttagaattattgattgggcttcctgagactaagggttgttatctttcaataagtctagaaaattattagtaattggccaggcgagatgttgcatgcctataatcctagcactttgggaggccgaggtgggaggattgcttgagcccaggtgttggagaccagcttgggcagcatagtgagaccttgtctcaaacaattaaattaacaaaaaaaaaatgtttagcaattgtatgcttgagtttaggttttcccctataatctgtatttgcttctccaagagctcctataagacatctgttagctcttctcacactgttttcatacaataatatttcctccacatttttcatcttttttcctctctagattatttgttgtttgtttgtttgtttgtttatttatttattatttttaaaaatagagacagagtcttgctatgttgcccaggctggtcttgaactcctgggctcaaacaatcctcccttctctgactcttaaagtgctgggattataggcatgagccaccacacccagcctggatgatttctttgactgcatcttccaattagctaattttctcttcacgtgtgtttgtttaatccacatattgggttttacaattccgctattatatctttttattttcaggagttctttttggttcctttctaaatttgcttgattgttctctctaggtatttattctgttttcgagtttctcttttatttcactaaatatattaaatatagctgttttatattctttgcctgataattccaatatctgattctgatttttaattccaccttctgttatttcttcatgctctcactatgttttctttttattcccttatttatattgtaacttttggcttcaaactgctcatttttaaaaactttattagtggctatcttagtctgttttgtgctgctaaaacagaataccacagactgggtagtttataaacaatagaagtttatttggctcatagctctggaggtggaaagtccaagatcgaggggcagcatttgatgagggctttctggctgcatcaaacatggctgaaggtatcccaggagcaagagaaagggagagcccaaactcacagcctcaagcctttttataaatgtcatcaatcagttcatgagggtggtccccttatggcctcaacagctccccttaggccccacctcccaacactgttgcattggggattaagtttccaacacaagctttttggcggagacattcaaatcacagcagcggatactgtttgaggcctggggtttatttctgctagtttccttagaactgtatcaaacctagacacatcttaaactcagatttccttttaagattttttaggatcacacatggcatgggaatttgaactgcaacctctcatgaattctacttgtggttataaattctcagaggagaatattttccccttcacccagaagcaaagttgaatcagggaagtttccttccattctgttctgcctggtggggtattttctcattcatatttactttgaaggcagaaccctctgaagttctggtgtgtgtgctttatgaaactccccagcttgacgaggctccgggctttatctacatccccctttttcctcttcagtgtcaaagtgatggtaaaggtgtcatgtgtgtgtcagaaactctcagcatgttcggtggctttggtgtgtgcttattctcaggattcacgctctcactggctggactcttttatgccaggtcagcagtgtatttaaatttttttttttcttaattgggttaaaaattttctttgagacaacttttagggcctctaatctgccatagtagcagaactgggagttgaaaacctgttttatgttcattattttctacatatatttggtagcatcaagtcaaagataatgatgaattgttcttcagccttctgaaattctgaagaaggtatttggtcttaaattgaagcaaaagactagttcactcaactataataaaacctttcttgcctcgaaatctagagttggccaactaaagaagttttcagaactttatatatggaatttctgggaaatagcatagatttactttattacatttcaccaacttactgctactactattaacgtgttatctcatgtaatcttttaacaatgattagtaagtgtgtactctgggaatcaatcagaatttctgataccaaagttcctgcacttactcatgatgttatattcctttcaaccaagatttgaggcagcttccaaccatgtattcagtataaaagaataaaattaatcactgagagacttgaggcaatggataggaaaacaataaagctttgaataagagtaacacacaggaggctgggcatggtggctcacgcctgtaatcccagcactttgggaggctgaggtgggtggatcatctggggtcaggagtttgagaccagcctggccaacatggtgaaaccccgtctctactaaaaatacaaaaattagctgggcatgatggcatgcacctgtaatcccagctactcaggaggctgaggcaggagaatcgcttgaacccaggaggcagaggttgcagtgaaccgagattgcaccactgtactccagcctgggagacacagtgagactctgtctcaaaaaaaaaaacaaaaaacagtaacacacaggaatacataatacttttttctcaacagctgtgacctgtatttggtgttaagattttgtgggtttttttgtgagtcagggtgttgctctgtttcccaggctagagtgtagtggcacaatcacagctcactgcagccttgatctgccaggctcaagtgatcctcccacctcagcctcccaagtagctgggaccacaggtgtgtgccaccgtgcccggctaatttttgtattttttgtagagacagggtctcaccatgttgcccaggctagtcttgaactcatgttcaaggaatcctcccaccttggcctcccgaagtgctgagattagaggcatgagccaccacgcctggctggttttaagctttttgaacatacactaagagtagggtaggcaaagaacaactaagttggtttgtgtgttgccctgtaggacaaacacctgtgactttgtgagcctttttgcaacactgttgaaattgcatcaaggccctgatgatgaagattggcagtaataaagtagtctgggggaatatcgtttatgttttaattataaaaattgaaactcttctaagctattgacagctgcattactgggaaggtggtttagggctggacctgcctggtgaaggactggccctggtaggatctggatggggtggtagcttcattgagcatcagatttcaatccactaccaagtttccaatcactccagttgttcctattttgccaaaacagtcgccctctatgtcccccatggtcttgtgcctgttcgtattgggagggcctgagatgcatctgggcccttagagatactttaatcacagtatggacagcctgtatcatctcagtctcagctgatcagggaccatatgcatagggccagattataagtaaaccagctagtggtgtgaaacttggaaaagccatttactgtgtatatttgggtcttgtcagcaattcctgagcatgggtaggggtgtgtgtgtgtgtgtgtgctcttgctgtggtatacaagcacaatgaaagtgtataaaaacaaatgtaaagttcatggttagatttcttaactctggaggttagtcatctttgataaagcaaactgggatgactttttgtgtgagctcctaacttaaggactaagaaatacaaaagatcagtttccgtaaataaactggctcacaagtgtgcagtagttttaaactttctttttctttgcttcaaggattttgactctttcttctctgcaaaagaagagaatattatttattccttccttggtttggctcctcctccagactcaaaggtaagtttgaacaaactccattggggttcaaaacaggtaatactaaatgaaggtagaaatcaccgcatccaagactgtttaatacatgatgatctctaaattaacatgactttagtacacttcttattctgatgcagtcctatgcatagagagaatgcagtttttactaaaaaaagttccaaaattatgcttttcatatttatgctgtgttttcaccttgttacaataaattttataatacctaagttaggaaatatcattactttgaataatcttaagtgcattcattaaatatgtaaacatttgagctcctaggttgtgtttatacaattattttgttttgaattgacttctcatatagctttatatgagttaatttcataatgatatatacccttacattatttctatttaaatgaaccaaactacattttggtctcataaaaatgggacaggtaagatctcgattcaacgacaaggtaggttttatcagatttttttcttccagtgacgtctcatctttgattatgtataattaaatagagagttatgctaataaagcaggaaccatgaatttgacttgtgtgcatgtttaattcatgtgacttgctaagacttgctgatggattgaatgtggatagggatggattccatgatgacttctaatcagtgtgtgtaaaaatccactctgagagaggaccatattgaggggggaagttaagtttgaatgagacagctgagtgaagaagtgaggtaggcaattgcatactgatctgtgtctctgcaaagtctggttggagacacacacgtggaagctgcgaacgcatgtagatggagctgaagtcatgaaaagtggatgaaacagagtaatgagagagttgacaggatggagaccagagtgggggtggaggtgggacttcaagtttaaagttgcctggaagatgagaaaccagttgaggaggctaagatggagagtagggaaggcaggaggagaccaggagcgtgtggcgtcatggaagcccaggaggagctcggctctttacagaagagggtgatgttagttgtgacaaatgcggctgagagattgagtcaggtgaggccataaaagtgaccactggctttgatgacatggaggtcattagaggccatgacagaagtagtttctgaggagaggtggaagcagatgtatgtggtctagacagagtggtctaaggagggctggtagtgagaacgagggactatgcatagacaattattttgggggaattttcccacagagtgaaagagaaaaatggcagacatcattgttttaaaaaatgccctactccttcccaccactggaaatttgggcagagtcccttgcgtccctgcttgctgccggttccctagcttcctctctcctccctatgttctggaaagttcccccatctctgttctttacccaagctcaatctctcgtcttaacccaagttctctgtctttcagtagacatctcccgtattcctactacttctcaatccccttcttccagaccccagacctgtgggtggtaggaggggagagtctagtttttacaaaggcccactagggggttatctaaacaaaagggaattttctatccttggtcaataataatgtggcaaagctttgaaatgacttttttttaaccttttgtaggtcaaatttttgacagagttactgtcttcaccaagagtcccaataaacagaaggggagacggtagtagaaaaatatattttctgtctgttcatcacaaattccaggaatcatgtcttccttatttcttccctttgcaatatctttttattttttattcctttttttatagcattagaatcttttattttttcatgtggctatagccttcatgatgatcatttaaaacttttgtctgatactctattacactgatgtatcataattgacttccttattcctatatgtttaatttttacttattattgtgtcataaacatgtttatgctattatggtgtcataatgtcatctaaatattttgtataatgttccatcaagttgatgtgccatgcatttaaaaaaatttttgttcatttatttattttttagagacaggatcttgctatgttgcccaggctagttttgaacttctgggctcaagttgtcctcctgcctcagctttccaagtagccaggactacaggtgtgagccactgtgtccagcataatattttttcactatgcttatatttttgaacctggggttgctcattatttttaattacaaataactctgcactgattttcaccatgaaatagtattctttattttggagtatttccttaggataaattcccggtagctctttcagtgagacaaaaatgcacacaactttttatggctttgaacgtgcctccagattactttctgggaggattataacattcatcctgctgcactgtggtggaccagcttcactgtaccttccagatatgagcattttaatgaccttgatcttaggaccattaaattgtattttagaaatttgtttctggttttactgtgctatgaggagggaatttggttttgataaatgtctgtcttaagtgtctttgtaactgaatgtatattttttcatttttgtgtgatattttattttttaagttgacaaataaagtgtatatttaccatgtacaatgtgatgttgtgaaatacgtatacattgtggattggctaaactgagctaattaacatctgcctttcattgaatactttttttttgtggtgagaacacttaaaatctactctcagtgatgttcaaaacacagtgcattgttatttgctatagtcactatcttgtaaaatcaatatcttgaacttatttctcctaacagactattttgctataaaagattgttttctgaatattaaaaaaataacttttttcaaatattacatatatgatattggaaaggtcaaatagtcctacaaagattactttttaaaaaaacagtcctgctaaacatttcatgccagaaaatgccttatattttcctgctttagtctgcagtgtgcttaggtgcagaattccaggctggacgttgctgcacctcagaaccgggaaggtgccgctccatcatctcttcccacttccagagctgctctgagatcacgtctgatgccagtctgtctccagatctttttatctgcctatttttgtctttcccaattctgggagattttagggtccaattttttggttttgaagttgtacgatgaggtagctcgtagaggtcttcgttatttgtgctgggcatttgctgggaccctttaatttggaaggtcatgtgccttggctctgaaaaacaaaatgttagaggacttctatgcggattcatttccagttcattttcactttcttttctttttggaattcttcttatttaaatgttggacctcttggatgaattctctaattttcttatcttttctctcccattttccatatttttgtatttttctgctttctgggatattttcttaattttctaccttatcttccctctattggtagtttttttccatttctcctatcaatcatatctgaacttctcaaaagctcttttttgttgttatctctgcatgttcccttattaaatagcttcctattcttattatgtaggttcattatttttcttaattctgagtttattaaatatagttttcttttacatcttcttcaactcattgcattctctgttttctctaattctgtttcttctctgtttgctttgctttcctttttatttttatgtaagttgttttcctcagatgtttggtgatctttgactgtttgtatttaaaacaaagtactgagctggcagtggtgggtgcatgtctgtattcccagcaactaggaaggctgaggtgagaggattgcttgtgcctagggtttcgaggccagtcttggcaacataacgaggctatgtggtggtggtggtggaggtggtaagggtggtggtggtggtggtggtggtggtggtggtgatggtagtgctggtggtgatagtgatggtggtagtggtaatggtcatggtggtgatggtggtggtggagtggtagaggtggtgattgtggtggtgatggtggagatgatggtggtggtgatggtggtggtggtgacagtgatggtggtgatggtggtagtggtggtgaggtgggtgatggtggtggtgatggtagtggtggtgatgttggtgttggtggtggtgatggtagtggaggtgggggtgatggaaagtgggagataaatctggctgccagtgttctagaagcaagtagggaagggaatggagggtctcccctttcagaatgtgaacttcttatatagaccccttgttttcagtatggttgcctacttcagctggcctcatgcccaggaggtcatatttcctctagttcagcttctacagagacaaaaactgcttatttagaaggggacagtcacttgccgtccagggatgaggagggaaactaaatctacttcttctttctctcacatcgctctttgtaagcaattaggtttcagattttttctggttaagtcaattattactcaacgattccctttactgcctttgaatttccgtagacattttttttttcctgcaaaaagacttcttgtccatttaccctgttcttgtgaatttatccttttctttttaacatctttgttgtattgtcagtggggctctggtaagaagccaaagcaaatatctgttttcagcttctcatgattaactagaaactgcctgtagttttcaatggtcccagtcttcctgaaaaggaactatcatcccctgttattccattaatttctttccatatgttggttaatttaatttaatctatttttagttacataatttgagattaaggattttaatatctttgctctttttaaaaaaatagttttattgggatataattcacacaccacacaattcacccatttaaagtgtacaattcaatggcttttagtatatgtagagttgtgcaaccaccaccactgtctacttccaaaatactgtaatcatccttaaaagaaacccagtaccccttagctgtcaccccctaattcagccattcttcctgcctagggaaccactcaaatgctttcgttctctgcaggcttgcctcatctgagcatttaatgccagtggaaccatacaccatggggtcctttgtgactggcttctttcacttggcatcatgttgtcaaggcttgtctgtgttgtagcaggtgtcagcacttctttctttgttagggcagactactatccatggcacgaatggatggactgcattttacacatccattcctcagtggctgggtatttgggttgtttccacgttttggctatcatgaatactgctgcgatgaccatttgtgtatcttttgtttaatcgatttccaatacttctacagttgctgctttgtatcagaatctcttggacaattttaaaaaattcagatgcctgagttttactctagacttactgaccctaaattaccaggggagaggcccagggatctacatttgcaaaaagtcccttagttgattctgatgctcatttctgtttaacaaccactacactggagactcatttaactaatattcatgtatatgcttctccagaatgaatgtggtatcttatttgctttagttaagaaactcaaataggcagggaaattgtaaggccactttgttcctttccccattcctgattctctcctgcattcatcaatttggtatctctctttccacaagcaagacatctttttgtgctgtattttcaatgcctaattgttatattgtatgaaatctgctttttaaaaagacaccatggacattttattaatatttttaaacaacaatagtagtagcagtcgcaacaagaacaaactcttagccaggcattgtggttcgtgcctgtaatcctagcacttaggaaggtagaggcaggaggatagtttgagcccaggcatttgtgacctgcctgggcaacatagtgagaccctgttctcaaaaacaaacaaaaacaaacaaactcctagagggctagcaacttaacagatattgcgaagctccaaatgaaattccagccattaaaaaaagtaactcatataatagcattaatagatgtcaaagaaaatatatggataagtgaataatgaggctgacaagttcaagtagattgctccaggtcacaaggctcataatctgtagacctagaatttgatttcaacattttctgattattaacccagtatcctcttcactcccttgtgtttagggctacatttatagaaaacctatctacgcttaagtctattaaaattaaaaaactcatttgtcacatatatagataactatcaccccaatattttactctaaaattaataattaaaagagaagatccaaacattttttttctgccttttaaactagaatctataattcatacctggttgttgagagtaaactttttgttgtaggtcaaatatcgaataaatgatagaattagaaaaataacccgtttgccaaagccaatgtaataattgattacagcatagctaatgaatagataataaaactgggtaaaaggcattaggtgaatttgtttcttgggggaatcagttaaatttcctgtgctaaagtattagccccgccaaacattatttgctaaattcaaaggggaaaccgatctttataataaagagatctattggtcacagccttaacaaagtagccaaaccactgtcactactaatgggactcactgatatcaaatgctgcctgttgcaaacgtgaagtccatagtctcaccagtcaagtgttcttgctaaatcatttcacctgcatccaatccagtctccagctccaagttctagtctataaaaaacacagaggaagaggagcaagttaaataatatcacaaagaaagaatcagacaaaacaaaaatttggaacattcttcaagataactgacccagattcttaaaacattcagtgtcatgaaagaaataaataaaaagagatggaattgttctagactaaaatagactgaggaaatatgagaatcagatgcaattaatatgttttaagaggttcaagtctaaagaaagtaactgtaaaatatttattgcaggcaacttggggaatttggaaaggaattggatattagatgacattagggagttcttgttagttttcttagatgtgataaaaatactggagttacgtaagagaatgcccttgtttttagaagatgatactagaatatttaagggtgcagtttgataagacagatgaaaatgttagcaagtgttcaatctatgtagttcatctttaaaagcttttctttgtctttaaaattttcataatgaagagctggagcaatgcttttttttttgagacagagtctcgctctgtcacccaggctggaatgcggttgcgcagtctcagctcactgcgacctctgcctcctgggttcaagcaattcttgtgcctcagcctccagagtagctggggttacccgtgcccgccaccacgcccagctaatttttgtatttttagtagagacgaggtttcaccatgttggccaggctggtctcgaactcctgaccttaggtaatcttcccaccttggcctcccaaagtgctggattacaggcatgagccactgcgcctggcctggagcaataaggatttggagctaagcatatggcaatgttgtattgcctttgctcttattagttaaaagcccttaaaatgtcctagtcaaaacttgaggaggattgctctaaatggagaagaacacaactcaaataaaacttgtttcaaggcagaaagacacacaaatggcaaatggccgtgtccaaagttactatgtctaaagctgctttaagttttacagggaaaaaaacagactttagaaaattatgtggaaaagttagagcagatgaacttattttccagtgtgcagagtgtccaggatcaatctcatattttcagcaacaaaaataaaataaaataaatggttggaagttgatcaacatagatattgccatttttctttctctgagataatgacttgccattcatgtctagggacatcccacttcctagaccccttctcttgcatttctcctgagaagtctcagagttcacctctcttctcatcgaggcttttgtagtcctggtatttctttccatccataatctgtctcattcagcatgaaatgaagaggaactccagtggaaaagaacatatgattcagttagaaaaccttacatactttttacctgctgaccctgaatttgggggcaagatttttaacgttttcccagctataaaatgaagagagaaatatgaccacctacctcttaggggtatttgttttataatttattctttcaagagaatttatttgcgtacatgctgggccagacactgggctggttgattgaagggactttatggtctagaggaatagttagatgtgagcattctgtaagtagataaaataactgtctatgtgaatatggagatggtccaccaatctcaggccttatattaagtctccgaaaagagttgatacctcacttggtattggaagatttagtaggagctcagtaagtggaaaaagatagtcaagacactatgggaagatggatttatacactaaggcaatgaaatttatgagagtatgtttcattcagtgaagtcatactttggatggaatcagaggtttcagtagaacccaggatatggaagtgggtaaagataagagctgaggcaagaaaagttagtagggatgatattgtaaagggccttctgtgtctggacttttttcttggcaatgagaatgatgggaaaaggtcagtgtggagtgatttacatttcacaaagcctctgactcagacagcaacacagaagattgttagagataagatgcagaatctgggactatatctttcatatttacatcctcagagccaaatacagctcataactcgtagtaggtgttcacctctgaaattcgaggcaataattaactggggtaccaaagtcaatgaaacactccggagatattcagcaccattcttcaaattgaatgtaaatgggacaggtttgtttattgtaacttgctattttaaaaaaaattatattttgagatctatttatactaatacgtataaatctatttcagcctctgctgtgttttatcttatctcatttttattttaatatctaatctccgtttttagatcctaccctgatttgtgctcaggtactgtcatattatataaaactcttgttttgtggaagaaagggatggccacaggattatgaaacctggcctagagatacctaagaggccgtccagtccagattcttctcttctgagagaagcaacatgaagcccaaggagcttaagtgacttgtacaaagaaccccgctaattagcagtacagttcgtgctagagcctttggtgctgtcagcattgcttaggttgataggtgtttatactgtgcgcagggacagagtacttccagtatcctttgaaaagacgacatctgatttatggaaacattacttatcacggtgtcatgttgtagtaaacaagattgtggaaaggtgtcagcaaggaaaattaatctcactcaagctaaaaataggtactcttgacaattatgtagaaaatgcatgctcataaaacgtatcatcatatgcagcatcattgcttttagaacatttttcttgtcttagacaggctgttctaggccaaggaccagaccagttttcccaagagggctttgtaagtaagcattggttccataaagtcaaccttagttctttaaaagcatgtggtcatatctgattaaatgaacatcattcttaataggacatggcaggcaggacctaggttacataaccaatgttttcaattatgccctggcaagaaggaagacagattcttgttgaagttatgcaaataagtatattgccaaaaaatatatatgtattctgattgaataagcagattcaataagaatttttgaactccagaggaatcgggcagggagaataagaggtcatttacaagtgattcatttcagcttacaaaagcagaatctacaacattattatgatgtatggaaagcttaagagaaagcaaaaagggcttccttatatataaggaaaataagacattaaaataacatcaacagtattccagacaaaaattactatcatccctcaccaattcatttaatcctatgtaattaattcctattccactggatcttgtggatcttgggttagtcgtctaatgaacccatctgcttctcaacaaaagttctggaaaatttgactaagtccacggatatggtctcaaagttgttttctttttttttttttttttttgagacggagtctcgctctgtcgcccaggctggagtgcagtggtgcgatctcggctcactgcaagctccacctccagggttcacgccattctcctgcctcagcctcctgcgtagctgggactacaggcgcccgccaccacgcccggctaattttttgtgttttttagtagagacggggtttcactgtgttagccaggatggtctcgatctcctgacctcgtgatccgcccgcctcggcctcccaaagtgctgggattacaggcgtgagccaccacgcccggccggtctcaaagttctttaagcaatgccatcagaaacctgaacccaaatgtatttaacatataaccctttactgtggggctctgagcagtcattcttcatgaaagatgaagcatttttgcttgtagctcattacaaataacttcagggaagcatcaaagcaaaacatgctaacaaaaatatctgtagatgacaaaaaacttaaaatgggtgccatttattcattgcttataattttcaaaagtgaaagtctagaaagtcataacaagaataatatatttgatgagaaaatttgttgttttctgtgacatgcaaaacgaaactataaaatcaaccccccaaattttagacaaattacttataaacataatcattaggcctatttcaaagaatacagaaaacattatatctaatttacaacaataagtgggcatagcaaaaatcttgatgtaattattcagagacataatatactctgactataccaagcatatgataagaatatcaagaaacaagatgtagtaggtctggagtaggtcctaaacatctatttattaataaaactgtatgagtatatgatgggaattcccaatcgaaaaacactgttgtaaaacatgctagattcagattaaagaaggatcaagttaacatttaaaacaactgaagttatggttgataacttaagcacctgttgtctgataccaggcaaaacaacaatataatcaatgtctttttatttttattttttattttttgagatggagtctctgtcacccaggctggagtgcagtagcacaatcttggctcactgcaacttccgcctcccaagttcaagcactttcctgcgtcagcctcccaagtagctgggattacaggtgtgtgccaccacgtccagctaatttttgtattttcttagtagagacggggtttcagcatgttggccaggctgatcttgaactcctgacctcagataatctgcctgccttggctttccaaagtgctaggattacagatgtgagccaccacatccagcaatcaatgtcttttagtacattaatttagtcaggggaatattattatatcaatgaaagacatccagttatttaggcaattagatttgcccttaattgacagagatatacacagccataacaatgtttttttgtttctgttttttgaggcaggttcttgctctgtctcccaggctggagtgcagtggcctgatcacggctcactgcagcctcgaccttctgggctcaagcgatcctcccaccacagcttccctagtaactgggaccgcagatatgcaccaccatgcctggctaatttttgtattttttgtaaagacagaatttcaccatgttgcccacactggacttgaactcctgggctcaagtgatcctcccaccccagcctcccaaagtgctgggattatatacaggtgtgagccatcatgcctagctgtcatagcagtgttaaagtgttacctttacagattgctgttggtgtgtaactcctcagtgccaaagcttatacatcccagcgagggctgtccttctcatgggaaccacattaggaagttctaacattccaacagccagacaaacattgctcaaaagaggtttcaaatccctctattagagtcatagtaacatcttctattggaagatggattttcttgtagaacacatttcagtctaatgaataaggcagggataatatatctggatcatgtaacttttggccaaaagtgacttgtgatgaaaagttttgagattcattttccggtatcactagcgagtgcctattgaaagcatttttgagtaatggcaaaatatttaagtaagtgtggcatttcctggtgacctgaaggaggaaggccaaactggacagaggacaggcgacttcacttgaaggagtacaaaaggaagaagcagaaggagctttggaggaacatttgttgagaagcataaaagatatgaatttggagcacaaaattcattcaaaagatgttctggaattttctaatttgaaactacaagatgggtccttactgcaggaaagggtatgatatctcaccaattcatttagtcctgtgtaatgaatcctcattccactggatcttgggctagtagtctcaggaagccatctgcttctcaactaaagttctggaaattttgactaagcccactggtatggcctcagttctttaagcaataccatcagaaacctgtactccaaagtttctagcatataatcctttatgacaggcttctgagcagtcattcttcacggaaggtgatgcattctggcctgtagctgagcagagctgagcagtccgacatgtaacttcattgagaaccagaccgcagagttcaaggaggccttccagctgtttgactgaatgggtgatggcaaggcccttacagccagtatggggacatgacgagggccttgggccagagccccaccaatgccgaggtgctccaggtcctgggggaacctcaggagtgatgagatgaatgtgaaggtgctggactttgagcacttcctgcccatgctgcagactgtggccaggaacaaggactagggtgcctagttttaggattatgtccgagtccaaggattatatggaaggtctttgggtgtttgacaaggaagagaagggcaccatcatgggcgctgaaatccggcaagtccttgtcatactgggtgggaagatgacagaggcagaagtagagatgctggcggccgggcatgaggacagcaatggttgtcaactctgaagagctcgtctgtgtggtgctgagtagctgggcacattcccagcatccccccagccctgtcctttgccctgtgagacactgtgtatctagccccgaaggctttctggtcacagcacccttcccatcttgtctcttttggataatgcttgccatgagcattcaccaataaacttgttctctgttccccccaacccaaaaccctcaaacaaacaaacaaaaactacaagatgagcaacagagagaatgaacagtgttcaggcctccattcaagaagaccagagggaagaaggcatcaaacataaaataaaacacaaagaaatagaaattgtgagtgaaaggtacaagtttgcaagtcagatgctagagacctgatatgtgcacgagaggagttccagaaacaacaaaagaccagatggaagagggctaatcattcgagagatgccagggtcttccagttggagatgctgctgcagccccctccatccccttatcttatgactgcaggaaaaccagaaagggtgctgcctgaggactagaaactatgggagaatccctgaaaggttagaaagcaaaaacatttggtttgaagaaggaaatcaaggtccaaatgcctgtcagagatgggagtggctctgtgggccctgcacagcctcagtggtgtgttccagttgcaggaagggcctgggcatgggcttggagcttgaaaggcagagcccacttccatcctgctcttagacctggcaggggtcaacacagtggtcaacagagtgatcaacagggcagggcagtgagcactgagttgggtggggaggcacagcaggtctgagggaggtattcttactccagagggacagagagaagtttagatactggcagtcagcctcaaccctggctgcacattagaaatctctggggagctgttaaagctattaggttggtgcaagagtaattgcggtttttgccattaaaaatagtatgccagggctacatttgagagcaattaagcagaagcttcagtcagggagctcccaggtgaacctaatgttttatcaatgtggagagccacttctgtaaaggaaaacattgaataatagtgaaatcaagaattgtaaactatcttggaaagatctaggagttctggtatcactagtgagttcatcactgtggatggaactatgtgagaaaggagatataggaaaatatccattacaaggattctgttcatggatgagggtatggagaaaagaagggaaataagtgtaagtgttcgaaagggcgcatctcaattgcaggtgaactatcttgatgggaacccatgtattgtgtaactgtgaatgttaatagagaattatgtttaatgatgactattatgaataggaaactaaacagtagtgagatagagaagcatttcagaacatttatgttaacaaggccgggaggcagagctgaggaaaacagagtgaagagaaactttagccagcaatagtaaggaaagggaaaaagcataagagagaagacaggctgtcatgaattaatacagcagaagcatttgaactaactatatcagttgttctaataaatttgaaaaggctaaaattccctggaagaaaagagacgatccgtttggatttttgcacagctgttctgcagttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacgccctttgtctttatatctgtattatataaagctactctagatttcttatgcttatggtttgcctgggatagtttttccatcgatttcctttcaacttcctatgtctttgtttttataatatgttttttggagacagcatctgattgggttttgtgcatttttttttttttttttgagacagtctcacactgtctggagtgcggtggcatgatcatagctcactgcagccttgacttccctcccaggctaaaatgatgcccctgcctcagccacctgagtagctgggactacaggcatgcaccaccatcctcagctgatttttaaattttttatagagagagggtcctactagttgcccaggctggtctcaaactcctaggctgtagtgatcctccctctttggcctcccagagtgctgggattacaggcatgagccactgcacccggctggtcttgagcattttaattcatcttgataatctgttataaatcagagtatttagttcattaacaattaatcattgacataattgtgtttaggtttactatttctttattttttctattggcctccattttatttatttatttatttattttattttttatttttatttttagagacggagtgatctcggctcactgcaacctccgcctcccaagtacaagcgattctcctgcctcagtctcccaaatagctgggactacaggcgggtgccaccacactgggctgtttttgtatttttagtagagacgggggtttcaccacgttggccagactggtcttgaactcctgacctcaagtaatccacccgccttggcctcccaaagtgttgttgggattacaggcatgagccaccacgcccagccccatttcaatttttattatttaaaaatacaatttccattttatttttctccagagaatagtttttcttcagtcttctaaggcctcagctacttacatgggctttggtgggggtcgtggggcagcacccgcaggtctaagtaggggtggaggtgttcggtccttgcaagcttcacgagattgattcctcactactttgctttaatattataaactgcacaactcacacagtaatgtaacttcatatccagcttgggaagcacataggtgtcgaagaagcttgcttagaaatgtccctgactgctgtggcctccactttgtttcaaatgacaaatttcttaatggccttgttcttgggcacacatcaggtatagttcgtgcagcaaataggctacacgtggccatggccctttttggtatgacctttgttccttcttttatttgtcatcttggaggcacagactggagctggtctcccatttttattcctctgttgtatgcttttttgctttcttttgggctttatgaatgtgttttagacttcctttttaacttatctattgtatttttaactatgcctcttggcattatttggtagtggttgttctagtggctataatatgtatgtattttttaagttttttatttccataggtttttgggggacaggtggtatttggttacacaagttctttagcggtgatttgtgagattttggtgcacccatcacccaagcagtgtacactgcaccctatttgtcgtcttttatccttcacccccttcccaccctttccccctgagtccccaaagtccattgtgtcattcttatgtctttgcgtcctcatagtttagctcccacttttgagtgagaacatacgatgtttggttttccatttctgagttacttcacttagaataatagtctccaattccatccaagttgctgcgaatgccattaattcattcctttttatggctgagtagtttcccttggtgtgtgtgtgtgtgtgtgtgtgtatatatatatatatacacacacacacacacaccacattttctttatccacttgttgattgatgggcttttgggttggttccatattttggcaattgcgcattgtgctgccataaatgtgtgtgcaagtatcttttttgtataatgacttcttttcctctgggtagatacccagtagtgggatttctggatcaaatggtagttctacttttagttctttaagaaatatccatactgttttccatagtggctgtactagtttgcatttccaccagcagtgtagaagtgttccctgttcactgcatccacgccaacacctatattttttgattttttgattatggccattcttgcaggagtaaggtggtatcacattgtagttttggtttgcatttccctgatcattagtgatgttgagcatttttgcatatgtttcttggccatttgtatatcttcttttgagaattgtctattcatgtccttagcccactttttgatgggacgttttttcttgataatttatttgagttcattgtagattctggatattagtcctttgtcaggtacatagattgttaatattttctcccattctgtgggttgtctgtttactatgctgactgttccttttgccgtgcaaaagctctttagtttaattcagtcccagctatttatctttgtttttattgcatttgcttttgggttcttggtcatgaaatccttgcctaagtcaatgtctacaagggtttttctgatgttatcttctagaatttttatagtttcaggtcttagatttaagtccatgatccatcttgagttgatatttgtataaggtgagagatgaggatccagtcattctcctacatgtggcttgccaattatcccagcaccatttgttgaatagggtgtcctttccccactttatgtttttgtttgctttgtcaaagatcgttggctgtaagtatttggtattatttctgggttctctattctgtttcattggtctatgtgcctatttttataccagtaccatgctgttttggtgactatggccttatactatagtttgaaatcaggtaacatgatgcctccagatttgttctttttgtttagtcttgctttggctatgtgggctcttttatggttccatatgaactttaggattgttttttctagttctgtgaggaatgatggtggtattttgatgggaattgcattgaatttgtagattgcatttggccgtgtggtcattttcataatattgattctacccattcatgagcatgggatgtatttccatttgtttgtgtcgtctatgatttctttcagcagttttgtaattttccttgtagaggtctttcacctccttggttaggtatattcctaagtattttatttttttgcagctattgtaaaagtagttgagatcttgatttgattctcacttggtcactgttggtgtataggagagctactgatttgtgtacattaatttcatatctggaaactttgctgaattcttttattagttctaagagctttttggaggagtctttggggttttctaggtgtataatatatattcttaacatctcacagtctacttagacttaatgttataacactttcatgtaatatgtagaaacattgccatcatatgcatccattgactgtttcccatcctttatgctatacgatcatgtgtatcacatttccatataccattaactctactatgtaatattcccattgaacagtcttcttcctcttcttcttcttcttcttcttttttttttttaagtaggaggtaatcttttgtgcttacccagacttttaaatttctgatgccttatgaagagtgaagtttccatctggtgtcattttctttcagcccaaagaacttcctttagtcctttagcattgtttcatagtgaaggtctgctggcaataagttctttacttttcttttatctgaagtgtctttactttgctttcattcttgagggatatttcaccggatataagattcttagttgacaggtttttttcctttcaacaccttggatgtgtttttttcccttctgtcttctgatctccatagtttctgatgagacatgatcttgtttcctgtagatagtgtatgatttttctctgggtgcttttaagattttcattttatctttggtctgcagccatttgattatgatatgcctacctatgtttttttttgtgtacttattattattggggttttctgagagtcttgaatctatatcatttaccaaatttagaaaattttcaaccattatattttcaaatattatttctgctccatttgttttcatttccccttctggcactctaattacatatatgttaaatcttttgttattattccacatttccctaaggcttaaaattttttcagtcttgtttttctttgatcttcatattggataatttctattgatttattttaagttcacttatttttgtatttgtcattttcattctgcatccagtctagtaatttttttatttcatatattgtatttttcaattctgaaatgttacacttgtttgatttttttaatttctatttttctattgagaatcagttgtttcgttcattgcaagcatgtttgcctttacatctttgagaatagttttaatagctgctttaaaatccttgtctgcaaattccagcatccaggtcttttctgtgttggtcttcattggttgtttttttctcttgagaatgagtaacattttcctggttccttgtatgttaagtattttggatggtatcttgaacatagtgagtcttgtgttgtggagattctgtattttgttacattcttctgaaaaacattgactattgtgtttgtttcagcaggcatttactttgttggacccaaacagcaaactctatgtttctagtagcagctatcctattacttaggatactttcagttgtaccaagatcaatctcagttatgaatcagagggtaaaagtctctttttttttttttttgagtaaagatcttgctctgtcacccaggtgggagtgcagtggcataatcatggcccactgcagcttcagactcctgggctcaagcagtcctcttgtcttagcctcccaagtaactggtactatgggcatacatcaccatgccttgctaataaaaaaatttttttttgtagaggaaggatcttgctatgttgcccaggctagtcttgaacccttggcctcaagtgatcctcccatctaggcctccagagtgttgggattacagatgtaagccatcatgctccttctgaaaagtctaaataaaatattagcgaaatatattcagaagtgaattaaagataattcaccatcatcaaacaatttattcagttgccataattcattacatgaactgattaatggagaaaaaccatatgattgcacctataaatgccaagaagatattcgatataatttatcagatatttctagttaagaatggattaaaatataagtagaaagaaacaaaacataaaatacatttatcagaaggtaattataagtatcataatgaaccatgcaatactgaagcatttctattaaaattagaagcaagataggcatgcctgtcatcaccatattattaaacattgttttaggagccgtagttattgtaataatgtaataatgtgtaataagtcttatgtatataagacatggataaaatttaaaattatctttatttggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggtgcggtggtgggcacctgtagtcccagctacttgggaggctgaggcaggagaatggcgtgaacccaggaagcggagcttgcagtgagccgagattgcgccaccgcagtccgcagtccggcctgggcgacagagcgagactccgtctcaaaaaaaaaaaaaaaaaaaattatctttatttgcatatgatataattgcatgcctaaaaatctttaaaattccagtgaaatgcattagaattgataagatggtttcttaagtttctagatgaaagaaaaatatacaaaaatttgtaggttttgtttacatcaataattataagtagtaagttaaaatgtaagaaggaaaagtatcccattcatggtagtgataaaaatctgtaaaatgtttaggaataaatttatcaagaaacatacagggcctctgtgaagaacatagtttaattttattctgaaggacactaacaaatactgaagaaataaacctgcagtgttcctggatggaatgatttaacaataaggaatgaaaattttctaaattaataaatgtttagtgctatttcaatcaaaattctattttttaatttttggaactaagaaacattatcttaaaatgtatttggaataataattgtctgagaggagccaagaaaattttgaaaaatactttgtgtaacaacttgactttccaaatattaaaatatgtcctctaagctacagtgataaaagcagtatattggtcttggaactaatacatgtatttatatgtatatctgagaatatatttatatttatatgtttatataaaatattttaatttttattttcattgtatcagtatttatatataggatagtgtagaaacatcaatttatatatattatagtaaatgacaaatatataatctgaatgtaatgggaaatgatgatttatatataatatagacataatttgccatctgtctggaagaaaacaaatgtagacgtcgactttacattatatgctaaattaaattccagatggattaaagctctagatattaataacaatataaagtaatagaagcatattttagagaataaaagttagataaatttgcccataaaaagactaaaaactaaaaaaaatacaacaaaatctgtaaaaactgtagactggaggaaaacatttgtaacatgacaaaggactaaaatttttaatatagaaagatactctaaaaatttatagtaaagcacaaacaactcaagtaaaaatgagcaatgcattcactgcaatgtctacaaaaaagaaaaaaatcaaataaaatgggcaaaacatatcaagacaattatttgaagaggaaatagaaatagctaaaaatttataaaaaatatgcccttatttccaataatgataaatgtataagtgaaaccaaaaatgaaattctattttcttctcaacatattggtaaacattagaaataacaatcatcttcactggttatgaggataaaggagaaggagacattcatatatcgctgtggggatatgaattgctgccacctttttgaaaactaataagaatagcctcaccattttattcagtttagtacagtgttatttgtggtggaagaaacatataaacatttggaacacccattgactgggaaatgtttgaataaattatcgtatatttaatatgaagcagatgttaaaaagaatgattcaataggatcaatcatatgaattgacctggacaaatgtccatggtacattgagctaaaaatgaagttgtgcatactgtgttcccatttctgtttcaaaaccacaaaaataaaagaaaaatgacaatcaattcccccttaaaatagcttttatgtattaggatgcagaggtaccgtatcacatttttaatactgattatcacaggagggtgggattggagggtgtgtgtgtgtggcttaatttgctcccatgagcttgcagagcctctgtaataaaaataacctgatattttaaaaggctgggacccattttgtaagttaaaagagcatcagggaggaggtgtagacctagtccttcccctaactcacaatgtgacattttctgcctttattttcctgtctctgaagtgtgggtggtaatgactgccctacctacttagtgaagattaaggatgaagagaaatatagtttgaatagttaagacattgaaatgcaagctattatccttaagaaaattctcaaacactctcactttacataatgcgggtgacaaaatcacccaaggaagcatcgtcccttcccaatggtgatgtagtgggagaggcactgagcaccacagaggtaaacactggtgtctcgagccatcgtccccatgcccgtttcctcaaaatgtctacttggtcctaatctctctctctctctatccatccacctgtccatctatcatctatctattatctattcatctgtctaatcaatcatctatcatctgtatctatccatctgtattagtctattttcatactgcaataaagaactgcccaagactgggtaatttataaaggaaagaggtttaattgactcacagttcagcatggctggggaagcctcaggaaacttagtcatggtggaaggtgaaggggaagcaaggcaccttcttcacaaggcagcaggaaggagaagtgctgaacgaagagggaagaaccccttataaaaccattagatctcgtgagaactcactcaccatcatgaggacagcatggaggaaaccaccccatgattcagttacctccatctggtctctctcttgacatgtggggattattgacattatggggattataattcaagatgagatttgagtggggacacaaagcctaaccatattatcatccatccatccacctatctatcatctgtctatctgtctatctatctatgtctgtctgcctgcctacccatctgtttgcccatccatccattcctccgtctgtctgtctgtctctgaacattatccatccatccatctatccatccatccatctctccatccatccatgcatccatccatttatccatctatgtatgtttacctgtctactttatctttctaccttatctatcttcttaatttttaatctctaaaattataagcctccctccatacaagcaatagaaaacactgtgtaaagatagaattcttctcctcatcagcctgaagtgggtgaactgaaactcctcacttaggcagtttgttaccctgcaatgcacataggttggatctttgacttatcccagtcggcattttggagtttggagatcctatgctctagtcgctaagtgacctaatgagtgggcagtctatgtttgcttcatttatatactgtgtgtctaaataagaaagccacagcatatgtggcctgtttttttttttcttttttctgtttttgagctcatatcctgggtttcctttatgaccagggatcagagaaggctgaagaaggtggagaaactgaggcacaaaaagagggcagtgaagatgtgggcaacctccctgaagcccaggagaagaatgtgagttttcgctttttcacagcagtttgactggattctctgctgttcgagacttttacagggcttgtacaacttgactctgggcacaagcagtcagaaagagggcaaggagctgagagtttagccagggaggaagcaagtaatttctactgatgtgttaagcactggaatcctggtgcagagagggctaaagggaagacaaaggagcctgaacccagaccaggagggagccggctggacaaggcttggagaatttgttgtggtggtgttatggctaggttaggtgtatgctctttataaacaagggacctttctgcttgatcatgattaatgacagactcctagcttacacccacccaggagccctgcccagtggggaaatagagctaagggagtgcagtatatctggcggaagacaagaggaacttgaggataaaaaggactccttggggagggaaattgacactcagttaatttaagttcaatcagggaaatagcagatcttggtgaagtcacatgattaattctaaaggggttcccatgcaggagcagcagggtaaggagtgggcaatgttgggggacactgtggttctgtgagtgccaagctgacataataggggatgggatgggccacttcttcaaggagttctgaaaatgtgctgggaaaccaggcgccaaggaaggagcctggtggggctgggaatggggtgcaggcattgttctgggcctccttagaggagaatgttagagggcttctccactgggtcagttgtagcaaagactatttttcaaaccctgatggtttgctaatttatttattctgggagaggtgtgggagcttttatgagagctggatcctcattcaccagatagaatgtggctagaaaggggctgagacccacacccacgctatggaaaaaggggtgtggggctgggcatccatttgtctttacctcaaagaacttaaattgggaggggctagggaaggaaattccctgatatttagacttatatttgaagtagactgctatttcaaaatgttgatattacaactctgaagtttttgttttaaagaaagacaaaatcttcaatcttgacctagaagttagacggtgtttcatggcagcctgtataattcagaaacaatactttaaaaattaaatatagtgaccatttcattatcttgtaattaaaacataatctgtttcacaatttgaactttgcatgagttgcctaatgcacccttacagtcatattgatgaatactttgaagttgagtttgcttcttttaagacatagagacaaagatgaaaagcattacaccccagcccctttctcccgtgagaccagcaggaaggtagcatatttataatcagatcctgcctcctatagccagggtgggctttgcttcagcttctcagccactgggctgggttagttctgtgaagtgatgaatcacccagcttggacgttctctttgctactacattttaaaattgtgagcctttgacaaagtcaattataatcttgtgaatcctggtaggaattaaaaaaaccattttttgttatttttgtgtgggctatggtgaagaaatgaccgtaagtgaaaaatatttttattttatatgaatatattactaacatcatattatcaaatttacttttcaactctttaatgccatttatcctacagaaagacagattctgacttcttcctgtttgaaaaccaacacatgctctttgatttactttaattcaattaaattagaaaaaccctctgtgattgtcagtaaacagatgaaaaatgttgtaaaaacatgattaacccttatgagtgtatatgaaaataggctgaattttaaaatttaagaaggagacaaacaccacttagatatttagaatgcttgcattttgtgcttcaagaacctactggcttgttttgacggtctctggtttgttgttaaaagctgagatggggccgggcgcatggctcacgcctataatccctgtactttggaaggcagaggtgggcagatcacttgaggtcaagagtttgagatcagtctggccaacatggtaaaaccccgtctctactaaaaatacaaaaattagctggctgtgatggcgcacgcctgtaatcccagctatttgggaagctgaggtgggaggatcgcttgaacccgggaggcagagtttgcagtgagctgagatcgtgccactgcactccagtctgggcaatagagtaagaccatctcaaaaaaaaattgctgaaatgggaggacattgtgggctatttgtaaaggcatctctcctcccagggcaccccaggcatagacaggctgacagggaatcagaaagacaagggagagctctgtgtgttttgaacattgattttgaaagtatgagacacatcctagtagtttcatgtaggtatgacacctcagataaatccaaggctttcaaactcctggctccgttgaaaccatcttgaggctatttctttttgctcctcttggcttgctgtggttaaaacagaggtgctcccctgggcttccctcattaaccaacacgctgcggtggatataaagtttagaatattcgtgggcccacatttggttcctaagactcctgggcaaggaatgtcagcttcctttattgctttaaattccctctatctgctccatgtgcccacctcatggctggcaggagcttccagctgggtggggtgttttgaagaccctgtcctcctgagggtctcacagccatcctggggtcgttagtggtgactgggcagggattgggtgctggttgtctgtggtggtgtttctgctgtctgtcccttggcatgggccagaccctctgttctggctggacacagactggcctttcacagtggctggccttctgaccgcggacgctgctgcctgtacagagtgccttgtgttacttaaatgccccagcggtccctggctctgtttctgtgtatgagcagggcctgggcagtacccctcctggaaaatccttctttcctccccagtctggccacctccgtcttgccaattccaagctctttttttttttttcctcagggaccgcctagctttatcaccccattagcctaaggttttgaaaaccaaggtctatactttcttccttaggggtggaaagccagaacaaataggtcgcctgtgggaagagaaaataactcttactctgacccctctaccccctcagctttgtgtagcagaaagaacaagtcacaattcatatcctggccttcagccacacttattatgagaaggaataaaaacagttttaaacattttattctgaaataactatagactcacaggaagtttcaaaaataagagtcttgtgtgcccttcacccaacttccccaaatggtgacatctcatctagccttaatgaaaccagaaatgcaatgcattggtgcatttctgttaactagatgacaaaccatatcaagtttttaccttttttttaaaaaaacctgccttcatttgtgtgttaaaaacaattgtcatgtgtgcagtaaaaacacaaaacgagcaaaaaacctctctccagcacctggcaatgttcagttgagtgataaaccaggtaaatgcctaagtcagggacaggcttatctgatctctgctatgaaacatgcatactcaatgcacacttgtaggcactcatacaattccatttaatggagaggaatatttacctaatgtttgacattgattaaaaaaatcaacagaaatggaaacaaaaactattatcttctttaatgatatggacttcccctgaccacctcctcaacttccagggttcttaaagacaagatgccaagatgtaaattctgtccttgataaaggattgaggcaggaggacttgggaggtcaggagggtgaacaccgaaaagaccatgacttcatgcctaggaagatcttacctgtaactttagaaaataggggacctcatggggcctggcctgataacccaggggagggtgaggggctaaggaaccggcgcctcaggagtaaaggaggaaaacagaaagtcagctcagcttctgggcattctctaagaaatgaactgcagactgggacatcatgagagctttagaaaatgctggaaacattgcaccttgtgcaggtttggtttgtgttttttgatcaaggtacaattatttaaaattgtatgctttgtgaacccagtcatcctatctgaaagtcatgaggcccttgcttgacagataacatgattatggtctgtaaccacccctctctggcttcctccaatagcagtcttgagaaaagtttcaaggggcaaacattgatgtaggtttgtgggaggagtcatgggtctcagcctgggtccctggagtgcctgcagctcgagaggactctgcctctgtcctctcatctctagccgctctgaggctggctgcccttgcaggtcacgctgggctagtccttcactatctcccacacctgccacctgttcccagtgaacgctgcctggcactcaccaccacggacacctgtccttagttctggccacgcaccacctctgcagtctgcttttctggccaagtttccaacaaaaatagctgctgtggaaggttctaagacttcccacttctgaggtttctctcttctggctttctctgaaaaacaaggtgaaattactttaaggtgtatgcttcctcaaatggtgattatgtgagatcttggcttaattgactggatgattataattatcttaaaaaaatgcttttgtgcctataattacttgccagccgtgaaagtcaattcaagcattttacatagataacttttaaggatctgcctaattccagtattttataattctatgaaccaaggttggaagcttaattattattatttttatttatttatttttagagacagagtctcattctgtcacccaggctggagtgcattggcataatcatagtgggctcgagtgattcttccacgtcagcctcccgagtagctgggactataggcacaggccaccacacccagctaatttttacattttttgtagagatggggtcttgctctgttgaccaggctggcctcaaactcctggcctcaagtgatcctccctcctcagcctcctaaagtgttgggtttacaggcatgtgccaccacgcccagccattatttttaaaactaatatatcccacctcattctatgggggatttgaagctgagctggagtagcattacacaaatgcagtcattcaacattttatgggcagattgagtgctgccacttgccaggcaggactccagggactgtggagggagcagtgaaaatgacagagtcactgcccccacagagcttatgttctggggaagcttgtggtggtaatacccaaagttcttccaagcttacttatcctttcgaggctaagtatttttatgcattctctgagcaatcacttcccctgagcaatcactttccctgctaaacatatcttttaagaaattaaggtcaattcagatattgataaagagtgctaggagccagatgcggtgtctcacacctgtattcccagcacttcgggaggctgaagcgggtgaatcacctgaaggtcaggagtttgaaaccagcgtggccaacatggtgaaaccccatctctactaaaaatacaaaaaattagctgggtgtggtagcgggtgcctgtaatcccagctccttgggagcctgaggcaggagaatagcttgaacccaggaggcagaggttgcagtgagctgagattgcgccattgcactccagtctgggcaacgagagcaaaacttcgtctcaaaaaaaaagagtgctaggttcctccatagttgttgctagctaactataaaagttgagacttacattcctataagacttcctactgccccccaggctagctctacggttgacagtatctggttaattcatttgtttcaactgaatataactaataaaaataattggattcagaagaatgtaaaactctacataaccaataattctatggtacatataatgaattttattctgatcctatgtgaagaagaagaaaatcaaagttctttgagatccaaagagttactaacagatttcatgtgttcttctatccaatcactaacacctatttatcgagcttgcctgttggttccagaaagtggcctggaggggccagacagttcccagagatccaaaaatgaataagacacaggttatgcccccaaacacacagactagtgagggagacagataagtaaatgatgattatgggagcaagtgagaaggtccttaactcaaccttatgggttaggaaagtctccttggaaatgttttgagcatatcctggaaggtgtggccaatgtgagaaaattgcatgtgactcagaatggctgaagtagagtggtgagggatgaggccagaggggtacacagagccagatggccttttcactgttctaaggaggtgtattagtctgttctcacgctgctaataaagaaatacccaagactgggtaatttataaaggaaagaggtttaatggactcaccgttccacatggcgggggaggcctcacaatcatggcagaaggcgaaggaggagcaaagccatgtcttacatggtggcaaacaagagggcttgtgcaggggaactcccatttacaaaaccatgagatcttgtgagacttactaccacaagaacagtatgggggaacccgcccccctgattcagttacctccacctggccccacccttgacacgtggtgatgattgcaagtcaaggtgagatttgggtgggtacacagccaaaccatatcaggaggatagagtatcttgaggagatggaagtttctaaagatgagggtagtacagtaaggttgggtgctttttggaacgatctctctggctgcagtctggagcacagattggagatgagaaagaaaagaggaggtgataatcactctttaggagcttccttcagcaacccagtgagcaaagatggtggtcatggcagaggaggggcgagacatgggcaggattaggcaggattaaagaggcacgatcaacacgtcgctgtgaaagcaacccctggattttgcaacaagtgccagactcttctcctgcacattatttgagcaccaaaacttggggtgtcaccagtggcatttaacgtaaaggttagtttgaagattcccagtgctgaaaaagtcctcttggcctgattcagacctggctggcactgtcaggctttcaagttcagtgcccgtctcagaaataggaaggtattgttctggaaatggctaaaaacatgaagttgggccaggagatgtgggagtgtgttggatgctgtataacttgccttctgtgatatttatttatttatttattttagatggagttttgctcttgttgctcaggctggagtgcagtggcgcaatcttgactcaccgcaacctccgcctcctgggttcaagcgattctcctgcctcagcctcccaagtagctgggattacaggcatgcgccaccatgcccagctaattttatatttttaatagagacggggtttttccatgttggtcaggctggtctcaaactcctgatctcaggtgatctgcccgccttggcctcccaaagtgctgggattacaggcatgagccactgtgcctggcctaccttctgtgatttttaaaattttactttatagacaaggtcttattttgtcacccacgctggagtgcagtggcatgatcatagctcacagcagcctcaaactcctgggctcaagtgatcctcccgcctctgcctctggatgcctggctaatttttaacatgtttcatagagatgggggcgtcttgctatgttgcccaggctggtcttgaactcctggcctcaagtgatccttccatctcagccttccaaagagctgggattacaggcatgagctgttgtactctgccaccttctgtgattttgatttttccattattaatcttgagaggctgcctggtagtgtaacaaagacacttaattaggaatcagtagacttgcagtgagtcctgattgtgttgactccttgtcctgtgacctttgactttggcaaatgacttccctctgtggcctcagtgtcctcatctgtataaacatggtgctgggtagagaatgtatatgactgcaagatcacattcagtgccccccgtccatgattccctgagctcactgcctgaattgtaaggcattaggaatttttagggactgctctcaagaaccacatctctctctttaatgaaagcaattgtggcactctggcttcagggaggtttatcggaccattctgggaagggatggaaaagcttttgttttcttcttagaggcatttttaggagctgtaacctggttattttgctttgatctgggggaaatagaaattccagtgggctggtggcttgcacagtagagacctatttgagccttgggtgaccccacccactcttaccttgcaaatttctttctttacccagaaatcagtatttaaaatactttgtgattcagaaatgttatcattttgttctcatagaggaaaagtttttgacctacttttattaacttgttcaaacctgaagtaaagacatagttataagggcataaagtcagaaaagacatttttgttcaaatttttacattgcttgcatatggtctgaatttcgctagatagcactatcaatctttggtatgctttagaaatagaattgaatgtattactaagcagtattaataattacattttctcaggagttcaagtgatgggaaacggtctttaatctcacagttattttaagagcttgaaatataatgtatgaaagaagtagggatcacccagctatcatatctttgctatttacttattttatggataaactaatgtgttgttcattttgattagcttgtattttattatagtttgcttgattttcagatttgactttaaacgtacttgaattatgtttttttctttaattttgatttatggatgtaaggaagaagaaggagagacagccacagaagaggtacggtcgaccatctttaacagctgtgcttaatctgcttaataaaaacatcttttaggtgggaggattgcagcttgaggcacgttcttaataacataagagagcgatgcaacccacacacccagaaaatcctcctttaacatgctgagaaggaaagtaagttggagataagtttgtccgagggaggtggagagagaaacggggcttggctgtggactctgttcggagccccctcaggtgaaggtgtcttccgtggtttctcactgacatcaggccaggccaggccagggcactggctggagatgcctgctcctcgtccttttccaccctgttgaatgcactgggtttaggcatcctgcatggtggttagtggtgttttcattgagggagggattccacctatgtttatgtttttgaacatctttgaattaatcacttttattgtttttttttttttttttttttgagacagggtctcactctcttgcccaggctggagtgcagtggtgtgatctcagctcactgcaacctccgcttcctgggttcaagcgattctcctgcctcagccttctgagtagctggaattacaggcacgtgtcaccacacctggctaatttttgtatttttagtagagatgggatttcaccatgttggccaggctggtcttgaactcctgaccccaagtgatccacccacctcggcctcccaaagtgctgggattacaggtgtgagccactgcactgggcctggattaatcactttaaaatgctagagaactaacttaaaattatgaacacaagggtagggagaataatttactaagttacgtgtattgtctagatgtttcagcacaaggtcatcaacattaaaaagggtcccaaatgtcaaaagaaatccccccaaagaaacttttgttaacttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagcctttgttaacttttgaaatgacaaaattcatgatctttatagaaaatttaaaaaatgcagatagaagaggaaaatgaacatagcttttaaccctcgttacccagagataaccactgtagctacatacacacacacacacacacacacacactgtagctacacacacacacacacacacacactgtagctacacacacacacacacacacacacactgtagctacacacacacacacacaccccatcaatttctggtgaatactcttgtagtctccttttttttcatggaatgtgtctatatttggggaggtagtcagtacagatctgcttcatcattttaaatgttaatatatcaaaccaacccctcttcttagacctatagattatttctagtatattctacaccatgatttctcaatatttacgtctttccaataattatttcttttgtttctctcttgctaggccagcttcaaaatagaattttaaaaataagataaaaacatattgttaatttggaagaaattccagattatatatataggttgctgataacttttgcttcaagaaattagcttgttacaagaaaatgtaaccaacttgtgcatttaacagctcatcctgacaaaattcaatttgctgattctttttgtatttgattcttctaactatatatatatatatatatatatatatatatatatatactttctgaatttgtaaaggttatttgctgagaatggtttgttaatatgagtggagactgtacacttaggtgggattataaaacctgttaggattaacatatcattctaaagcaccattctaaattgaggactctgtgtttagaaggatgattttttttatgtgtgtgtatgtatgtgtggtatgtgtggtgtgttgtatgtgtggtgtatgtgtatttgtgtgtggtgtatatggtgtgtggtgtgtttggtgtgtgtgtgtgtgatgtgtgttatggtgtgtatgttatggtgtggagggtatgtatgtgtatgtgtgatgtgtatgtgtatattgtgtgtgtatttgtggtatatgtgatgtggtgtgtggggtgtgtggtctggtgtgtgtgtgtgctatgtggtgtttggtatttgtgtgtggtgtgtatgtggtgtgtgtgcgtggatgtgtgtctgggtggtgtgtgggggggtgtgtgtgctgtgtgtcatgtgtgtttccgtggtgtgtgtgtgtttgggcggtatgtgtgtggggtgtgtgtgtggcatgtgtttgtgtggcatgtgtggtgtgtgtatttgtgtgttgtgtgtgtttgtttgtgtgttgtgtggtggggtgtgggaggctttgacctctagtccagcattttacagtctttttctcactgtatccttggcccttatgcttcttaatactaatgtaagttttgttaaaataagacggaagaaatagccatggagggtgcggaaggggaagccgaggaggaggaagaaactgcagaaggagaagagcctggagaagacgaagattcctaggccttttcatgcttcatttcttccacttctccaggtagctacaggattctggggtggaaaagctgctagttaccgtactgtatgctatctgcggcacattttgcttagtaacaggagaaagggaattccaattcagggctgtctgtctccttccaaagccctggtctgcacacctttctggcggggtccagctcctttctagagctgcggggctgctgacctttcgtgggtctgtttcttgcacactagggcacagaaggctatggttgatgggatttctaggaaaaagtgcacctttgatgcagggaagagttttgttttgcatttacttcctcctcttcctctatataaactttgtttgagagaagatacagcaagtgtccttttatcagcattctgtaacctcaactcctccaccaaccacatgtacaactttaggggggtgactactgatgttcagaatgatggcaataaattataaccttaaaaaatcacaaagctggtgttgagtcatgaaagaaaattattgctgccacgggtttagtcgtcagtgcttggtactccatttccgtttctattaaccagaacgctcctctggaaacaccggggaacatggtgaagtccctttaggtatctttgacaagtaagctcttgctgccttctggttttaaacttcccttgatgatggaaaataattatgtaattcttactagtttgataagtgccacatattagtgaacatttattaagtgttaataagacaatagaatctgataatggatcttgaggacatgggcgaatgcttaaatattgtgagccatacagataggacagcatgcgtgaaaacccctaaagacatgaagtgcattagccgggtggggtggctcatgcctgcggtcccagctacttgggaggctgaagcctgaaaatcacttgaacccgggaggcagaggttgcagtgagccaagattgcaccactgcactccagcctgggtgacagagcaagactctgtctccaaaacaaaaacaaaaacaaaaaacaaaacaaaacaaaacagaagacattaagtgctataaaaatatctgttttttcctgatatttggcaaatacctaggtacatgttgtattattattaatatgattggctttgcaactgaatttgaggccatagtttattctctagggcaacattgctcatggttttgctctggagctataagcgttttttaaaaaatttaaaaaagtttagtctttttatctcccatattatgcctccactgaaaattaagacggctttttgggctgttactctcaggagataatgatggaatatgcactcattattctctaaatgagagacacttatcaaaccagtaagaattacataattattttccatcgtcagtagaagtttaaaattacaaggcagcaaaagctgacttgtcaaagatacctaaagtgacttcaccatgttccccaggcaggtctctagttaagaattggtgcatgtacaaagaagggtggatagaagggtttatttggagaaggaagaagaaatctttggtgctctttaaaaattggctgacaaatagcaatgctctttgcaccaaagtccaatttgaatagtagggatgtcccttcttaatagacttacaaaaaaaagctgatataaaaagcacttaatctatttttagagcatcttggagctagtgagggtggccatcacactttgttattggaccataaaggttttgtcattcatttgcttgaatgagaaagtgattctagcccacgatttgatgtctctccagggtgtttctttcatgctctggacccacagacttctactttaaagccctctgcttgccacttggttacaattccatttctaaggagtgggttgggactcatttttgaaaaaaaggaaactggcaagcttaagatattctacctgaagaatggtagaaaatgaaaatatgattatatttatcctcataccagaaacaaaacaaagcaaaacccacagtaacagactcattggtcctgtttaaatccatgtctgttcactcagcttggaaagttctttaaaaattgtgcagttttaatgtgataattataaagaaatattggatgtgaaatggcacagccgagagagaatctttaatgtagacagatggcttctttataggccatttccaaaaaagaaagaaaaaaaggcaagttacagttgtggctagcacattctgcctgtttctctgatgggttctagtttggaatccagtccctaatagtctgttgtgaggtcaaaatgtctgacagtgaaggagtaaaccaggcagcaccctaaatcccagccactgactcccgaagagagtcaataacctttaaaatgcgacatgatgatgcagtcaggtattctgcaaactatttggcttccaaaaacaaacccatctcataactcatagattatccatgcattttatttgaaaagacgattttagacagaacaaggcaatgaatggaactatgaaagaattctcatttcccatagttgaagttggagtcagaatctattattattattatttatttatttattttattttttgagacagggtctcactctgtcacccaggctggagtgcagtggtgaggtcatggctcactttgacctccctggtctcaggtgatcctcccacctcagcttcttgagtcgctgggattacaggcacgcactactatgcctggctaattttcgtattttttgtagagatggggtttcaccatgttgcctaggctggtctcgaactcttaggctcaagtgctctgcccaccttggcctcccaaagtgttggaattacaggcatgaaccaccacgtctgacctagaatctaaattgatgtttgagtcccagggcaaataatgtccaatatgagactggattctacctccccaaagcttgccacttaataccttcttctggtgtagccatgaaccatttagagctccgcctctgggaccaagctgtcaattcagcctattttccatgaaaacacagtgggaaattataattggagatgttgtcttccttatggtgtttgatatgtgtttatgcagagaaaggatataaatctagcttagttttccatgagacaaattccctttcctttcagtggggagcaaatgatgactagtggtttatagaataaaaggcaacactttcctttattgtatgttaagtgatgaagattgtggtaaacattctgtgtctttctctacagtctttccctaatatttgccttttcttttagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaatatcttgtcccaaggagcatcatttcattatttatagtctctgcttgcatatgcctgaactccgtctgtctgttgccaagtctaaatcttcagcagcacttttctgtctgcgttgggatcgatgtcttttattgcactgattatttggtccatgttttcaattgcattgattgtctcattacgtcgtatttttttttttattacacacacgttgtgcgtatcatctttgaagccttatctaactgtaactttatcatccacttgtgtggggatgatggtaaggagggatgatggtaaggacagaaatctgcaacccagtgcccttcacacgtttctgagctgaagggagtggctgcttctgtttctcctgctgttgattgatttgtagccatggctgtggagacgggtcctgtaatttttcttcctgatggccaggagtgtgtgttcacctacagctgatccagctccaatgacttgtacaccaggtaagtttgatagcatttctctgctcacctgcctgcctcagtttactgtagatattttttcttccttgtaagattttgatattccccctgctacctccctgcctatgtgtgattccttgtgtttttgcagcaaatgttgctcctgtattgtcagaggggctcatctccttgctgtgctcttttcctatttcatgttaattatggcaattcaacttggagtggcataaactttcccctctggagtctgcctcctaattttgcagcagagtctgttggtgttatttcagagtgtattctgcagttgcagaagtctcgtggctgtcatgaactctgggaaacggctcttttcttgttaccctagtaacaaaaaaaggcattttgaatagaattaggttattttgtttccaatcattgaagtagtctgtgttaaaaacatttctccctttgcttaaggtaaaagaccacagtaaaatggaaattcatataattgaaaattaatttctacttttaatttcattgcactaaattatgtcctatctaaaaagcttgcataatttttacaacaaccccctacacaaataggccttaactttcttcttcttgctcagggctgacttttctctctttcatggcagagtaggatggagatagatttagttaggtgccaattttcctcctatttctctctctctctctctcttttttttttttgaaacagagtcttgctctatcgcccaggctggagttcagtggcaggatctcagctcactgcaacctccgcctcccaggttcaagcaattctcctgcctcagcctcctgagtagctgtgattacaggcacgtgccactacgcccagctaatttttgtatttttagtagagacagggtttcaccatattggccaggctggtctggaactcctgtcctcaagagatctgcccaccttgctatttctcatattttaaaaagaaaataaatatctatgctgacaataagcaaagataaaaacccagaccacttatttaaattgaattaattttttcttatattgttttcctgtagtcagaaacattaacatcttagaagggtatttgtatttgctcctgtttcattttatttaaagtatcactgaaatgcaaaaatcacttagatcaatagtaccctatggatggtatcagttctcttctagttttggcttcagctgtcccttcagccttccatggttagcaatccagtggcacagtgaggagaatcccagatatggactgtatggtatcaaaatacgattaaaaaatctgaatgcttttcaatataggaagcttctagaaactaagcagcattgtgaatctgtaaaaaagaataactcacaaggaaaccccaagtgaataaggaaaatcattttgaagaaaaaccaaaagagaccagagaaatggaataattgcatgatgatctgaagtgaatcgaagttcaaagagcttggtttaatagtataaaggaggcctgaacacgcaaaggaactgttt

SEQ ID NO: 16940 - DNA, 10745 bp, Human
ggattgcttgaatccagttctgggctatagtgtgttatgctgatcaggtcgttagcatcattatggtgactttccacggagcaaaagacccacaggtttgcctatgaaggggtcaggtcagaaacggagcaggtcaaaacccccatgctgatgagtagtggaatctactgccaaatagtttttcatttgagttctggctgctccatttgtttgtgttggcaacttaaaaaaaactaggccaaataaaacatctgtggaccatcagttgtcacctctggcctagcgcatcttcggttcttatgggagaaagttctttatgaggtaagtccaaaagcatagagttcgcttgcttaagaccttgcagtatccctcaatctttggataatgatcgaacttcatgacgggctgctcttctttttttctgcctcttttccctgatctttacgtccatttttcgtatctccatccctgccactttaaaggtcttggtgggctgccacactctagcaagtcagcatgccttgaaatatgctgaccccccctgccgatggcttcccctttctttactaggccaattgggtactttctctccccactaaattactagacccagtgcttgggatacaaacctggattctctctaccccagggacttcacggtgcctgccacagggcaggtgctcagtacatgcttgtgccacaaacttgggtactctctgatgttgaatttttttaaggtaatccatgcagataggaaagtgaaaaaaaattacacacgagaaaagggaaattttaccctcaatcttcccacttttccccagaggcaaccgctggtaccacttccttgtgtattcttcctgagatatatatggaatgtataaggatatatattcaatcaatgctatggagaaaaaaaaacagccctctgggggtccgcgagtgctggagacggtcgcgcacggctctcaggagctgcaatctgagagctgccctactctgggcccagaaacgaccctcgtgcacctgcagtcctccagggaaatctgaagaaagttccacagcttggatccccagcactttgggaggccgaggcgggaggatcgcttgagcccaggagtcggagaccatgctgtgcaacatagtgaaaccccctctctacaaaaaatacaaaagttagctgggcaaaatggtgccctgtggtcccagctactcgggaggccggagtgggaggttcgctggagccgaaggggtcgaggctgcaatgagccgtgatcgcaccactgcactccagcctggacgacacaacgagaccctgtctcaaataaaaggaaggaaggaaggaagttacacagaaaggccgcgtcggctctccttcccacgccctcctgcagcgcctgcgcaccagggcccgcttcacgcaggcctgcgaagctggagcccctggatagcctttcttgccgacagaggcgggagaaatttgctacttcctgtataccttatccttctcccttcccagtctaagatacgaactataaatgttcgaacccaattcaccccggaggggaggggccagataccagtggcctgaaggcgcccaggtatccagaagaattgtgggtggggacccgcggtcccgtgacgtgcgtccgccaatcagcgcgcagaccgcactttgcggctcggcttcaaactaccgtgaggccggagcgccactgggaccccgcccccttcgcctgggtctggggccccgcgagacggcggaaaggggtgggggcgcccggggggggggggggggcccccggaagggggcggggtccgggatcaattaagggcccgcctcacctattccgggcgcgggctgagtcccgtagccaatgggcgggggtggggggcggcccggccggcggggagggggagcccgcggccggggacgcggggggaggaggaggcgggctcccaatccggttccatccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtgagcggcggccgcggcccgcacacgccccctggagccgccgccggcgccccgccgggccccgcgaggcccaggccccgttgcacccacggtggcgacgggcccgggaggcgcttggagaccggcgggcgggcaggcgagcgctcggcggccgcgggggcgggcgttctggaacgtttggcggccgggggagctgagggggctattcgaacggggcggcgggaagccgtgacgtcacgcggccgggcattgttctcggggccgggcgggcccgcgagtcctgggactgcggcccgcctctattcgtgcgtctccgtctccgcaggtcagctccgccgaaggcgccgccaaggaagaggtgagtgcgggccttctgcggggggtggtgggtttcccgtgagccgctggcctgccttctcttctcgctgactctcctttttctttctccaagcccaagaggagatcggcgcggttgtcagctgtaagtaaagcgagccccgtaaccgttcgttttccgcgggtcgtcccgggtgaggacgctcagtgctgcttttgcctttcagaaacctcctgcaaaagtggaagcgaagccgaaaaaggcagcagcgaaggtaagcctcgaaacgcgcattgggatgcagcggggccttaggctacactgcttcttaatgcggggcttccattttgattagctattggagctttatttatactttaataattacggtaaataatttttctagtggtcgaggcaaaaatgtaatggatatattcatcctggtttatagaactatatcacactaatgctgctgcagatgttaggagacttaggacgacaaaaaatattaaatattaagtctacaaaggaaatttattctttgcgttgcgtacattgtggctggtgcttggcttttaattcgtgcttgtacttccttttttgacaataaaagagtcaagatagcaccgaggccaggagaaagggaacgtgtaagtttttatatatacagtttccaagccaacttcgggaagccttaacctttttacggggtgggggtggggaggtaaaaagttgtgatctctgagaaaataaccgccactactctggaagtgttcatcagcagttatacaaaaccgtgattttggctgctccctaacaaattcgtgattgcatgattcgaattgcaggtctgtagaatgaagttggctttgggtgtacgtgtgtttgataacttgcagggtggaaaagcagaacatgtgtaaaacaagtataagctttgtgtttggatatagcattgaaacctgtaaagctctacatgttcttcgcggggtgattaatttttatccaaaacttaggtgagagtttgctatttgaagtctcaaaaaaaatttttgttaatgccttcacctctttcctaaaagtgtaggtagaagtttagcactgcagtcatcagaagaggcaagattaatttccttgacattgaggagttgttggataattactaaatttgtccttgttaaataaaggtataaaacaaagatgttttttcttttttaatttaaattttttacagagctgagtgtaaaaatgttaactatgttttctttaacagaaagttctgtttttgtgatccttttaaaaataaagcttcacggaaggtatgagaatagtatttttcaactttaaatttctcattaccagaagaccatgtggtaattctctgtatacagttagaacagcacggaaacttgaaggcctaaaaaattagctgaccttgttaaaaatgttggcgtgagcagtatattattacctatctttttttattgtgtgtgtgtgtgtgtgtgtgttttaaactaattggctgaaatatctgcctgtttccctctttacatttttcttgtttctttccttatttatctttgtccatcttgagatctactgtaaagtgaattttttaatgaaaacagttccaagttttactctcagtgggtttgggacatcagatgtaattgagaggccaacaggtaagtcttcatgtcagtgtttgttgaggaacgagcctatgaggtcagttttcccaaaaggaaaaagggcagaagggatttgttcatttttacatctcgtttctgtaatacacctttgacttcatggttgatcagactttgaagtctaaacagaacgtaagcacttggtgtatcgattatcatactacacagtagacatgttttcaaggcatatcttgtcactgtgtgtgcttctgacttgtatctttccctagaactaaatattttgaaggtccaaacattatactttgggaaacttgattgatttttttttaatctagcttttcagctgataatggttacacgtggtattatttcaagtccaagatattatgtattctattttaactgtttcccagttttgtattttttgtattggaatgattatgaaattaatgagaaatctttagaaacagactacaaaagagtagttcttaaatacagaagtgattgtgaaactttgtgatagcaatgtgtgtagtagcagttttgtctcaaatacatttatcatttgttactcaaaggatgttgaagtattaaaagtcattatgctgtctgtggaatcctactattagtacagaacaccctgcagtgatttttccgcccatgttagcattgaagttgtgagctctacttgcttgtctttatggccctttaattcaagtaattggtcagtatccgtatgggtcttttataccacccgctgggggctaaactaatttagctgctgctgtatacttactaacaaggaataaatgttaagctttcttctcagtattgatggatggtatctaaaagtatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggtgattggtcttaatgtgagggttaaggtcttgtgaggacagtattgttgaagttcacaacaaatttggggatgggtgggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacgttgttttcctgattactgggggggaccttaagttgtctcatgtaataggtgtatcaactgatgtgtgatagacattaatatgacagctgttatggatacagtctatacaaaatgagatcctttcataagcttgaagattggggtttcacgctcatgtgtgagatgtccctctctcaaaccttactatgaagtcagcaccactgggcacattacttgtctgacatgaaggggaaaaagtaaaacaaaatgtaaataaggagtaaagcatgtacttaaaatatattcttattctatcataggataaatcttcagacaaaaaagtgcaaacaaaagggaaaaggggagcaaagggaaaacaggccgaagtggctaaccaagaaactaaagaagacttacctgcggaaaacggggaaacgaagactgaggaggtcagaagtgtgtgtgtgtgtgtgtgtgtgtgtgtgattgctttgactctgaacagtagatactaaattgtacattttttgtagcagataacagtattcattataatattgaacaaagttttgtacggtatcccaaagtgattggacaaatggttttctatgatttatgttattggaaagtaaatatgtaaatggcttatttaagagcaagaaattttaatatgctcaatttcagatataattcaatctttgttttgtttttatattctggatgttgcttttaaatatatttttgaaaatttattccccttacttgcatttttcctggcatttttttcccactttcatttctaatgaaaatgtttttgtttgtatttttcttaaaggtctaaataataacatagatcaagtaaataaaaagactagtgtcattaatctttattcttagagacagtgtctgttagccaggctgaatctttattgttttaagctgtgaggaaaagatgtctttttttttttattaatgaagcagtgggagtagagaaggaacaaagaagtctgtaacaggttttgattgatttgttgtgagcactactgcactcctctagcctggaagctgtttcttaaaaaataactgaactgcaagattcagttaagccagacctttattttatgtttgttatattagctaagctagaaaagataagtaatttagtatattgatttttaaattttgatatcacttaagtatttgatgtttatatttgatatttatcaaattcttaagttataaactacttattcctaagttaagaaatttataatcacagtttatttttttaacttgtacttcttgtacttcttaattcctttttttttttttttttttgagacggaatttcgctcttgttgcccaagctggagtgcagtggtgggatcttggctcactgcatcctccacctcccgggttcaagcgattatcctgcctcagcctcccgagcggctgggattacaggcgtgcatccccacacccaactaattttttgtatttttagtagaaacggggtttcgccgtgttagccaggctggtttcaaactcctgacctcaggtgatctgtccgcctcagcctcacaaagtgctggtattacaggtgtgagccaccgctcctggcctgtactacttaattctaaccatacatcaaatactgtgtgataataagatcacattgctaatctagttctgattttaaaggaagaacttgaccttctagtacatgttatcaaattacagttggtttcccttgtttatagctgtgttctattaatataaggctgccacaagtatgaaaccgttttcacataggggaagtacaggattgggttcctacaaacctctgatcacaacattttcatcaactgaaaatacgtgactttgttacatgtgtatttctgtttagacatgccttaatgtatgttaaattcacatcgaactcactacccagtagcactgtaatttgtacctgaacaaagccctccaacacatacgttctctgtgtggcacatcacagccttgaattgagcaacattagatagcacttgaacaagatgcgtgggggccattttaaacaacaaaatcatcagtaaaaagcacaaaggtgtaaaatatgtggcactaagtagaccggaaaaacagttgtttacggcattagagctgaaacaagaagacagagtgacctcagcttggagtgtacatgtgatgcaactcaacattttttcctgctctgtagatgcatgcacatgaccatggaagggctgcaagtattgatttggggtgagggggtggttaacaaaagttttttaacaagagtaggtaggtgactttacaaataacaaaggttattgacttttttaaagacctgatagttgcatataaataaaatgacaacgtgttaaatgctaaagatctcaatttcctttcttttgcagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaatattttgaagcacatggattaaattctggtttaaattttatttacagaatttccacatttgagcctggccaacatggtgaaaccctgtccctactaaaaatgcaaaaaaaaattagccaggtgtggtggcaggtgcctgtaatcccagctactcgggaggctgagccaggagaatcgcttgaacctgggaggtggaggttgcagcgcacccagatcgcactactgcactccagcctgggcaacagagtgagaccctgtctcaaaaaaaaaaattccatatttgatcttccaaagttgttttttttaagtgaaatgtttgaatttttgtttaatacagtcatgggtcaccactgactggatacagtctaagaaacacattgttaggcagttttcttgcgtgaacatcatagagagtgcttacacaaacctcagtggcatagcctattacctatgtaagctgtatggtttaacctattgctcctaggcaatagacctgtacagcatgttattatgtaaatactatagggagttgtaatagaatggtaagtacttgtgtatctaaagagaaggtacagtatataatatgggaccattatgtggttcattgttggttgatacctgagacataactgcttgagtatctatgtcctttgaagttgcttgactatattggtttaagggaaaaacaatccaatatcctttgaatcaaagcaaatacgtaattcttaactcttcgtatgaggttaaaaaaagtacagataggccaggtgtggtggctcacacctgtaatgccagcacttagggaggccgaggtgggtaggtcacctgaggtcaggtgtttgagaccaagatggtgaaaccgcatctctactaaaaataaaacagttagctgggtttggtggtgggcacctgtaatcccagctactcaggaggctgaggcagaagaattgcttgaacccaggtggtagaggttgctgtaagctgagttcacgccattgcattccagcctgggtgacaagtgaaacttgtcccaaaaaaagaagctacaactaaatctagtatggtatgtattttccagatttgctttcatatacattctgttgtcattctgccctcttaagtatagtcttcagaggtggtgtggggcaactcttgacttggcaacagtgaaaacggccggagaacagaccttgttgaggttatcactaaatagggatccttggaacagaatttaaacctctgtacacttggtgtgttgttttgcctgtgggctgatcagtaggcaagaatcctttaaaaacaagccctatgggatcatagatctctgcacggactgccagagcagagtttatagggaatagtgaggatacagtaaaagcaaatgcagaggatagtgatgtgtcatgaactgacggcaaagaagctttgataacccttgggggatggggaaggactaggagccacctgagcgctgttggtcattacacgatggaggcctgaaacggtgatgaacagatttgcctttaactctgaagtataggtagaatagatgagtttttgataagccttttaaccatagaaccatctgccagtgtttagttagttgtcatccccaaccttcccaccccggacggtggtaatagatgttttcaaatcacagattttcttaatcgttgaatactcgttgtaatgatatatttaaagaaatcactagtttttcttacaaattaaaacaggtaaagggttttggcttatagaataccaaaaacattgtagaaaagcataacagaagtactttaagatcctgccttgaactactccgttaggcttttctacagtttttttggagcgagccttgccttgttaaatctgacctattacttgggtgtttgctagccctaaggctgcccattttccttttttttttttcttttaaatcctacccacaggaaggaacaccttttgttgttgtttctgagacggagtctcactctgtcgcc

SEQ ID NO: 16941 - DNA, 21372 bp, Human
gctgccgtgctgcgtggtccatccaggtggaagggaaggctatggaggagagccagactcctgctctttgttttggtcagttcagaagtcacttaaccaataagtcctttcagggaaggaattcactctaccactacagaatagttttgcttcacatgttttcttgacacagaaatttgtagaaccacagcctctttcttttcttttctttttctttttctctttctttctctctttctttcctttcctttccctttctttctttctttctttctttctttctttctttctttctttctttctttctttctgtctctctctctctctttctttctttctttctttctttttctctttctctttctctctttctttctttcttgacagagtttcactcttgtcacccaggctggagtgcaatggtgcgatctcaactcactgcaacctccgcctcccaggttcaagcgattctccttcttctgcctcctgagtagctgggactacaggtgcccgccaccacacccagctaatttttgtatttttaatagagacagggttttgccatgttggtcaggctggtctcgaactcctgaccttaggtggtccacctgcctcggcttcccagagtgctgggattacaggcttgagccactgtgcccagccgcataattattttaactggttcataataatgagccagagttgtgctctgtcgcccaggctggagtccagtggtgtgatcacagctcactgcagcctcgacctcccaggctcaggcgatcctctcatctcagcctccctagtagctgaggccacaggcacgtgccacagtgcccggctaatttttatattttattgtagagatggggatctcactatgttacccagactggtttcaaactcctgggcctgtgatccaccttgcttggatctcccaaagtgctgggattacaggcgtgagccagtgtacccgcaatcttgcatcattttgattaggaattagtcctcagaaaccagtcatggcagcatggcagaagagacagttgaacatgtcttgctttatccactaggcatacttttttttttttttgagacggagtctcgctctgtcgccagagctggagtgcagtggcgcgatcttggctaactgcaacctccgtcttccgggttcaagcgattctcctgcctcagcctccggagtagctgggactacaggcgcgcgccaccacgcccggctaatttttgtatcgtagagacggggtttcaccatgttggccaggctggtttcaatctcttgacctcatgacctgcccgcctcggcctctcaaagtgctgggattacaggcgtgagccacctcgccctgctcactttgcatacatttgagttgggattctttcgctgcaaaacctgatcttcacctagattcaggttaatttattaactattactaatgattgtgaacagtgcattctattaaacttatttttcaggtatgcagttgtgtaaattggttagacttactacagtgtttagatctggaacgaaaacgtaaggcattttccatgtaactgcttggaacacgacagttacctgctactataaaaacggtagttttctatttatggaagagtttttcttaaacttatctagaattaaaagttaatttaaagaaagtactaattatgacaaaagcagggagtcgttagcacttgaaaccagagtttggtactatgagaaggtttttaattttaaaaagaaggaaaaaaagaaacacggacgtcagaaaactggttcagtagggatgggtgctagaaggctacggaaccgccgaaggcccaggagaaacccggaacgtgttaaccgctccaactggagccggacgaaaaaacggccccgcctcccgcgagggcgacgcagttcgcaggcgcgtcggcgcgcctgttctggggcgcttggcttcaccgcgcaggcgcggtcgccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcctcccgtccttctcatccttcgtaagtggctgcctggcctcccaagggccggtggggatgccgccccagtcccccggcgggtctggcgtaggtacaggggtctcaactgggcgactgaaggccgtagtagcgtcttggttggtccgtaagcttttttgagatagttgttagcgtctaaaaggtacgacgctttaccccaaaatcagactttctgggttctagggggttgggagaaacaccgggcaaccctggactcttctggctgtgggtggcggcggcgaacctcacactgggagttcctagtgccccgctgtcagcctcgtttccgttaatcctggttcctagaggcattcgagcagccctcggccagggtttcccagaggcctggcgggcgaagtcagctgttccaggtcccggagagatggatcctcgcgtccaggagcccacattcttggggtgggtagggtgggagacaggtgtagagagaatctcagtacagcgtgatgccttcagtatccaagggagcaaccaggttggggaacactctctttctgccaggtagtgagtacattacctctgtctcacggctgctgggagaggcgagtattatcatcctaccctcctttacctcccggaggagtctggctcaagagaatttagtggtggcactaagtcatccacctagtgactggaggtggagatttgattgccttttggagcagggatagggatttggtggcaaattggacagggcgtggtggggtgtggccatggaaggcgggggtaccttgggaactgtccccgagaatgagcgccctccgtatgcccacagcagaaatgaggagctgttgggcaaaggcggagtcctcaaagattgggcgcattcgtttcagcgttgtcttggaaaacagttcttgcttttctctcctaagataaattggtagtagtggaggatattttattccaccagtattcattgagtgcctgttttgtgcaaaactctattcttactctctcaattgtcctactgtctgcattgtcctgagatatagggaattctcttttaacccctgagtctccttcagaatctttcctgatgctatccagtctttaagatgatgtctcaggcattgcataaaagactcctgatgagctggcccatgctcatcttcttgtttttaattgtaaaatacacataatatgaagtttatcatctttatcatttttaggtgtacagttcagtggcattaagtacattcacatttttgtgcaaccattatcccagaactttattattattattttaagacagggtctggctctgtgcagtggtgtaatctcgactcattgcaacctctgcctcccaggttcaagtgatcctcccacctcagcctcccaagtagctgggaccacaggcatgcaccaccacgcccaggtatttttttgtatttttagtagagacagagctttgccatgttggccaggctggtctcaaactcctgacctcaagccatccacccatcctggcctcccaaagtgctgggattacaggtgtgaaccactgcacgtggccccgctcccagaacattttctttttttttttttttgagacagagtctcactctgttgcctatgtaggagtgcagtggcctgatcttggctcactgcagcctccaccttccaggttcaagcgattctcctgcctcagcctcccaggtagctgtgattaccagtacctgccaccatgcccggctaatttttgtatttttaatagagacggggtctcactatgttgcccaggttggtctcaaactcctgacctcaagtgatctgtgctccttggcctcccaaagtgctaggattacaggcgtgtgccaccacgcctggccccatcccagaactttttttatctcctctaaccgaaactctcgcactcattaaacaacaactttccattcctacctctccctggcaatcaccattgtactttctgcctctgtgaatttgactactcttgggacctcatataagtggaatcagacagtatttttccttttgtgactggcttcttttcactcagcataatatccttaaggttcatccatggtgtatcatgagtcaggatttcctccccttttaaggctgaatagtatcccattgtatgtataggccacattttgtttattagttcatctgtctatggacacttgggttgtttctaccttttgactattgtagataatgctaaaatgtttacaaatatctctttgagtctctgctttcagtttttctggacatatacccagcagtggaattcctgaatctatggtaattctatgttgaatttttttgaaaaaccaccatactgttttccatagcagccacaccattcgacattctcaccagcagtgcagaagggttccagttgctccatatccttcaacatgtattttgttttcttatttatttattctttttatttttttatttatttttattttttgagatggagtcttgctccgttgcccaggctggagtgcagtagcgcaatctcggctcactgcaagctccgcctcccgggttcacaccattctcctgcctcagcctcccgagtagctgggactacaggtgcccaccaccaccacaaccagctaatttttttgtatttttagtagagacgaggtttcaccgaattagccaggatggtctcgatctcctgaccttgtgatctgcccgccttggcctcccaaagtgctgggattacaggcttgtgccaccgcgcccagcctatttttttttttattatttattttattttgtttatttattttttgagacagagtcttgctcttgttgcccaggctggagtgcaatggcgcaatctcagctcactgcaacctctgccccccgagttcaagagattctcctgcctcagcttcccaagtagctgggattacaggtgcccgccactatgcccggctaatttttgtatttttagtagagacgaggtttcaccatgttggccaggctggtctcgaactcctgatctccggtgatctgcccaccttggcctcccaaagtgctgggattacaggtgtgagccactgcgcccagctaatttttatttttttgagagggagtctctctctgtcacccaggctggagtgcagtggctcaatcttggctcactgcaacctccgcctcccaggttcaagcaattcttctgtctcagccttccaggtagctgggattacaggtttgagccactgcgcccagctaatttttatttttttgagagggagtctctctctgtcacccaggctggagtgcagtggctcaatcttggctcactgcaacctccgcctcccaggttcaagcaattcttctgtctcagccttccaggtagctgggattacaggtgcatgccaccatgctgggctaatttttgtatttttagtagagacggggttttgccatgttggcgaggctggtctcgaactcctgacctcaggtgatccacctgcctgggcctcccaaagtactgggattacaggcgtgagccaccacccccggcctttttttttttttgtaatactaaccatcctaatggacgtaaggtggtgtctcattttagttttgatttgcatttccctaatagtgatgttgagtatcttttcagatgcttatggccatctgtttatctttggagacatgtctagtcaaatcttttgcccccttttaaaatccagttgttttttgttgttgagttccttttgttgttgttattattattattattattattttttgagacagagttttgctcttttgccgaggctggagtgcagtggcgctatctcggctcactgcaacctctgcctcctgggttcaagcgattctcctgccttagcctcccgagtagctgggattacatgcatgcaccaccacacctagctaatttttgtattttttttagtagaaagagggtttcaccatgttggcctggctggtctcgaactcctgacctaaggtgatccacctgcctcagcctcccaaagtgcggagattacagctgtgagccaccacacctggccgacaattttttttttttttttaacttttaagttcagggatacatgtgcgggtttgttatataggtaaacttgtgtcatgggtgtttgttgtacagattatttcgtcacccagttattaagtctagtattcattagttatttttcctgattgtctccctcccaccccctatcctccaccctccaaaataaaaaaatttgtttttagaggccgggtcttgctctgtgactcaggacctgtggccacatcctgtgctgcctcatacaaccttatggcctctctaacctcaacccagttagctttcctaaacccatttccctatgattgttaacacttgttgttagccaggttcagaaggataacataattattatcccagcagagtacacccaccctgtaatcggtaagagagatgtttggcctggtcactgggtttgtggtgagagtctgtgaaaagctgtaaggaacgcgctggtcttcagtagggtcaaatgctgctccttcaccatcgtcagaggctacttcatcacagcctctctgatttgaggattcaagtgggaaagactcatgacaagcagcagaaagtcgaattgggaaaacagtgccctcagggatggggccgcgctcaggtacttagattataacctccgttgggatgtttctgaagctttcgtcttagcagaagttagggaggcagcaccccgatctcagcactcagtctaggccgcactggtccccgcactggtctcccccctccccccgcgtgaggccttaggaggtctgaagtatcagaagtccttgggccagttaagcctagcaaggtcctgggaggcgatctcagctgtccgctgcggtgggggtgggatgcctggtaaggacaccaagtccgtggtgttggcgtggttggaattttcctgggatcgctcccttctcttcaagctggtcacggggacgcatggttgagagcgcctagttcattcagtaggtggtccaggactttcttcagctatagaggggaacaaagacgcctttggtgagcaccggctctgcagctctgcgggtgcaggggaggtgtactgcgtaggtgccccaggactggcgggggctgagggtccatgcgaacggcactactacgcaggcgtcgcaggactggcccgggctcaaggtccgtgcaaactgcatgcactgcgcaggtgctccaggactcgcgcggggtcaaagtccatgcaagccgcacgcactgcacaggtgccccaggactggcacgggctcagagtccacgcataccgcacacactgcgcaggcgctccaggactggcgcgggctcagagtctatgcaaaccgcatacactgtgcaggcgccctaggactggcgctggctcagggtccctgcgagctgcacacactgcgcaggcgccccagagctggtgtgggctgagtggccacacgagccacatgcactgcgcaggcgccaggaggcccttcctctcaatccgagctttgcagatgaaggactctgcgtgtgttgccttctgggcttacgggccgagtgccctttgagattcaactttttctaaattatccttcactttctgctgtaaagagtggccacctcctttttcctctaggggactgaagcgagaggaggatattgcagggtttgcctctgtggtcatcttcttagagagcaccccctccgcccccacacccttttcctcagagccgttgcttagtgagtccctgccatggaccaggcttgggaatggtccccaagtattagtttaggaggacgactctctgcttcacaggacctaccccagaatcctgtgactcagaagcgcgcttgtgaagtgcgcatgtgcgggcagggcctccagtggggctctcgtgggggcagcagccaaggactggggctggtggcctggagagctgcccgcttctccgcccttgccggtagggttcctggccgagagtggcatctggggctgttcagggtctggagcttcctgagttggaagaccctgtcctctgtgttcagggactcagggtgacctgagttggtggttcctgggtttgcctgctctactgctggcagggactagcacggggtgtgcacgttgtcatgccatcaattaattcagagattcacttttgttctaaaaattaatatttgcattattacatttagattcatattaaatcttacactgcatgattctagaacattttaacacttatacgtgggtcttggattaacattgatacatatttgcaaatttatactttaaaactttttttttttttagagacagggtctcactctgttgccaaggctgtagtgtggtggtgccatcataactcacagcagcctcaacctttcgggctcaagtgatccctccctccccgcctcagcctcctgagtagctggggccacacggaccacaggcgtgcaccaccacacctgactaatttttaattttttggtagagattgggtcttgctatgttgccccgcctggtctcgaactcctgggctcaaacgatcttcccgcgtcagtctccgaaagtgctgggattactgcactgcgcctggctcagacagtttttattgtgcttatacatgtaatagatgtaattattttttcaagcaccagttgtttttgttaaccttacaaagctgccttcagttttcctgaagttcacccttctgccttcactcacctcccattcctgagttgttttgtgtattccctataatgctaaataatgtcttggaatctctttttctttttaaaatatggttttaaaagtcagatttattgaagtgtaatttgtataaggcgaaattatcaaaaagtccttagcagtgtctgtagattttccttgcttttgaaagataattttgtgattcatctaagagaatttggcccattcctatttccttctccagagtgggatcaggctggagtatagctccttcggttatagtgctgggtagtggccagggcagaggcaccacaaagagagctggatttgaaccccctactccctgcgcaaaggctgccagaagctgcgctgcagtgaacacgctgcgcatgagcccctagacccctccaccccccctactccccacactccccccccccactttttgcctcatcacgcaggcgctggtaggcggcatcactgggcgggtcagaaaccacgcgcatgcgcagacaccctcaggcgactggcgggtcgcggcttccaagctctaaatggagagttgtccctactgtgcggcaggcggaggagacctgtaagctggaagggggagggggggggatctgatttattgtgtgccaggcacactttagatacactataacatttcgtctttattaatctatttttaaaatctcgaaacaaacacaaatgtgcagaaaagttatatacagtcaataccgataactgattttgtttcctgaaccatttggaagttgtcaacccaaaccccctcattccgagatactttggtattcaaaagaatcttgggggccgggcacagtggctcacgcctttaatcccagcactttgggaggccgaggctggcggatcgcttgagctcaggagttcactggcaacatagtgaaaccgtgtgtctactaaaactaaaaaaaaattagtcgagtgtggtggtgcaggcctgtagtcccagatgctcaggaggctcaggtgggagtatcgcttgagcccaggaagtcgaggttgcagtgagccgagatctaatgcaggcgtcaagtacgttaccacgatctgatcctcagaccccatgcaggttccccacgtttcgcagtaatgtccttaacagggaaaggacccagttcggaatcatgcattgcatttcccggcctctagcctcctgtctggaggagtttcccagtcttcccttgactttcatggctgtcatttgtgggtgtcagaggccagtgatttcgcagaagggacgcctactggcatgtctgatacttggtagggatttctgagaggcagtgctgtgttctcattgtgtctcatccgctggtgtgggactgggatttggggatgttcgctgatcccttggggtaggtgccagaggcgcctctgagggatctggtcttggggcgcccgcgcagtccttggactaggccttcccggcagatctgcgggcgccacctggcggtcactgccgactcctccgttgcgctccagtcacctctcccatcccggtgccgtggccgggccgttccctggagagtggacggctggggctggtgcagggaacaggggcctgcgggggctgcgcaggcgggcctccaggtcatgcggggcccctctgctcacagggaccagccaggccagcctggggagcgtgcttctttgtttatgtctgtatttctctgcctatctgtggaaaccacagatctccaattgaagccaacaccacaagattcattctgcttctctccgagacgcctgcctgcctgccttccttccttccttcctccctcccttcctcccttcttcccttccttccttcaccaggttatgaaactggctaatttttcatattttttgtagagacagggtttcaccatgttgccaaggctggtcttgaactcctgggctcaagcgattcacctgccttggcctcccaaagtgctgggattattggcatgagacaccgaacctggccttttttcttttgtcccccttttttttttgagacaaggtctcaccctgtcgcccaggctggagtcccatggcatgatctcagctcactgtagccttgaactcctgtatacgagagatcctcccaccccggcctccagagtgttagggttgcaggccgagccaccatgccaggctgaggcatctttctaagtgtctttgttgaaagtgagaagactggcttccgttactctcaatatgtttatttctgtgatcacccttttgtaattaatctctggtgtccaccgcccactgttacccaagtgaatgcatgcctctccccacctgggctccgaccctggcagggttcctgcttgtcttgtatgtctgtctccctcaccctacagaccctgactcctgtgtcaggctgccctttcttggggacccctgtatcaccatgcctggccctgatgcctcttgccagggtgccattctgtgggaaggccctctgcactgagcttgggcactgacattctgccctgggcccctgcctcaccactgttaccctgcacctgcaccttgctctgccccgtctaatctaggactgaattcttctgggaggggagaggttacatgttccctgtcactggaataacagctctggtgatggaattggttttcatttcacaattgcaattttatttatagtgaaacagacaaacatttgtattggagcaaattcatgggcatatctgtaaaaggaaaaatatagtttgaatagcaatttgaatatgagttttttttttttttttttttgtggtcgttatagggagccgaaaaaggcagcagaggctggctgtgtaggtagagggcagcttgcccagttggcagaggtgggagtaggatgttggaggaaggtgtaccggttctgtctggccaaacccatgctggagtcacctcaaaagcagtggcaggggagttccctcaaggggctgctccagactgcctggagatggggctggcttggattccaaagaaagaagcactaaacgccagggtgataagtccacagcattcatgacaggaacttacaagagctgcggcagtcccgggacagccagtgagagaaagggacatttacctagggctgtctgccacccgggggttggggtatggagtgtatgtgggagtttaaggactttgtcatggtggggctagtttgtaggtgtttctcagcaggatgaatctcccagtgttctccagcaacagcctttgctctttatcagtcctgggaacgttcacggccgcagtttgcattcagtcctgcagggacgcacacaactggctgggtcacagagtggtcagggcatagacagaaagtagcgggggactggggaaccctcctgtgacccgtgttggaaggtgctgatccccgttgtccgccctgccagatgtccagggtgctgcagaaggacgcggagcaggagtcacagatgagagcggagatccaggacatgaagcaggagctctccacagtcaacatgatggacgagtttgccagatatgccaggctggaaagaaagatcaacaagatgacggataagctcaaaacccatggtactgtgtcccttgcagcctggaggcttcatgagagcggatgaatagagaagtctgtatgtgaagattagtagaatacatactttgcttcttggatgttctgaatattgatggaaacttaagttatctggaggaaactcagtaataagtattactttcctcttatttgctggtgaacctttgctttctaagcacagaaatatctaagatcctctcagattttcctcagagccaactctttaaaattttaagctaactcttaaaaattgtaggttttcatttttaaattcatcacttttctgagagaagcccagaaaaaaagtctcacagtggattcccagaggcttttgttccactctctagaaaaatgcccagcagtgtcctcttctgagtgtcacctcccgggtccagtgtcctgtgatgaagagcgctttctcagggcagcccgtgtgctgagggaccccggtcacagtgtgtgcacagtcagagagctgtctctgtggctaggaaaacagacagaggggcctgtccaggcccaggacaagctggactcccaccaggggttcgtgtactgtgcacactgggaaataaggaggaaaatttagtcctgttggtaagtggtaactgtattatacaaagaatctttgatttcatgagtcgttttaagagttttcaaaattaaagctattcaaatctcaatctgagtcggatactattttaaataatggcataatgagatggtgggtgacttaaaaattctattttatattttctaaatatgttgagcgattgttccatttataatcagaaagtgtattataagggaaaataacatttctgtgtatttgaatattttgttaatttttcaggactgacataattatttatcctgtttttcctttcagtgaaagctcggacagctcaattagccaagataaaatgggtgataagtgtcgctttctacgtattgcaggtaagtgtgctagagcgtcagccgggtcattggagttggtgaccccggcctccagagccgtgtctgcagatccagggctgggagttcgggctgttccaccttcagctgtcgtgtcgtgtgtccctgcccacacggagctctaaacactctcggtctctaagtcagactaaaaggaagcctttctcttgaggagagttgttaaagtttgggactttttggcagagggactgtgaagtaagttctcggagagctttcaccatgcctgcatcccagtgtggtttgaaggacctggtgggatgaagcgagaggcttatagatgacatcagttttttctgagatcttcaatacttttggcccttacttgttacctggtgtacttcatgcacgctctccaccctccaggtagagaaccagcttttccgactggaattggcttctagcctccctgcctggggcttaaccctcatagcctctcctggagctgttgggctctgctctgccccgagagtgcagttgtgctgcccagacacctttagcagctgccgtaaatatccgagttgcagtaccatgtgatccggtaaccaaggcaaaggattcaagcccacccccaaaaaagcttagtttggcagggtatattgaaggaaattaattctgaggcactgtcatttgctaagagattaagtttccgcagacaaaggagttaggccagcaaccctctttcatgtctcttctgagcggcctgttcaagccaggaaggggacagatgacaatcgaaggaatgctgtggggggatggagggaaataaagcatcccccaccattgaaacttacacagggctcacctctgcgtcccttgctaacactggtgtacgtgggagaattcactattttttccaaggatggctttcgtcactaataaggtgtgttgagcatacagtctggctactcaaaggagatactcagtgagaaaagcacacccgtgttatgggagactttggttagtttatcagctaatttaaattatgtgtagattgtgttcatcctaaaacagtgaaatgccagttcacataggaaggctcgcctacttgttggcagtgttcagacatgctgctgagctcgtctttaatttgactttctcattcaaggtttcaccaagggacattagtggctgtgcgtgctcatctgttgtctgtggggactgggttcctaggcttgaggtgctcagtctggagagttttcctggttttattttcgcatttccctgtcctcccttctgtgtggtcggttgtgtgattggcaggctgctttgctcaccagaggtgtctttacaggctgccctgatgatctcactcatttggaagtattattctgtccctgtggctgtcgtgccgagtaaatggataacccctctagaccgcctggtagcctttcctactagagtagcaggtaagaattttctggaagatgcagtggaagagtgtgaataggcttatgtagaggtgtgtggtagaagattaagttagcctgacatcctcctcaccgtccatttagtgagcggggttttgtgtctcagcctcacatgaggcttcccatgaagaaactgaggtctgaaaaagttacttcacttgtccagtgtcaccaaaatgttaaggagcaaagctaggattcagtcctaggtctgtttccgggatccatgcccaatacgtcaagtctgataccccattgaaacactagccgtagttccaaaattctgtatcttttcaatccctattatggttggcttctctgtagcacttgctgctcctggctattcttttattttttattttttgagactgagtctcactccgtcacccaggctggagtcagtggtgcgatcttggctcactgcaacaacctctgcctcccaggttcaagcaattcttatgcctcagcctcccaactagctgaaattacaggcatgcactaccacgcccagctaatttttgtatttttagtagagacagcgtttcaccatgttggccaggctggtctcaaactcctgaccttaagtgatcctcatgccttggcctcccaaagtactgagattacaggcatgaaccactatgcccagccacgttcttttatttttgaagataaattttttttagatattaaaagtagtacatgtcactatagaatgattagaaatatagctatcaattaaaaatcccagctgggtgcagtggctcacgcctgtaatcctagcactttgggaggccaaggtgggcggattgcctgagctcaggagtttgagaccagcctggccaacatggtgaaaccctatctctactaaaatacaaaaaattagctgggcatggtggtgcgtgcctgtaattccagctacttgggaggctgaggtgtgagaatcacttgaatcctagaggttgcagtgagctgagatcacgccagtgtaccccagcctgggtgacagagtgagaatctgtgtcaaataaaataaaataaataaaaaataagattcctattagcttttaatgctgtgatatgtttttctttgcctttttttccccatttattttgatatagttaaggtcacctggcacatcacatgttgtgcctcctttttactttatagggtaagcctattcccacatgttttagtttgttagggttaagtgaaatactataaactgggtagctcataaacaacagaaatttatttctcactgttccggaggctggggagtccaaaatcaaggtgccggcagatttggtgtctgatgatggcccattttccagttcatggatggtgtcttctcactatgtccttgcatggtggaaggacaagctcctttaggcctcttttataagggcactaatcccattcacacggactctgcccttgtgacttaatcacctcccataaggccccaattcttaatgccatcactgtggggggtagcatattagcatatgaattttagggggatacaaacattcagaccatagcaccatatcagtacatttcttttcttttttttcttctcttttctttttgaggcagggtcttgctctgttgcccaggctggcagtggcaccctcatagctcactacagcctggaactccttggctcaagcggtcctcccaccttagtctcctgaatagttaggatcacagttgcacaccaccatgcccagctaattaaaaaaaaaagttttttatagagatggggtcttgctttgttgcttaggttggtcccaaactcctggcatcaagcaatcctccctcctcagcctctcaaagtgctgggattataggtgtgtcaccttgcctggcaaatttctttattaaggaattttcagtagctgttcttcatttagatatctcatttgcagattttcctgatgaaggatatttattccggtcctgattttttgctattaaagataatgctgcagcacacatacttgctggtctttggttgtgatttgtgattatgttagaggtgaatactgtatcaaaaggaatgactatttttttttttttaagaccgagtctcactctgtcgcccaggctggagtgcagtggtgtgatctctgctcactgcaacttccacctcccaggttcaagtggttctcctgcctcagcctccccggtagctgggattacaggtgcccaccacacgcccgactagtttttgtagttttagtagagacagggtttcaccatgttggccaggctggtcttgaactcttgacctcaggtgatccacctgccttatcctcccaaagtgctgggattacaggtgtgagccactgtgcctggccaggaatggctgtttcaaagactcccaatttagctaccacccctgtccccttccccaccctttccttcccctctcctttgtttgacacagctgggcctaggccaggagctctgcactgcggccagagaagcatccagccacccttccatgcatccagcaggtccatgggtcactcttgcagcctgtcttcctggacagggggatatgtatgcctctccattattggtggggcaagaaaggcataggtagacattgctttgtttataatgctttctgagaaaggaaaaataaataatcttacaggtttggttttggaatctattaatatcataaatagtaatgcacatctctctggcaggaaagggaaattcagcccagggtccaccgttcactgcaattcctgcttagtaaagaatacagccctatgattctatagaaagtgacaaattcgggctgggaatggtggctcacacctgtaatcccagcacttttggaggccgagttaggcaaatcatctgaggtcaggagtttgagactagcctgacctacatggtgaaaccgtgtctgtactaaaaatacaaaattagccgggtgtcggccgggtgcggtggctcatgcctgtaatcccagcactttgggaggtcggggcgggcacatcatgagttcaggagatcgagaccacggtgaaaccccatctctactaaaaatacaaaaaattagccgggtgcggtggcgggcgcctgtagtcccagctactcgggaggctgaggcaggacaatggcgtgaacccgggaggtagagcttgcagtgagccaagatcgcgccactgtactcccacctgggtgacagagcgagactctgtctcaaaaaaaaaattagccaggtgtggtggtgcacacctgtaatcccagctactcgggaggctgaggcaggagaatcgcttgagcccgggaggcagaggtgcagtgagccgagatcgcaccattgcactccagcctgggggacagagcgagactccgtctcaaaaaaaaaaaaaaaaaagaaagtgacaaatttgaacctatgaaacataaacttcacttcagcccagcactgctcaaaaagaatggaaatactctctttgctgtgagttaaagacagcagagacagatgggggcagcactgctggtatgcgctctcatggtgaatgtctttgttttcaggtggtgttggaattacctgttggattttagtctgtaacaaagttgtcgctattgtgcttcatccgttcagctgaacaggaggatggatacagccgcgaggctaaaaaacggatttcctcttcctagcttaaaatctgatttacactgttttgttttttaagaaacaaaagtgcatagtttagattttttttttgttgaatatgtttgttcttggactttatgagatagtcttataagaatcacgattttctacacctgtcattgagccaagaaagtccagtttatgacacgtatgtactagtgaacaccgtcctcgatctgtacgaaatgtgaaatgtttagggacatctccatgctgtcacttgtgatttgccctcttatgtattttggtcatattgccaactggaaagtcaaaattttctaacaactttaagtaagttctttgaagacttagtgctgtttttaatccagtttagaaagtaacttaattttaataccgctactaaaaattcgaaaatttcttctttaatcacattcaatatggttaaaagaacaacactaattgacattgcgtgggctttttctccctttgtttaaaatgtcatttgttgagcaagagttgtatagtattatctacttacttgaggctgttaatttttcattacagtgttttgtaaatgtatccacgagaccatgatgcattgttttgtgctcaacttgtgttttgtatttaaagcattttgaatgaagtgtattttataagcatttaatatttatgctctttagaatggaacacagaaaacaaaccttataagtcctgattaaattaatctgaaccaataacctgtgtggcctacaaagtataattctattaaatgttccttaaaacacttttttctaattaaaatctttgcaaatgcttgtgtaacttcctgccttacagctacttgtttgctgtgagccacccgcaactgacaagtggctgttaactgagtcaccatatcccagtaaagctgaattctctcactagtttctgcaagttcatatttgtactcttttgtttcctaatgatctaataagtagtttgttgttattttagctgattggactgtgagaagacaaagtgctgtggtcctttatttattgtcatgctgaaggccaccacagcagcttttgggttccacttactcaaacacacatgcacgcaggcttacccagcaccaagtttacttagctttaagaaaggacagagcagggaacgcagccacagcctggtggaggaactggacaccagcttccagtgtccgtcaccacacgggatacattttgcccacaaaggatgagaagccaacctggggaggagatgagagtagcacacggaagctgcaggaactagtccttcagacgaaatatagcaccaagggggcacgtgcctaactcccgttttagtaagctgcaggcagaaatgatggtggacagtcaacagtgcaccggccatgtagagcgtgcccagggaactgctgggatcactcatccgcatacagtgtccatgatgatacccgtatctcttaaagatattctcattcagttgttacaagaattttgacaaatctcactgaggctagaggtaaaaatttctggttcacagctattaactttccccatgcgtgaatagtttgtgatgattaaataggggaaatgtaaatgtcctttatgtttcacattattgtgtttttttagaaattatacagtttttttttttttttttttgagatgggagtcttgctctgtcacccaggctggagtgcagtggtgtgatctcggcccactgcaccctttgcctcctgggttcaagtgattctcttacctcagcctcccaagtagctgggattacaggcgcccgccgtcacgcccagctaatttttgtatttttagtagagacaggatttggccaggttggtcttgaactcctgacctcagctgatccacccgcctcggcatcccaaagtgctgggattacaggcgcccgccatgacgcccagctaatttttgtatttttagtagagacaggatttcaccatgttggccaggttggtcttgaactcctgacctcagccgatccacccgcctcggcctcccaaagtgctgggattacaggcgcaagccaccgcgcccggcctgccatttgttttaacagatgatgaacacggtgatgaattcagaagatagagaaagagctacagtaaatgtgcatcttacgactcttgtcccccaatttcccaaagttttcctctgttaacagttttttatgattctgccagtgatattccatgcatttatgaatattcatgcatgtgcttttaagacatgttttaaaggtataaaaataatacctaaaaagacaaaagtagtacctatttactgtttttttttaaaaatggaacttgggaagtacagaaaagcagcaaggaagaaaaacctatgactccatagaactagggtgactggcgttagcatctgtgcttttgttttttgcatatatgtgtgtataatgttgaaaggtaatgataggtttattttttttaaatttattttattttttgagatggagttttgctctgtcgcccaggctggagtgcagtggcgcgatctcggctcactgcaacctctgcctcctgggttcaagtgattcttctgcctcagcctcccgagtagctgggactataggcttgcaccatgacgcctattttttgtatgtttagtagagatggggtttcactatgttggccgggctggtcttgaactcttgacctcaggtgatccacctgcctcaggcccccaaagttg

SEQ ID NO: 16942 - DNA, 48108 bp, Human; identical to SEQ ID NO: 12555

SEQ ID NO: 16943 - DNA, 11700 bp, Human
tataaaatatgcaaagtaaagatatacacaaacctcaacgcagtggctatctctagaaaaggaggggaaggaactgagagcaattttatttctttaaaaaaaaagagtatctgaagtaaatttggcaaaagattaaataatcacgtctgtaaaatctgaatcatggattggttagctccccctctgtatttgatatctgaaatattccaaaaattaaaagaaaaaaaggaaaattagacaataagaaaattgggcagaacaaagacaccaaaacgcagcccttgagcgcagagcacgaaaccttgagcaatcggagcagtagctgggtctctaaggggtttgaagtttcttaccctaggtatccttatactatatcccattttccttaggataaatcgcaaatttcttgcaacaaaaaatgtcctaactagagtcgtagttataaggaaaaggctctctccggaggagtaaaatctgtaaaatttctaccttgtttccctcgccaggatcttgggcaaaatggaaagagatttaggtgaatgccataaaatactctataaaccattaaatatcatcaagaacgcctaaggaccgcatcgcccagtaggagagtgcatatattttgaaaggtctctgcaactgagggggttttggcgtccagggcgccactggaaaaggcacggcgcactggtaccagcccaaattcacctacgtctcggcttcattttttatctttgatccccctattctgtctcctgaacaggctggctgaagaggccacactggcagcgtcaacactgcggagcagctggccagactcgatcctgtccaccccccttcccattagcgtctgtgggagagaatgctcagaaagaggcgcgggggcgaggggagcggcgaggttacccccctcctgggtccgttccgtggggacaggccctggactggactgccagttcacacgaaaacaggtggcaacagagtcgtgacacgcacacacagcaaggggtgtgcacgaacgttcacgctcaccaacgaaacctgcacacaagagatacccactcgacagaattaaatccgcacacaagagatcacgcactcaacaggacccatgcgcagacactctgcgtcactcggagacacgcaaggacgcacacttgcgcgagcaaggctctaggcgggggtcgcaattgcagaaggcgcggccacgcgcgctaggggacgcgcagcccacagacaggggcagtaacacaaaggggggccacctgcaaggccgagagcgcccacgcagccgccagggagcgcggacaccgacacaaaaggggcgacgaggcgacacgcgagcgcctccacccagcggaggtgtcagccacgcaccggccgaggcacgggcagcggggggttgcgcacaaagggactactcacaccctcgcaccggcatcccagggcctcgctcgcgaaggggcaccagaccaagggggcaaacccactggggtaggcaatggcggccacaccccctcatcgcgcgggacccaacccatgcagacacagtaggcacctcagcgagggacgcgaggagacgcgcacacacccacactcaccacacacccacggagggggtgtggaaggccccgctcccccggcatctcggctgcagcgggacaaggtgacacatccgggagcccggcagcgcgccgggtgtgcactcacccgggcccgccgcccgcgagcctcggacgcgggcagcagcagcagcagccgccgccgccgccgccgccacctccggccctccacgtcagccgacggcgggagggagcgggtggcggcgttgaagcgaggtgcgtcacgtgggctggcagcgcgcgtgcgcagtcgcaccccaccgccccctccttcgccgtcgcgagccgcgggatcacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgaggtggccgaggtgtcgggaggggcctgggtgggcgtatgaaggacccgaggtcgagggcccccccataccccgcctcgaatgagaaatagaagtctccacgaatgggcagggcccggggcctgggcgccgcgacctagtaggcccgcatgctggtgggcgccgcgcgagccttgttccctgccctcccctcccacagggaggccacgcttgcagagctggagcgcgcgtctatcgccccagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcaatggtgccacggagcacatcgctgacgctgattgtgttccttttccacagattgtctaaagccccaggaaaaatggtggaaaattcaccgtcgccattgccagaaagagcgatttatggctttgttcttttcttaagctcccaatttggcttcagtaagtactttcctgatggatggccaggggctttttctggcgttcagtgacaagggaagaatacattggttagactgtgcacacatgaactgttgattctttctccctatgtctctttttaagaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatgggtaaatctacagttaatgctcagtgtgatgagtgtcagggagcacggtggagagacattgaaaccagactggaaagtcaaggctttctacagaggcctttccccctggcactgatgctgattaggaaagagtaagagggagggaagaagtggaaaggccttgaatgagggcgtgagagggtttggacccgaggagcttgtgatgtcaccagtgtgccctgcgggatctggggaacaggagaagtaggccagagaagtcgggttgaaaggtgtgtcgtttgcgtcctggatctcccttaatttaaccccataacattccattttacagataaggagactgatgctcactaagacactaatatgcccactcacacagcaagtcccaagtctctccccaaaatgatttgagaattttgaggcacacaaaagggagaaaattgagtgcccgtgatccaacgttctgcaactgtttggaaaccaggaaagtggaggagtggtagtacttctgaaccctaactaaaatatatcagcctgcaccatcagcacagcttgcagatgaatgtaatggccaggctattaaaactgaagtgaagtgaagaagttacaactgagttcgaattctgactcctccacagattagccatgtgagctgggaccctcagcaaattttttgagcctcaggttccttatctgtaaaagggtagtgataatgatggttattaaatgcttatgacgcatgaaacagttctatggggtaggttctgttattactgtcctttaaagatgagcatcctgtggtttcagtaacttgctcaagattgcaaagctactaaataaaagccttctaaatttgaacccaaatacactggctgacttcactctgctgcctcttctgactgttgtgaggattaacgggggtaatttatgtaaagcacgtaaaataatgcctaggaacagttagggacttaataagtgttagctactgatgttattgttagcacttttgtaaatccttgttcaaagagtatgtcaaggattagaagctatatgaataaataaaagcaatcactttaaggcttaaattctggccggcctggtggctcacgcctgtaatcccggcactttgggtggccgaggcaggcagatcatctgaggtcgggagtttgagaccagccagaccaacatggaaaaaccctgtctctactaaaaatacaaaattagccgggatggtggcgcatgcctgtaactccagctactcgggaggctgaggcaggagaatcgcttgaacccgggaggcggaggttgccgtgagctgagattgcacttttgcactccagcctgggcaacgagcgaaactgtctcaaaacaaaattaaattccatcatacccacaaccaaaaagtaattcaagtatttattggtgcttaccatgtgccaggcactgttacaggccaggaaggaccaaaacagccaaaaatgccctgctttgagtcttcattctcatgccggggggagatagtcaatgggcaagttaaataagaaaaacgtatatagtatcaggtgataacgtactatggggagaaattaagcaaagggaaggaggatacgaagtggaaggagggccttctaatgtgcttctatgtcatcttttattactcattcgtgagcacttgtaacaatgtagtgaaaataccaattttctctattcaccactagattttaagtttagggagggcagaagccatctcttttggattcaatattgtgtctcacacacctgacatacagaattctgtaatacatatttgttaagaaaagaatgcatcatcactgatgtagtaggtagttaaaatttatctttgccgcttaccttgggtaggtgatgtatcctttctaagcttccatttcctcatcatttaaaattgcatacttgccttggaggattgtcttggaggattatcttaatgcatacagaatgcttggaactgtgcttaacccacagtgagtgctcagaacttagccattgttgttatcgtgggataacagtaaagagtgccgagatttcggattgagggaaataacattgtactctgggagatagggcagaagctcagtatgtggtggatgagaactagggtaggtaaatttccctttgagcaattaaatgtctataattacttcaaccttgtggggatgaagtattgaacacttactgtacctaaagcaaactgctaggtaataaggattacaacaattgctaagccatgatttgtatccttgaattgcttaaaatataatgtgagttaagatattaaaaaaaaagactaatacagtaattataagtattataagaattgtgcaaacgagctagaagaactgaaaggaggaaaaaatcatttctgagttaatcagggacacttcaaaagagcttttctgttttatctgaatcttaatagattgatagattagatgtatgtcttactgacttctcttcctcttttttttctttttcttttctacagtactttacctcgtgtgggcctttattcctgaatcttggctaaactctttaggtttaacctattggcctcaaaagtaagtttaatatatttcttaaatgaggatataattaatgctgttttgaggagtcatatcatttcttaaacctacccaaatcttaaatatttgttctcttaaaattcatgaatagccatatagaaattgaaagctttttaaagatcgctattgatacatctctaattaaagatggtagcatgaacacacatgtttatctccatccatttcctccaaaaatcttgttaaaatgaccctacaggaaaaaaaaaaaaaactgaagatacaaaccacagaaacaatagtatagcagaaaagagatatcaaccacattttggaaagtggattgtgataggtgagaggtaactgcctttgtttctgtgattttcacgttgctgaagtagggaagccagcaagaatatttgtgccttagaactccagaatagctcagacattggggtaccaggtagctctttaattctgggttgaactgaaaacatgtttaaagaccatatgaagtcttcagccttcaaatctccctcagccctcaaagctgggaggcctgccctgccctcccctgcagaaaacaggagttttactctctggcaaggttaagtaagagtctctagcatgggggccactaagtctgagtgtgggaatgcggcatcttactgaaaacagggaagtaagtgaaaatctacatggcttaatgagaagatttacctcctgctccatcttccctcttggggcttcgaggcttatatcaccctactgctcacagaaaaagatagatagttctttcctgaggaagctgaccagcccgagagaaaggatctataatttctgacatttagaggaccccagtgaagtggccaagtctctcagagtgaggctcaccagttgaccatccctgcccacatacacatagtgcttccaactcacttgttagcacttcatttttaaatatgaatggactactctaagttaccagacattaaaagaaagcctctagcatgaaatgaaaaagcagaaaattaaagggaatttgaaggaaatagagataatgcaggaaacagaaaaaaaaatttaaataacataaaattctcagaggtaagaaacaattataactatgaaacaagaacagaatgctatgcaaacaggaaattactgtatttggaaattgtaaacatgataaccaaaattaaaattttaattgaaagactggaaaataaaacaaaggtaatctctagaagttagaacaaaaaaaaatgaaaatataagaaagtataatcgttaaaaattcaaactattagaagttccagaaagagaaaataatagagaacaaatcatttaaaaaaaaaaaaacatctggccaacatctcaagaccccatttctacaaaaaaattaaaaattagccaggtgtggtggtgtgtgcctatagtcccagctacttgcagggctgaagtgagctcagcagattgaggctagtgatctgtgatcatgccgttgcactccagcctgggtgacagagggaaatgctttctcaaaaagaaaaaaaaaacactcaatgaaaaatagcactccatgtacataatgatactgagaggcataatagagtcctatcagagaatttgaggctctggtattggtggattcctgggaaaccaagtgaacagacaaaaagatgtaattattccagaaaaaaaaaagttgtacaagaaaatatataataataatgtactaagatcctcagttgcaaaattgtttatgtaggtacaattatttctaaaacctgctgctataatgagaaattgcaatgtaagtatagaagaggataggaggaggttaattccttatctccatattaggaagcctagagaaaatgtctgtaatggaaaaaaatgaggaaatagtaatatgagcatgttttgtagcaatgaggaggtaagtaccagaagacagctcaagtgctcaaagcatttctttttggagagtgagaccccagggttgggatggtgggatagaggactgcagtttttcactgtaagccttgtggaactatttgtctcttatgtacacatattactttataaaatttaaatttaaaaaacatgttggctttgtgaccgactcttgagaattacaacttttttaaagtgtctattatgtactttaatattctctttggcagatattgggcagttgcattacctgtctacctccttattgctatagtaattggctacgtgctcttgtttgggattaacatgatgagtacctctccactcgactccatccatacaatcacaggtaactttatataaaaggaaagtgctggggcaatgaaagagtggagtattagcacttttacccagaaaagcaacaaagaacaggctgcaaaacccatgttggtggtgcgcgtctgtaatcccagctacttgggaggctgaggcaggagaatcacttgaacccaggaggcagaggttgcagtgagccaagatcccaccactgtactccagcttgggtgacaagagtgaaactccatcctaaaagaaaacacacacacacacacacacacacacacacacacacacacacacggacagtaaaaagaagctactaagagaaataaatacaaacttatataaaaggaaatatttgcatgaaggaattaagttctgatgaatacacactagctatattcatggaggaaataaattataattaattatagcactggttagcaggtgtatgttcccataaaaaccacaagtatatgctatatgtgtctataatatgttcccattaactttgcctgagagaagcttatcctgaacagacaccgttgatcaagggatagtaaatagtacatgcagaccttgttcagaaaaaggactttgggggtgtgtatcctcctcaggatcattgtgtactccttattccaattaagtggataaaagagccacaacacgttcgtctggttttatttttttaaagttctttcaagtctaaagatgaaaataaatcagactcctgagcttgcttaaattctagaaagtaaagtattttttaagttccctggtatgatttttcaacttttcaaaacctttatatattagcctctacaatgtattttgaaaatcaattctattatttttaagtgtctttctaatacactgcattccatgcattcttgattggaattggcagcaaataggtaatttgtgcaaagaggggaaattgttaagattgcatgaatatttataccaaatgatttaatagttttgccatgttgatttaaatacattttcaaggcctggatataattctgttcccgtgagaaatgtgcaaatgagactttaatcatcattgtatggttgattaaaatattgatttctttccaagttagagatgaaaaaagtactttactgatgtttttatttttttatttttatttatttatttatttattttttattttttatttttgagatggagtctcgctctgtcacccaggctggagtgcaatggcgcaatctcggctcactgcaggctccgccccctgggttcacgctgttctcctgcctcagcctcccgagtaggtgggactacaggcgcccgccacctcaccaggctaattttgtgtgtttgtgtttttagtagagacagggatgtttttattttaattgggacatttcttctaaagagaggatttaagtaatcatctaattatgttaaacatgatgtttgtcactatccaaacgtcagcctagtaaactatgtggtgggtctccatcagacacagagactgtagaagaaattgcttaggtaaacagagctttttggtcttttcttacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccatatagcagacttaaaaaaaaaaatcaatgtcagtataatcaagaagttcctccagagaggcatttatattgtaatttgcaaagggcaatgatgtccttcctcctgtttgtcctgaggggcccagaattcaaacccttagtttttgggaagggtacagttagtacttgtgccatcagattcatgtctaagacacaaatatttgttgagtactcactgtgtaccaggtatttttctaggcactgaggatgaagtaatggtaagattctctctcaaagagcttatagttttagaagcagggtgaggcaactaagcaaataaacaaggaaatataatttgatgagtgctatgcaaagaattaagataatgtattctagaatgcaaagggatgactagttcacattgggtggtcaaggaaggcctctcagagagaggctgttgggatctaagtataaagcaggtgaggcaaagaccataaggtgggaaggaacttggtttgtcctaagaacagagagaagactggcattgggcatagagcataccaaacaagagagaatgtggtcccaggtgagcctggagagaccgggcccagattgtgaagggctttgtaggctggtgtaggaagtgtggatttaagtgtaagtgtgatgagtttgaggcactttaggatcaagctgttgggagtcttgaaggaaaggaatgacatggcctgatttctgttttttaaaagtcatcctgattggtgaatgaagaatagattcagaggaggagctgggaaggggacaataaccatatccttacccagtaagcatgagatggataacatgaatctgcttttcctgttccctagtttgtcccagttcctgttattttatggtgagagcatgtcaccacacttaagagcagtataaggggactggatgtggtggttcatgcctgtaatcccagcactttgggaggttgaggcagctggatcacctgaggtcaggagttggagaccagcctggccaacatggcaaaacctcatatctactaaaaatacaaaaattagtcaggcgtggtggcaggcgtctgtaatcccagctactcgggaggctgaggcaggagaattgcttgagcctgggaggcagagattgcagtgagccgagatcatgccactgcactccagccttagcaacagagcgagacggttaccttggcaaccgtctcaaaaaaaaaagaaacaaaaaaaagcagtgtaagggaaccagcgaactccaccaagtatagaatgataaataaatcatggtctgtttctacaattgaacactacacagccatgcaaacaagaatgcattacttctctacctaataatatgaattaatatggccataacattgggcaaaaaaagccagacacaaaagagtaaactactgcgtggttccctttatttgaagttcaaaatcaggaaaaactaatctatggtggcaaatattagaataatggttacctttggagaagagtattatctaggaggaggcatgaaggagcctgctggtgaattgaaaatgccctacatcttgatctgggtggtggttatggttacatggaggtaatacatgtttttaaaaaatcattaagttattaagatttctgcttctgatgcaagttacacctcaataaaaaggggaaaaaaaaacagtgcctatgcctacctccagaaaatgttgattcattggtctggagtagagcacaggcaggggtaattttttaacatcttccagatgcttccaatatgcagccagggtcgagaatgactcccttacatgattggactcccttacatgattggactcccttacatgattggactcccttacatgattggactcccttacatgattagacttaactgagttttggtcaagcagggcagtagctgtaagctttggaagagaaagccagcagttatccgagcggttccctcccatctgtgagactcttgctcatgtcagcagtattcc

SEQ ID NO: 16944 - DNA, 121384 bp, Human
tagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagtgagaagaaaagagagttgacattgggtggcggggaatggagaagaagaacccatgaaggaaactgaggaagagcagccagacgaataggaggaaaaccaggagaagatggtcttggagtccaaatgaagagttctgaggaggaagtggtccacagcgtcaagtaagttgtaagctgaaaagtgctctttggatttagcaattaaggtagactatttagctggaagcatccaaacagtggattttaaaaatactcatctaacattaatgttaatgatagctggtatttatagcatttcccatatacctggtactcttctaagctctttacatgtattaacagattgatcaggtaggtagtatcgttatccccatttgatatgcgaggaaacacagaggaagcacagagaggttaagtaacttgcccaagatcacacacccaagggaacaagagagccaggactcaagcccagagtcttggctgcagagtccctgttcttaaccactttgtcacattgcctctctagttaaaaacaaaatacaaggccgggtgcggtggctcacgcctgtaatcccagcactttgggaggccgaggcgggcggatcacaaggtcaggagttcaagaccagcctggccaatatggtgaaatcctgtctctactaaaaatacaaaaattagctgggcgtggtggtgggcacctgtagtcccagctacttgggaggctgaggcaggagaatcgcttgaacccgggaagtggaggttgcagtgagccgagatcgtgccagtgcactccagcctgggcgacagagtgagactgtgtctcaaacaaacaaacaaacaaaccaaaacaaaatagaaaataaaatataccccagtgtcgtaattacagtacaattggtgctgtgtgtgttatcagtgagattcgctaggcttgaatgaccagtatcagtctgccaggtatgagcacattaattgtattgtaattgatgccatgatgtgtgggctgtgacagttcttggctctttctgtattttatgccaaaaaaatttgtaagacaagtgagattagcatatacctcatattatgtgctatagtttgggtgctccagtatcttatgttttctggtcattgttcacttttagagttaaattttttaaactctagaaatattcatgcagaataggtcaggttctagacattatagataaccagtcttttgttgaaggtcattaatgatcctaatgaaagcagtttcccttgaatggtcgaagtggaaaccaaattgttaggaaactgacagtgaatgagaatggaggattcagatgggtgaaaaattaagagttcttgatgaagttgaagaatggctgtggtaggaaatcaggaagacatgagccgtaatgactcttggctatggtcagagaggagctaataaagatttaagaactggtttcgacccaggtagtgatctgaggtgtccccctggggtgggagagcctagtgaggtaggcagtgaagatcatgttagttgaggaggttgttaaactacaaggctagggtattgtgtgcatggacctcgatgtggctgggatgatgatagaatttggaggaaagagaaaaacactgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcatttcccatctgtacagtggagataacgataattgtgcctctaagaagaattgctgtgaagattagtgaaataatgcatgtaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaacccttagtctgaaactttaccaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtggtaagtaggtttgctaatttttcatttttgacattgtgtattgaaggttttctggtttagggctatctgagtaaagatgtttttgtggtacgtgcgttttgacagggaggtacacatgctgttgaaaagttgatttgagaagggaaaagtaagcactggctcaaaaataagattgtggagtgccagagaatgagtggtggcaaaaggtggttttctgacagggcataagaaaagctcttggggagagccatagaagcaaactcaggtaatactgtaaaacgggtctcaaattaagactctttggctgaagatgtgtttgaagcatataaataaatgcccactgaaagttctttggttagttctgataatccttagattaaaaatcaagaacattttactagacacaaatcaaaataattttcttctttttagggtgtgcaatataaagattatatccaaagtgagaggaatttgggtgagtacgttggtatttttaatgttaatttatggaaagactacaaagggaggtccatccatcctgtcatagcaatacaacatttttatatgccttttaaaaatgtattcttactagtttttcactagaaatcagaacttttctttgttaaaatagagtttttgccagcacttaaatattcttaacatttaacaggctagaatacttcattcattcatttcttccctctccatatccatttttgcctttttactattaagtgttgattcattaaaaaaatgaggcacaaacattaattttaaactttttttttaattaagaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaagtaagttactatatgttgctcattttgtgtggacagtgataaacatgttacccaataccaagaaatgcaagttcaatggaaggcttatgtcttattcttgtatgctgctcaacgtttgtgtaatagggtggaaaaaacaaatacttgagatttggatatgaatgaataattgtaacataatcagtgaaattctgaatagtactagatggtagactggaagctgagtcaggaggaattaacatgggtgtttataagtatcagtgttatagtgcagaagagaggaaaaagatacagtattttgttcatttaataaatagcttagttattgttacctagagtgaagaaaaagagaacttattttttaatggtttgagatatatagctaagcataaagttcaatgaatttgtatatatgagaatctaatcttttaaaaaataaatttgtctttaagcaattcacgtgcttctgagataaatttgaagaaactacaacatcttgagttgatggaagatattgtggatttggcaaagaaagttgctgtaagtggtagaatgtaggttcccccgagcccttggtttaaataatataagcatttatatggtgttaggctcaaatgactaatttatagcaattaacaggtaatggttttagttttggttaacctgagataaatctgctgtccatcagtgcgtgctcagtatttgagagatcagggagatggctgatgtcatggttctacgctggggaccaggactgcatcttgtcattaaaggatagaaattggaacttgtcacagaaagtggggtatgggttcatgaaaacctttgccacaggttctgaaagtgatgtgctctatctgttgatataaaatcacatcaccatcaacaaatattttgtctttgggtaggtagactttatcagggcagatttgaggaggtgtccttcattatgctattgagataagttgagagtttttgtggtttttaatttttttttgaaagctattggatagctttttaaatttcagttggttatggagtcaagtgttgttcttggtactattaaatttagaaagggcattctgatgtttattttctgcagtagttatttgcagtaacatacaaaccagtgtacctttataaaaaaaattaagtgcaatgaactttattattattattatttttgagatggagtcaccctctgtcgcccatgctggagtgcagtgacgagatcttggctcactgccatcttcgcctcccggattcaagcgattctcctgcctcagcctcccgagtagctgggactgtaggcgcctgccaccatgcccagttaactttttgtatttttagtagaaacggggtttcaccctgttggccaggctggtctcgaactcctgacctcagatgatccacccgcctcggcctctcaaagtgctgcgggattaccagtgtgagcctgtagaaacctcacctctactaaaaatacaaaaattagccgggtggtagtggcacgtgcctgtaatcccaggtagttgggaggctgaggcaggagaattgcttgagcctgggacgtggaggttgtggtgagctgagactgcgccactgcactccagcctgggtgacagagtgagaccctgtctcaaaaaaaaaaaaaattcacatgtctaaagattatactaagttattttactgctagaaccctattggagactattttggaattcttgtcttaagatcttaaggggtaacttggtcatgtaaatgcttgtcggaagtgtactactgagtacatatagtagtgttcctaaaatgtaggccatttttccgttagaaaattcaagtagaattgactgaataaggaaaaaatatgtcctttttttatttttcagaatgattcattccttattggaggcttattgagaattggttgtaaaatagaaaatgtaagtgttaaacactgaaactggcacagccactgtggatgagtggcagtcatctcactgctcatttccccttgcattgggtccatacactcaatgttctatatgtggtatttggtagtattgacttctatattttccttaaggagactcctcattttgggggtttggatcattttctctcttttttttttttttacccatgtacatagtgtaattttgagcctattttacaagttgattctttttctcttttagattatttacctggcttatgtttccccaaatgaaattattaggcctctggtatgaatattttttgttatataattactaggtaatctccagattcaatgttaaaccaatttttaatgatactgatgccataaacatctatgtttaccttaagcccattgttaactttaatttttgaagttactttagacattagaagtacaaataacatttctgtgaattcttgatccttcatggagatcactgcactgagtgcccatttgcccagccacatcttcctcttgttctttatctccttattcttctgtttgccacagaccacgtaaaatatgtagttcctttggagaactttaatctataaatttaaccttggggtaaggatggaagtctttgtgtagatgagatctgagaaccctcatccaccttgttatattgcacttgcctgctaccccaggcagtctggccaggttgtagacctcaaattgcaggtctgtagtaattgcagaagcatcttgagctctgagggtgcctgaagtcacctgaagaggtaacatatatgagtccatagtatctgttaatttatatgtcagagtctgtctactctaagttacatgccagagtagcaaaaaataagtggttgtaccagttttgtagtaaggatctgaaatacttgcataagatgaatttataatgccacatgcaaatttagaattaataaccaaagccccattcttcatttctcttttgaaacagaaaatcttggcaatggaagaagctctgaattggataaaatatgcaggcgatgtaacaattctaactaaattaggatcaattgacaattgttggcctatgttaagtattttctttactgaatgtaagtataaatgctttaaattgttacttgactcagtttttaaaggtgtttgggaaaatgagatatgtagttaagtgatttctgatttatcttagaatttaaaaaaagtttttattttgttatatatggctgaaaaagagaatttcttttttttattatttatttatttatttatttatttattttgaggcagattcttgctctgttgcccaggctggagtgcagtggtgcagtctctgctcactgcaagctccgcctcccgggttcacaccattctcctgcctcagcctcccgagtagttgagactatgggcgcctgctaccacgcctggctaatttattgtatttttagtagagacagggtttcaccgtgttcaccaggttgatctcgatctcctgacctcgtggtctgcctgccttggcctcccaaagtgctgggattacaggcgtgggccaccgtgcctggccgaaaaagagaatttcaaactggtagttttattctatattttctgtcttaattatttttatgacattgtactttaaaaattttcactgaatggatattgtaagttgttatatgtaatactcaaagagaccacaactgggtagtctcctttgtaagaaaaagtcactgaagctaagcttatgatttttattttcttcatgaatctgttgttcttttatgtatgaggtaactgccttacatatttcttttactttgtgaaatatttttctttaaagcatttgaatattagcagtgtttttatagtatagttataggaatcttgaaacaggaaaggtttggcttttcagtagatgatgaccaataatttaccatctctgctgagataaaggcaaattttgcactattgacttaagtgctagaaaggaattaaatgaagacacatctttctcataggtttattagacactggggtgtattacactgatagaggttgttctcttcattgttttggaggcccttaattataagctagattttatggtggaagtagagaagcagtatcttgtactaggtacacctctttaggcttatagctgattttttacattctattttctttataatagctctgcaaggtggctgttactatctttgttttagcagtgagcacactgactttgagaggttaagtgttgtttctgcagtatagtaagtagtaggtagtagtaggtaagactagataagtcagatctctctgatctcaaagcccaggttttattccatgtaatcttactctgtcccttagaatttctttatttggtgactttcttaggtcctttattgaatcttaaattttaggtgctcttttcactttagaaatgaatatgtttggctagaggcttaactatagttttgttgcaataaatttttttttgccactttaaaatatcctttttatataatagcttacaatgtagaaaatgaggcccgataaactttagttacttactgcatcttaattagtttattaaatttttataataatagtgtttcaaataacttctcattgtaacattttactcatgagagtcaaaatactaaataaaaacttttgaaagtatttatttaaaatatgttgagcatcaaaaatccaaaatctgaaataccccaaaatttgaaaccttttgagcttcgctatgacattcaaaggaaatgctcgctgggcgcggtggctcacacctgtaatctcaacactttgggaggccgaggcgggtggatccacgaggtcaggaggatcgagaccatcctggctaacatggtgaaaccccgtctctactaaaaattacaaaaaaaattagccaggtgtggtggcacatgcctgtaatcccagctactcgggaggctgaggcaggagaatcgccttgaacccggggaggcggagtttgcggtgagccaagatccatgccattgcactccagtctgggcaacaagagtgaaactccatctcaaaaaaaaaaaaaaaaaaaaaaaggaaatgctcattggagcattttgaatttttggatttgggatactcacccagtataatgcaaatattccaaaatccaaaattatccaaaatccaaaacacttctgatcccaagcattttgaataagagatactcaatctttatattaaatagattgtagaaagtagttttgcaggtttttgttttcatgcatttttattgaatattgtgcatggtacaccatacatgcttgacagtgtttattgaattgacttaagtaattatgtggcctatttggaatatgttatgacagagcatttattgtaaatacaattacaactaatataataataaataaaggttttttattgctagaaataaaaggtgagattagattcatagcaagcaataactgatgttttctgcaacattttatcagtttatttttttactgagttatttaatagacataaaaggttacaagaaacatgtgctatttagaaagaataataatataggaccgttgtggactcacctaactcaagaattagaatattatcaataccaatttgtttttttttaaacaaatgttctctcttgctctctcctaaaaataaaatttagacaagtaccacataactaaaattgtaatggaagactgcaatttgcttgaagaacttaaaactcaaagttgtatggattgtatagaggtgagaatgaatattataaatatattttaagatttgcccattagaactttttaacactcagaggaagttaataaaactgctgacaatatacaattcataaaattggatgacatatttgagggaaagaactaatatcttgatcagagttctctaatgatttaaaaaccattaattgaaagtgaaaatttggtttttaaaaactttagtctttaatgagttgaagaaatatgattttctttggtaacagctgagatgtaattcatgtgctacactgttcattcataggaaataggactttaactcaattttataaaaggaatttgggaaaatatttaatgttgtattgaattccctaatgctgttgatatgatgtgatttagtttatttttaaaaaattgagtgttcgaaatgaaaagttttagttttttctctagcacctttcatatatattctcgttaacctaccaactcatgctttgcaattaatctaatcagcattgcctctatgttattgatttatatatgtttttcggcactaaggctttttgaataacatcacatttgctaacctaaagttaaaattctactttgcatctattttttagccttatagataaggtatatttaaaagtgggtctgccaaataccgcacaaaattttagcaattattcataaggtgatggttttgtttactttttaatattctctaacaaagttagtgttgagtcattcaagacaggtttatttaaatatatataccgaggctgcacatgatggctcacacctgtagtcccagtactttgggaggtcgaggtgggaggattgcttgaggtcagaagttcaagaccagctggggtaacatagcaagacctggtctctacaaaaaatttttaaaaattagcttggcatggtggggtgcacttgtagtcctagctacttgggagactgagatgagaggatcccttgggcctgggagatggaggctgcagtgagctgtgattgcaccactgccctccaacctgggtgacagaccctgtctctaaaaatatgtgtgtgtgtgtgtgtgtgtgtgtgtatagtgggtgtgtatatatatatgtaacaaaatattgggtattgtaatctcattttctacataaataatcccctatgttatttctgatatcgaagatagaaatccagatccatttttactaggtattgggttcttgatgatttttggaggtcattgatgggtcttctttcaccttggtttctcaggaaggagaactaatgaaaatgaaaggaaatgaagagttttccaaagaaagatttgatatagctattatctattacaccagagccattgaatataggtaagagcaaatagaacaaaagagatgctttttctatggcacatcaagttagaatggtagtcagaagaaataaaaacaagacggagaattggagagtatcttccaacttgtgcagaatagattttctcatccttgggtgttggaagcattggagatggcctgggtatatgaagctaacgtagtagcataactcaagcaagtcaggcaaaatggtgaattttctgttccattttctttaaaactttccagtacagagttacctcttttgtcttgttctcattttgctatcaaccaagtcctcccaagttattaactggtcaaaaaggattaaaggattagttcttaatagttaagatgccacccattcagggttttttgctttctaagagggaacttttacaggataattgagagaatgcatacatgctctctaccttgtcttctctttgctcagctgctagaattttgtagctttcctccagatgtgcctcataactgtgcgcctattgtctcagtcaggccgcctaatattgtagcagcctttgaagggtgctctgtagccactgctctttttcctcccttgtgcatctccacagggaatgagggaatccggttagtgtaccacctctgagaggctgctgccctattcttttgaggaagaagtggaggaaagggagatacgtttcaccacacagtcagataaaactaaaaaacaaaagttcaaatgaagctattttaatttgcaattactgtaggcttcctttctcagttctttgtcaaaacgacatagtcctgacttattatataagtaatcctatcctctagagttactctgtagtttgctagctctttaatatgtctcgtttgatcccccaacagccctatgagttagagcaactagagttatcttcattttgaatatagggaagtttaggttggttcaaacaaagttacttatgtaagaagtgaaggaacggggacttcgccagttaagactccaggtcctatattctttttgctttgccacacatatgtaaagtttaaaaaaagttttctcatgccttatgttttctacgtgatttttatttgtttcatgtgtaatgtgctttactgactaaacattgtatctttttaagacctgaaaactaccttctttatggtaaccgagctctttgttttcttcgtactggacagtttaggtaagttggttaaaatatctcaaccactgaattattatgctaaatacccatttttgggaaacgtttctgtttttcaggtatacaagaaaatccttgactggttctttggcagaaatacttaagtggttaaaagagtatgcttaggctttatatataataacaacagtgacagcagcagctattctgattgagtgcagacatatgttaagcattattttaagtgctttgcatatgttatttggttctcacagcacccgtaataggtaggtaatgttatagtccacattttacatgaccaaagtgtaccactagtaaatagtgataccaagatttgaacacagattttatctgatgatgtcaaagtctgtgtttgtggcacctatattacctctttatgctctgttaattaatccatatagtataaaagaagcattttcatcttttctctgtttatcctggtataaaaaattaagtaaatatccttcataagtgaaagaaagcaaataaatttaatattatgagagtggagtcataattaattccagttccttatattgaatttgagctgagtttttatttattagctaagaaagatttagagaaagatactgcaccatgattttattgttccccagtataaaatttttagaacataaattatatatattgagcattaatattgagcaggtagactattatatttaattttgtcctgccttactgtaagaaaggtgtagggtgaattcaagaatacatccacacagtagaagaatattcaaaataaaacaaaccagaaaacgaagttggaatctgggattctcagaaccaagctacataggcataaggtcctgcataggtattagttataattcatatttgcctctgaccttcagctacccaaaatgaaatgggaaaacttgacaagttacttaattctcattgtccataaagaaacaggacaccaattggtcaggtgaaacagttttcctagtatttagttttgaaagaagttggggctgtaatattaattgagtgatggagtagagaataatctcagcagtatcttatgcatagcaaaaaactccctgaaagcacagttttgggtttcacaaatactttttttgtgaagttttctcatgaaagctgagagtctgctatcagttgtttttcagtgaaagcgcttgtatgggagggtgggagtggggaaggtagtaaactctaagcatgtagctttaaaaataacatttattgtgtttttcttttattgtaaacagaacacattctcatggtagaaaatttggaaaatacaagagtttaaaaagaagaaaataaaaatcaccagtaatccaaccaccttggagaataccgctgtattaacgttatgcagcttttagatggcttaagccgtggataaaccgaggctatctagactagaggaatggatgggcttgacacagtcttccatcaataccactgtcctcaacgggttctgacaagaaatgagctgcacatgtctttaggttattgctactggctaggtccagaattgcatttattttgtgctgtttgaaggtgaatttgtatgctttcaagatcagatgaataggttggcaacttggctagcctcttgtgaaaattgaggtgcctgtctgaaatattgcctggcagaaggttttccactttccacttctgagagctgagaggcacaccagggtgtttctgctctctttcatgagtgttgaatgctagacacacaaggaagatccttctaataccttgctgcaacaggaggtgaatcagagtagaagtacagaagctaggtagtttggtgaggtaaaggccaagagcagcttgtggatctatccttgtacctccttgctgatggtctagcttgtggtttaataccatctacatttcactaaagccaggtcagcagcattgttcctttgtttcttattaggcaatcaccaatatatattggatgcctattttattcacgaagtgttttaccacactggttttgctggtgtttcctacctcctcacacattgtctatatgatttgctcagtaatgtagggataatgttttcagagtccatagtatatataactcctgatcaggtgactagatggtgtgacttaaggaaagaacacgttgccagtaattcagatgtgccattgacacaggaggacccatgcctgagaaagacttttatctgagttactgagattaagatgttttgaagctcccaagcagagggatgctggatctgctgtggaaatctggctgagcagctgcagggacagctgggggtaaagcatccaccctcccccagtttggcgaggatgcactcctcagctgttctggaaggccagacttcttatctgctgtcattgaagcaagaattgagatgtccaaagagaacagaaatgggacaatttaatactagaaaggaataaaagggttaaagtcttgaatgctaaaacttctgaaataattaatttatcctgaaagattagaaaatataagttgaaactttaaatgaaaaagagattcaatttaaaaaagaactttggcaagattgatatctaaaagggtaaaaataataatactgtatcttacaacatggttatcactgttctgagcatttaatgtgtattaactcgtaaaaccatcacaactacgtgaggtaggtgctactgcctttttacagatgatgaaacaggtatagggaggccaagcaaagtgtctgaggacactaggtggatgtgatggagccagaatttgaacccaggcagcctggatgtagagtctctactattaatcactatgggaaggtggtgatagaataaaagggaatgtgaaagtcgaaaaaattaaaaaataaatggtctaaatagtcaataaacgtttatgaggaaatgattatccttccaggacatgtagattaaaaactacgagtttctcatttatacccatcagatggacaaaagcttaaaaatctcataataccaagtgtttgagaggatgtggaacaaaggagactctcatattcagctggagaaagtgtaaattggtacaatcactttggagagcaatttgacaaggtgaagatgtgcatactctgcaacccacttctaggctcatatcctctgaactctcaaatgtgtacccaagaagatatgtacatgccttcatgatagcattgtttgtaagagtaaagaaatgaaaacgacctaaatggccatcaataggggaatggataaatatggtatattcatacaatggaattctatatggcagttaaaatgaacgcaatgttgagtgaaaaagcaagtcacagaatgatttgtacactgtgatgccatttattaatgtttaaaaacatgcaaaacaatatgcatatatacagactgtgtattaacaatgtttaaaaatgcatgggcatgttaaacacccggggagtggctggggagagaaggagggaaaagggattggagttgggaggggtggtacacggtgggtgtcaactgtaacaaactactacaaaaagagctgaagtatatggcaacatgttaatttcttgctaaggtggtatgccattggtacatgggtgttcattttgttaatgttctctgtacttttatgtatacttgaaatatttgataaaaagtaaaacaaaatgtaattaaaatgcacatgataaaaggaacagaaaaagaacagaaacagtgaccactaaacatcaaggataaaatagtgaacaatgatcttgaaaagagaaatataagtattgtaaggccagttgcagaagcgtgaagtgtgcatggggaagcctgaggtgaggtatatatggggaaacagatgcttccttctggtggcagtggcagtgatgattttaatgccaaaatagtcatacagtttgtaaatccaaccacttttgggtgaatataagttaggccaagagcctttcaaaacccccctgggcctgcgaatgttgcgcttggaaaacgcaggagatggggttggaatgaggcaggggttggggaactgcgctgcctcctgcgcccccactcctgccgcagcctctccccttcaaatcttcacattgaggattgtgtttatcccaggacacctggcttagaagatgagatgtccgttttattctgctccttctcaaagtgtacttttcaaatatgagttggtaactatagggcatttgagagtgatcattgtaattatagtaatcagaacttttcagtttagtcaagaatctggacaaaggaatcagtcatatctgtaccttctgcagttccaacagcttatgtaatgtacatgattaggctttgcccacttagtgttcagttcattcttgtgagactcgtggaaaattcagattcttcggtgggatgtgatgaactgtgtaagggcaaatgttaattggagaaagtgaatgcttagcttgaatcgtttttgaattgctttggaaactcatgtatttttaaacttggtgtttacttgaactgttggtattcatttaagtatttacccatcacatgataactgccttccatcagatcccaactgtgattggtagcagacagatagactttaactaactcttctcttgttgctttttttcccccctaaatttctggaagactagagatataaagcactgtatgtttctgtgagaatttcacaaattcttgtgtgtgtgtgtgtgtgtgtgtgtgtgtgtgtgttggtttggtgaattattcctcactctgccctctggtgtgtgctctttatttttacttagaagccactgaatttgcttttgaagaaaacatttacttttttcagtcttctttggggtataccccctttttaaaaaaacagtaacaaatgcacatggtaagcaacagagtaggaaaaggtacactcgcccagctctgacccatcctctgattcatcctcttcagatccttgtgtatccccataatattttatgccctatacaagaatttatgttgaaccagatgaaattgccatttttgtaagtcagaatataggcagttttatttggtttaatgtaatgtatatgtctttttctttaaatgggtaggaacatactacatacactgttgtacatcttgcttttttttttacatttaagtcttggagcttgttttggatctgtatatagagacctaccttgttcttcatggctgcacagtgttttactgaatggattgcctatgtaatccattagtttgtattatattagtatatagtttatatatatatattagtttatattagtatatagattattttatttacaatgttaaattatagatatattagtatgtagatttccattttaaagattatatatacctatgcaatgattatctttttacttatgttttacactcaggttcaaatatatctgtaggacacatttctgataaatttattttactcatgatatatgaatgaaagaacatatcattttaattacagacactttttatttaaaatgtatgtttattcagtccgtggttattactcactgcatatttgtcagtgactgaccattatacctgaatcttgcttttgttccttagttggaagatctggaaacttggggaatagttgttatttctttattgatctggtcatatcctgaaaataattataattgaggaaaaaaggaatatcccttatatggcttgcaaaattcttgcatactttttatggtatggtttaagagagtcaataaatagcatctcctttcccttccaagtccagaatcagttaaaagatggatggaaaagacaggcaaatggtgatcaaatattgcctttattactgatgcaattggagaacaggccttaagtctgatagtcaaggggctggttactattaggttggtgcaaaagtaaatgtggtttttagaaataatggcaaaacccctaattacttttgcaccaacctaataattcacccacagtcagacagaactgggctcttgggaactttaagcctggaagaaaagggaatctggtgttttagattccaaagagtaaggccaggtgcagtggctcgtgcctgtaatccccagcacttggagaggctgaggcggatggatcacttgaggtcaggagtttgagaccatcctggtcaacatggtgaaaccctgtctgtactaaaaatacaaaaattaggtgggcatgttggtgcatgcctgtaattccagctactcaggaggctgaggcaagagaattgcttgaacacagaaggcaaaggtttcagtgagctgagattgcgccactgcactccagcctgggcgatagagtgagaccatgtctaaaaaaaataaaaggattccaaagagtgagaaaaagaagaggtgaagccatgtatgattagtgtccctccctcaccattagataaattattattcatcatctggggatgttagccaagggtggggagaggaaagagttcaggaataattagcaaatccacatggaaactaggggagagggaataactgttctttacaagcatcatcttttagggcagaatgtagcatattttatatgcagtaatggggaggggctggagaaataaaaacacttccctatgtaagagcaataagttggagcacctggactagaactctctttcttactctgtttaatactcaccatgtcacacagtcttcaagagtaaataaccgtttgcatctggagtcttgtcccattttcatacatctcttgcacaggggattgctgctaccaaaagtcaaacctgattatttagaccctgggctgcagtgatctggatgagcaatagcatcatgtaattgactatgcccacttgcctagttgtagatgtggtcatatgccagtaaatgtgaaattttaattagtattaatattaattgcattcatatactaattgtgatatttataatatatgctaattataacgctgtttgtagtgctatatattataagtaagttcagcattgattcaacaaatattggggttctgttgatggataatgtcagaaatgagcaaaaacagcctctgtgtttcagacagtgggctggcattgtgagggccttgtagtgggaaggaatttgttgcatttgtggaactgatagttgctagatggcctgaatacagaggagagggtagtatgttcataggctaagccaaggagggccttgtaggctgtgttaaggcttttggcctttaagagcaataagaaagtaaaggattttaaactgaggagagagagcatgattagcacttaaaaaaaaaatttgagcatagtgaaaatggatctgaaggggatgtagtgtggatgtaggttaggaggctgttgcagtagcccaggccagagatgatggcttccagcagaatattgacagtgggaatggaaaagtagaaggattcaagagtttagaggtgaagctgacagaagttgctcgtggttggtgttggaacttgagagtgaaggtggttggaactgttctgacgtttctgccttaagcagcatcatggattatgggcctactcactcacattgggattgctggaagaggaataaatttgtaggaggtagaactggacttcactctcggacactgaatcgaagtgcctttgaaggccaggcatggtgactcacgcctgtaatcccagcactttgggaggccgaggtgggaggatcaccagaggtcaggagttcgagaccagcctggccaacatggtgaaaccctttctctactacaactacaaaaattagctgggcgtggtggtaggtgcttctaatctcagttactcgggaggctgaggcaggagaattgcttgaacgtgggaggcggaggttgcagtgagccaaagtagcgccattgcgctccagcctcggcgacgagcaaaactccgtctcaaaaaaaaaaaaaaaaaaaaagaaagaagtgcctttgaagcatccaaattccaatgttgtgtaggtagtgagttatatgggtctggaactcaaaggagggtttggatgggaaacatgtttggaatagccagcctccatgatttgaagttgtagatgtgggtgagactgcttacagagaagtttttctcaacctggactgcactttggaatcactgaactttgacaaataccacccaccccagagattctgattcaattaacctagagtaaagcttgggcattgggcttctaggaactccccagatggtactaatgtgcagtcacggttgagacccactggcctagagagaacctaggctgagactaggagaggaatcaggattgagccttgaacacatatggccaattggagaaggatgagcctgcccaggagattattaagatgtgaccagagaggtggaacaaagactaagtgtggtgtcatagaagtaagtaaaagagtggtcagcagtgtctgttggctactgagaagccagttacagtggaacttagatttggcaacatggacatcattcactaaccttagggggagctgtcagtgggaagcttgaaacatgccaattagatggggttgagaaatgcaaggaaatggagacagctagcgtaggcagcttttaaaggtgtttggggagagagacccagggtgagtctctttaaatggtaaagaaaacttaccttattcaagagttccagaagaaggtggcactagggttgtatattcagtggctcaacaatgtcatcagagacttagatttttccagcctcagtgtgtgacttggtcctcaggctgtcccctcagaatgtaggatggctgctgtaattcagacatctttagcagaagaaggacaactttgtcttatgtcctttaaaaaaaatcttaatacacatgctgaaaagtatacaagtgttaagtgcagctggaattttcagaagtcaaacaactgtaaccagcatgcagatcacaaccccagtaccccagaagttcctcttagtcatgaccctcctcctagtcatgatccatctcctcccccaggagaactaccatcctggcttccagtggttaattttgcctattttagtacaatgtaatgaaataatatactatgtgttcttttatgtttggttttcagcatcgtttttgagatccatattgttgcatgtagttgtaaagtgttcatctattgcatgaatataccacattttatccattctattgttgatgggcatttgggtagcttctcctatttggcttttacaggtagtattgttgtgaacatatgtatttatttctgttgagtgtataattaaggagtggaattgttgggacagagggtatgcttatatgcatttagctttcctgtgtgattgtatcattttgtactcttacagcagcatatgagaatttcagttctgtgccctcaacacttactatttttcatcttttattttagacattctggtgggtgtgtagtggtataccgctgtgattataatttgtattttcataaattgattaaggatgtttcagattttcataaggttattgaccatttggatattctcttttgtgaagtgcctgttgaagtcttttgctatttttttctcttgagtagaatgccctattcatttttaggagtttttcttttgtattctgaatatgagtcattggtcagatatatgtattgcaaatatcttctcacattcagtggcttgccttttcactgttgatgttttcacaaacaagttactaattttaatgtagtacagtttatcagttttttcctctgtgataagctctttttgtgttctgtttatcatctttacccattcaaaggtcaccagattttctatgtttcatctaaaggtttaattgttcaactttgatgtacagatctgcagtccatctggacctggtgtttgtatttagtgtgaggtagtgttcaagattcatatgggccaggtgcggtggctcatgcctgtattcccagcactttgggaggacaaggcaggagaattgcttgagcccaggagtttgagaccatcctgggcaacatagtgggaccgtgtctctacaaaaaaattcaaaaattagccagaaattagctaggcatgatggcatgtgcctatattcccagctactcaggaggctgaggtgggaggagcgcttgagcctgtgatgtcaaggctgtagtgagagggactggcactgcactccagcctgggtgacagagtgagcccttgtttcaaaaaaaagaaaaaagatccatatggatgtccaattgacccagcaccatttattaaaagagtatattttctccatgtaccgcagtatcacctttgtcacgaatcaggtcattatgtgtaagaatccatttctagtttctctgttctattttgttggtcaggttgtctatccttatctagttggtttttttttttttttgtacgtaaccttttagtaggtattgatatctggtagtataagttatctagttttgttcttccttgtaatctctttaagagtgatgaattagcataaatatgaatgtgaaatgatgaaccagcaaatattaatctacgttgaaaaaagaaggtggataagtcagtgagttgggtaccctgaggagataggaacaattgaacaagttaaaatgggataagcaaggttatagtgagaggtggatacctgaattagtgattgaacagtttgaagtttgaacagttttgagtttgaacaccctaagttccaggggtgcagtgatgggtggctgagttgggctagaggtggaagtcattgaagataaggaagccaggaaactgatagactgtggtatggatctgttagttcttgataggttatgaaagtacatttaataatgtagtatctaatttaatatctacctcagaacaggttagaaacagtattatttacatttttacagatgagaaaaatgggcccagagatgttaataactcccctaatagccccccaagaaaattaagtgattaaattagacctaacctgggtcttatggtctagcttccatgcctctattccagtgtagcttaactgatgttgtgtgaaagacctggtagtgatacatttggaaagtcttactgacatgcagaaatagtacagaaaaacatacaaataggaatgttattggctgggcatggtggctcacacctgtaatcccagcactttgggaggccaaggcgggtggatcacaaggtcaggagatcgagaccatcgtggctaacatggtgaaaccctgtgcctactaaaaattcaaaaaattagccgggtgtactggcatgtgcctgtaatcctagctacttgggaggctgaggcaggagaatcacttgaacccgggaggcaaaggttgcagtgagccaagatcacgccactgcactccagcctgggcgacagagcgagactctgtctcaaaaaaaacaaaagaatgctatgcataggtacaatgtcgaaatgtgcaagaaatacttcagaaatattaaaagtagtttattcctgggtagttgtgattgttactctgggtgactttttccctttgttttatttttctgtattttccaaatttcctataatggacatatattatatggattttttttaattaaaattatcttttgactagataatatacatggaaaattcacaaagtacacatatgcaagatataatacttttactataaaagagtgaaaatttttaaatacttgtttttccttttagaaatgcactcggtgatggaaagagagccactattctgaagaacacttggccaaaggtaggtttcttctgtattttatgttggcaaataatgccatacaacattgtgaaaaatctgtttatagggtgtgtttgttcataaaaatgctatatgaaattacgtagagctccagaatgtgaaaggggagtcatcagatccatgatcagcgtggggacccagccacagcactgacaggctgtgcgtgaggccaggtggcctgtgggcatcttgagtcttcagggtgccttagtgattgagaggtcatctctgcgtattctgggtgggtgtgcctgaatgtgaaaaatgacttaaaactcgggaggaagtataggaggctgtctttataggaggcaggaaaagatttcttaacacacagtgcacaaatcagcagtgaagacaaccatcttgatatatttggctatatcgaacttaaaaacttgtgtatgtcaaaaggcaccatagatgaaatagtagtttgagaggagataatttgccacatatataactggtaggatttacagctggaatatgcacataattcctaaagtaaataagaaaccccgtagaaaatgggccagtaaaacaagtaagcatttcacagaagagtaatcctgaatggccaatagaaataagaaactatttcggtaggggtggagccaagatggctgaataggaacagctccagtctacagctcccagcgtgacatcacagaagacaggtgatttctgcatttccaactgaggtactgggttcatctcactggggagtgctggacagtgggtgcaggacagtgagtgcagcgcaccatgtgtgagctgaagcagggtgaggcatggcctcacggggaagcgcaaggggtcagggaattccctttcctagtcaaagaaaggggtgacagatggcacctggaaaattgggtcacttccaccctaatactgcgcttttccaatgggcttatcaaacggcacaccaggagattatatcccgcacctggctcggagggtcctacgcccatggagcctcgctcattgctagcacagcagtctgagatcaaactgcaaggtggcagcgaggctggaggaggggcgcctgccattgctcaggcttgagtaggtaaacaaagcagcccagaagctcgaactgggtggagcccaccacagcttcaaggaggcctgcctgcctctgtaggctccacctctgggggcagggcacagacaaacaaaagacagcaataacctctgcagacttaaatgtccctgtctgacagctttgaagagagtagtggttctcccagcacgcagcttgagatctgagaacgggcagattgcctcctcaagtgggtccctgacccccgagtagcctaactgggaggcaccccccagtaggggcggactgacacctcacacggccgggtactcctctgagacaaaacttccagaggaacgatcaggcagcagcatttgcgattcaccaacatctgctgttctgcagccactgctgctgatacccaggcaaacagggtctcgagtggacctccagtaaactccaacagacctgcagctgaggctcctggctgttagaaggaaaactaacagaaaggacatccaccaccaaaaacccatctgtacgtcaccatcatcaaagaccaaaggtagataaaaccacaaagatggggaaaaaacagagcagaaaaacctgaaactctaaaaatcagagtgcctctcctcctccaaaggaacgcagctcctcaccagcaatggaacaaagctggacggagaatgactttgacgagttgagagaggaaggcttcagaagatcaaactactccgagctaaaggaggaagttcgttaccaatggcaaagaagttaggaaactttgaaaaaaaattagatgaatgggataactagaataaccaatgcagagaagtccttaaaggacctgatggagctgaaaaccacggcacgagaactatgtgacaaatgcacaaacctcagtaaccgatgcgatcaactggaagaaagggtatccagcgatggaagatgaaatgaatgaaatgaagcatgaagataagtttagagaaaaagaataaaaagaaacaaacaaagcctccaagaaatatgggactgtgtgaaaagaccaaatctacgtctaattggtgtacctgaaagtgacggggagaatggaaccaagttggaaatatctgtaggatattatccaggagaacttccccaatctagcaaggcaggccaacattcaaattcaggaaatacagagaacaccacaaagatactccttgagaagagcaactccaagacacataattgtcagattcaccaaagttgaaatgaaggaaaaaatgttaagggcagccagagagaaaggtcgggttacccacaaagggaagcccatcagactaactgctgatctctcggcagaaactctacaagccagaagagagtgggggcgaatattcaacattcttaaagaaaagaattttcaacccagaatttcatatccagccaaactaagcttcataagtgaggagaaataaaatacttcacagacaagcaaatgctgagagattttgtcaccaccaggcctgccctacaagagctcctgaaggaagcactaaacatggaaaggaacaaccggtaccagccactgcaaaaacatgccaatttgtaaagaccatcaaggctaggaagaaactgcatcaactaacgagcaaaataaccagctaacatcataatgacaggatcaaattcatgcataacaatactaaccttaaatgtaaacgggctaaatgctccaattaaaaggcacagactggcatattggataaagagtcaagaccgatcagtgtgctgtattcaggaaacccatctcacgtgcagagacatataggctcaaaataaagggatggaggaagatctaccaagcaaatggaaaacgaaaaaaggcaggggttgcaatcctagtctcagataaaacagactttaaaccaacaaagatcaaaagagacaaggccattacataatggtaaagggatcaattcaacaagaaggaactaactatcctaaatatatatgcacccaatacagggggcacccagattcatacagcaagtccttagtgacctacaaagtgacttagactcccacagaataataatgggggactttaacaccccactgtcaacattagacagatcaacgagacagaaaattaacaaggatatccaggaattgaactcagctctgcaccaagcggacctaatagacatctgcagaactctccaccccaaatcaacagaatatacattattttcagcaccacaccacacctattccaaaattgaccgcatagttggaagtaaagcactcctcagcaaatgtaaaagaacagaaattataacaaactgtctctcagaccatagtgcaatcaaactggaactcaggattaagaaactcactcaaaaccgctcaactacatggaaactgaacaacctgctcctgaatgactactgggtacttacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaaaagaactagagaagcaagagcaaacacatgcaaaagctagcagaaggcaagaaatatctaagatcagagcagaactgaaggaaatagagacacaaaaaacccttcaaaaaatcagtgaatccaggagctggttttctgaaaagatcaacaaaattgatagaccgctagcaagactaataagaaaggagagaagaatcaaatagacacaataaaacatgacaaaggggggatcatcactgatcccatggaaatacaaactaccatcagagaatactgtaaacacctctacgcaaataaactagaaaatctagaagaaatggataaattcctcgacacatacactctcccaagactaaaccaggaagaagttgaatctctgaatagaccaataacaggctctgaagttgagccaataattaatagcttaccaatcaaaaaaagtccggaaccagatggattcacagccgaattctaccataggtactaggaggagctggtaccattccttctgaaactattccaatcaatagaaaaagagggaatcctccctaactcattttatgaagccagcatcatcctgataccaaagcctggcagagacacaacaaaaaaagagaattttagaccaatatccttgatgaacattgatgcaaaaatcctcagtaaaatactggcaaaccgaatccagcaacacatcaaaaaggttatccaccatgatcaagtgggcttcatccctgggatgcaaggccggttcaacatatgaaaatcgaataaatgtaatcctagcatataaacagaaccaatgacaaaaaccacatgattatctcaatagatgcagaaaagtcctttgacaaaattcaacaacgcttcatgctaaaaactctcagtaaattaggtattgatgggatgtatttcaaaataataagagctagctatgacaaacccacagccaatatcatactgaatggacaaaaactggaagcattccctttgaaaactggcacaagacagggatgccctctctcaccactcctattcaacatagtgttggaagttctggccagggcaatcacgcagaaggaaataaagggcattcaattaggaaaagaggaagtcaaattgtccctgtttgcagataacatgattgtatatctagaaaaccccatcgtctcagcccaaaatctccttaagctgataaccaacttcagcaaagtctcagagtacaaaatcaatgtgcaaaaatcacaagcattcttacacaccaataacaaacagagagccaaatcatgagtgaactcccattcgctattgcttcaaagagaataaaatacctaggaatccaacttacaagggatgtgaaggacctcttcaaggagagctacaaaccactgctcaatgaaataaaagaggatacaaacaaatggaagaacattccatgctcatgggtaggaagaatcaatattgtgaaaatggccatattgcccaaggtaatttatagattcagtgccatccccatcaagctaccaatgactttcttcacagaattggaaaaaaactactttaaagttcatatggaaccaaaaaagagcccacattaccaagtcaatcctaagccaaaagaacaaagctggaggcatcatgcttacctgacttcaaactatactacaaggctacagtaactaaaacagcatgttactggtaccaaaacaaagatatagaccaatgggacagaacagagcctcagaaatagtgccacatatcctacaacctatctgatcctttggacaaacctgacaaaaacaagcaatgggggaagcattccctatttaataaatggtgctgggaaaactggccaaccatatgtagaaagctgaaactggatcccttccttgcccttatacaaaaattaattcaagatggattaaagacttcaatgtttgacttaaaaccataaaaacccttagaagaaaacctaggcaataccattcgggacataggcatgggcaaggacttcatgtctaaaacaccaaaagcaatggcaacaaaagccaaaattggcaaatgggatctaattaaactaaagagcttctgcacagcaaaagaaactaccatcagagtggacaggtcaacctacaaaatgggagaaaatttttgcaacctactcatctgacaaagggctaatatccagaatctacaatgaactcaaacaaatttacaagaaaaaaacaaccccatcaaaaagtgggcgaaggatatgaacagacccttctcaaaagaagacatttatgtagccacagacacatgaaaaaatgctcatcactggccatcagagaaatgcaaatcaaaaccacagtgagataccatctcacaccatttagaatggcaatcattaaaaagtcaagaaacaacaggtgctggagaggatgtggagaaataggaacacttttacactgttggtgggactgtaaactagttcaaccattgtggaagtcagtgtggcgattcctcagggatctcgaactagaaataccatttgacccagccatcccattactgggtatatacccaaaggattataaatcatgctgctataaagacacatgcacacatatgtttattgcggcagtattcacaatagcaaagacttggaaccaacccacatgtccaacaatgatagactgggttaagaaaatatggcacatatacaccatggaatactaagcagccataaaaaatgatgagttcatgtcctttgtagggacatggatgaagctggaaaccatcattctcagcaaactgttgcagggacaaaaaaccaaacaccgcatgttctcactcataggtgggaattgaacaatgagagcacatggacacaggaaggggaacatcacacaccggggcctgttgtgaggtgggaggggagagggatagcattaggagatatacctaatgctaaatgacgagttaatgggtgcagcacagcaacatggcacatgtatacctatgtaacaaacctgcacgttgtgcacatgtaccctaaaacttaaagtataataataataataataataataataataaagaaactatttctatttcctagtaattaaaattgtagggatttggtacacagataaaagaatgaaaccaatagtgcagaatagagggcctccacacagaacccactatgtgagtaaatattacaatgtcatattgtctgagtccttcagattggcagaaattaaagaggctgatagtctggtgttggtgggtatgtgtagtaacaggaagccccagtaaactggtgggagtgtgattgcttacaaccaagtcagggagcactataatagactccacagttacttgattctgagtgtgtgtgctctagaaaatttcttgcaaatgtgcacatggtttgatatgcaaggttggtcattgcagcattgttttaatggcacacaactgcaaatacctacatgtctattgataaagcagcagataaatgtggtattttcacttgatcaaagttgttactctgacctgtgtgatctgtccccgtcttgaacacttgttgtttctccaacctcactgctcctgctctgtccctggttcactttatcttggcctcttggcatcctcactgttcctcagacattccaggcccacttccactttgtacttgcccttccctctgcctagaatgcttttccccagagcgttggccagcccccttatttcttttcagtcgatattgaaaggactcttctcagtgaaacattccttggcctcattactaaaatgccaaacacctcacttcctacgcatttcttatcttctttccttgctttacttttttcttcttaggacttaccattatctaatacattatatctactgtttgagttatagtggctattgtgtgtcttccagtataatatgagctccacaaggaaagatttttttggtgtttggttcacttcactcttgaatccagactgtctgacaagctgcctgacacttacttagcaggcactcattagtaaataattgttgacttagtgattgaatgaatcaaatagtagattgcagttgaattagctggcttatcaacatttatggattttaaaaagttaaatgaaaaagtcaataaaacataggctggaaaaatatctatcgagttcatgatagtgtttgcttctgggcagtaagagagggaaaggagattggagagggtacaaaggagatttcagccatatctgtatcatcagaaatagttttatttatttcatttaaaaatcagaagcaaatataacaaaatgttaacagttaattctgggtatctgtgtattagtctctgtattttcctaaattataaaaatattttttttttaagtgaagctttagatgccaggcatgatggctcacacctgtaatcctagcacttcaggaggctgaggcgggcagatcacttgaagtcaggagttccaagaccagcctggccaacatgtgaaaccccgtctctacaaaaaaattttaaaaaattactggatgttgtggtgcattcctgtctagctactcaggagtctgaggcaggagaatcacttgaacccaggagatggaggttacagtgagctgagatcacaccactgcattccagcctgggtcacaggtgaaactccatctcaactaaaaaaataaaaataaataaattttttttaagtggagctttaaataagacatagaaaggcacatgtatttcatacttcattcctggttttacgtaatttaaaaaaagctagtgcaagtagaatcagaatttgaaggccttagggaatttagtctaatttgatacttccattactgctctgcggatagccttcattagattaattgtaggagtttattttgtttaatttttttaaatgaactttatattataaatatcacatgattaaagagaaaagtagaatatagcaaggtataaagtaaaagggaaaagtcagcctggagaccttgtttaaaagacagatttcttcgcttttcccccaaattgtgattcaggtggcctaggaatgtatctaggagtgtggagattgtaaaattccccaggtggacttctgcatccagattttagaatcattttttaaatgccttattttacacatgaagcaattgagtcccagagaggtagagtgatttttgcaaggtgtcattgcaaataaaagacaaaactggtggttctgtttgagggtgaccagtttgttggtattttcattatggagtcattcttttgcttgaaacaaaatcctttgctggatcccttgaacctggtgtttgacaggtgcctatatcaatatttgtaaaatgaatgaataatggattagaattccaaatactgaaacccaaaccatgatactggttttcccagaaatacttcctgctattttaatatattatcaattaagaaaaacagttattaaaactttttgaagacctggcgctcactcctgtaatcccagcactttgggagggcaggacgggcagatcccttgagttcaagaccagcctgagcaacatggcaaaaccatatctttacaaaaaattagttgggcatggtggcatgtgcctataatcccagctacttgggaggctaaggtgggataatcacctgagcccaggaagtatgaggctgcagcgagctatgattgcgccacttcaaaaaaaaaaaaaaaaaagaaaaaagaaaaaaactttaacaattattttgagaactttgtggagaatacttgttcctggcttagtttcttaaacaaaatattcacttttttttttaaattggaatgtttggtgatgtccaaacatcccttctcaggggatactctcttttgttgccttgtattggtgatgtgtcgtatgattgcagaaatatttgtatagataaaaacatataaccactagtaagtattttaaaaatttggtaactacataactaggttatttttcttttttttttaaaaccagaaaagaatgcttattaaaggataaacttcaggagcaaaagtagatcatacagggtatatttacttttataagattgccttactttagaattaattatgagcctgagtctatggagtcatacctctaagatgtaagtgtgttagtggaatgtattctgtagatttctatgtgagggtaggacatttttttccttcttcttaatggggaagattagtacagtgctacctgtctctagactcactttcaggatttagaaagaatgagtcatttgtcctgaagagtgagaatttttcttagcctcaacagatatgtttgtgcaggtctgtgagcattgtgttttgatctatatcatataggatacaaactaataacctcagaaatgtcctcaagaacatttaaattttgaggggcgcattaggacttttgttgtgaatgacagaaactgaactcagatttgatttaagtagaaaagggaattaattggctcatgtaactgagaagtctaggggttagcttcaggaatggttggatccagatttgtacacatctttctttcattttctcaactttgcctccctgtttgtcagcttcatgtttagtcttttttctagcttccctctctgatttttacatggattctcttgttatgtcttcaagctcacccatcttttcttctgcagtgttttatctgcctttatttccatccaatgtacttttcatcttaaatgctatagttttcatctctagaggttaaatttgggtctttcttgcatatttcatgtctttaacatattccatctttcctttcacctcttgaacacataggggatagttataataagtatttcaatgtccttgtctactaatctgtgtcatttgtgggttgttttcagttggtttattttgctgttcattataggtcatattttcctggtaattgtagatggatgccagatattgtgaattttaccttgtttggtgctggatattcttgtttttctttaaatatgcttgatctttgttttgggatgcagtaaagttacttagaaacaattttaattcttcaaggttttaagattttttttaggcgggactatagtggcatttaatctagggctaattttttccccactactgaagcaaaacttttctgagtactctacttgaagtagagaattcaccccatgaattatggtgtttttcactcttgttgataggaacaggaattattcctgatttgtttccgttccggctcttgttccctgttaacctttcaggttgttctttccctggctgtggaccgttgtcccccagggatgtgctgatcagtacttagctgaagactcaaggggtccctctggagttctccctgtgtgcagctttctcttctctggtcctctgctctgtgaactcagctgccttggtcctctgtactcccgcttctgtctccttaactgagagaggctgccagtctctgcctaggttttctcttcccatgctctggcttagagacattcttatcagtaagcgggatcaatcacagggcttactttatatgtttttcatactctcttttgttgccttgttttcaatgtcttgcaagctgtggtttcttatcttttgtctttgttttaggtaggagggaaaaatcaagtccttattacttcattttggtcagaagtggaggttagagtgtaggcgctcttggttttatttttaaaaagacttttaccatgtagtgggatctgcaaactgatgtcatgagtagctgttaattctaggaaaaggagaccctctctcagtgtgtgtacagtagaccttagggatgcctcagactgattctgattgagtcatgtgcccacctgtggatttattgctttgacctagaaagtagtgcatttcaattggccagtctcctgggttacagccacacttccaccgtgccgtccattgttgggtggagcactggaactgacagtcctgctgttactgtgagagtgggaacatggtggtctcctaagtgaggggagactagagagatgagcaagagggaatttccacatgtgtgatagagaatgagatagtgaaaagacccttttattgtaattgggtttcagaaactctgagatacctttaatttaagcttcattgaaataacttcagtagggaggtctgaattaagtcttttctcaactaacaggagttacattatgttttatagggttcagggaaaaggatccaataaaaggtgagaaaagtatggagaaaagagaaagaaataaagttctctgcaaatttagtagatttggtttatgatctatcattatttcttatgctagctgtgggttttttaatgcagttatttaaactttgaagtccgtaaatgcttaggggataggatttgaccttgtagcctatctgagagatgcctttgtcttcttatactttaggtgtcaggaagcatggcctataccctttcagcaaaacagagtttaatgaaatgccatatgaattggagtctgagctaagcccaaatagtctgtctaaaaaaactccagaacctttagagccacacggtaccccagagcaggattacttatggtaaacctgcataaacacgtacccacgtaattgtttctggcttcttgtagtgaaaagctgatccttcttaaaagcgttgtttgttttttatattttctcctagattttcactgaatcacagtgttctttgtgaaatgtgtagtgaagaggaaagagctttggaccaggtgtcataaaaatcagggttctttggtttgcctcttaagtaagtgtgatattaggccagtttctagcctctagcctctttcactagtaaatcaccttgccagtagtactgtgcctaaaatgggaatttggtttgggaggagctagaagcagggttggttcagttagcttcaggttttggtactgttagctttgtagattaaaaagtttatacttaatatagaagatttccaaaatatgtaaatggaccagcaaagattttggttctgtagcaaaaaacccttatcattggaattaaatgtaaatccctggtttttggtttcttaaagccaggagctgcacttagagataacaatgaaaagctgagtgaaggggagacggctggatggaagatctagcctgagcacatcccccatctgtctgcactcttcggaggtatcggaaaaccatggcacaggcccatggttccatccagctctaaaaacttctcgatttccaggtgtaggaaaggcgatgacttagagattgttactgccttcaaatatttttaaaacataaagttatttataatgaatgacattttttactttatctggcacaaaattattatattctctgttagcaaaatataacaaaagttgaactctgctgggggtacagaaatttcttaagcaaaaatattgatccttagttattgtgattatttgtgtatttataacttttcacttagctcattaggtaatgttatttcctgaggtattaacattttacatttatttttcattggtagggacctaatctaatattttaagtaatgaatcagttttcaagcaaaacatttttccttacctgttttctttaacttaagcatatttttgagaaaaaattaaatttatctttttggaacagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtatttcacctaagattcttttggttacagtcttaattccctttcaaactttggagggtgggtttcttggattaacagaggaccacaaatcaatcctcagatgatttatccttattttatcatgttatcttggtcatggcacttgagtttttcatttctatctgtgtagagttacatgttatccattaagtaattataaatgatttgtactttttatttgaaacagacagcaaccaaattgttatttattcctctgtagaaaaaaaaatccctttcagaaattttgaataaaataaaagcttttttgaaacaaaattatttaaaaatatttccttcattgctaaagttatttcctaaagaaaagacccttcagtagagctgcttgatgtttccgcaccatttgtgctaattctgcagcgtgctgatatatatatatataatatatatatatatattatatatatatatataatgttttttatatatatagcagaaattggctgtgcaggctaggagttgtagattttcattctctccttgttttctctcctaagtctttttgctttctccaatgcctgaaagtcccttagtctacatttttagtgtatgagtctttcctgctttttcttcttcgggttgtacaaagctgagctgaacagctctgtttgaccggcagatgttgttatccatcataacatgattatgtaataagatggtgagctccttgaagacaggtgccacctttgattcagatttacatattgctgtcatcttgtcaatgatcacatgtgatggaatgtcagacaaagtttgtgtaacattttgttgacaccatcctaaaactaaagacatctagaaatgtaaaattgcttagatttacttttcagttttctaaatttgaggttccttactatcagcttaaagtaaatttgaaaatcttttaaagtctgtgttgccaatccattgattactatgtgtgtgtgtgtgtgattgacttttataggtcgaacagcaaataaggatccaattaaagccttttatgaaaacaggtaagttaatagcaggtcagtagctgctactactaggaatggctttgctgcatgaatttaagaatcacttatgtttgacgctttaggagctaatagcaaccacagtaaagttggagatggaaggaagagaggtagttttttaagtgtccgtgttatcaggtgacctgtaagttgtcagatttatttcgctgttttagtgaaccatatagatataagctcagtagcctaatcctgtgggaaaagaggggtgaaatgttaattggacattactatgcttggatgggaccagtttggccatgaaactcctggcagcacagagctaggacatagcctgtgccctgtgcccttcacctctgtcttggaagtatctatggcaaaaaccacaattacttttgcaccaacctaatatttccagcttcctgatgtctttcaaaggctaagatacttcctattagaaataggcaacagatagacttgagtatgctcacaagaaagcaatagcagccagggttctacctttacttatttggcaattaaaacagattaaatgtttttctgcattcttgttcagatgtctgggataccgaagctgctaattctgtagcatgctgaacatgtagacataaagaaattggctgtggaggctttaaatttaattttagtatcctaatttaacttaacttaggatatttaaatttagcacaaggtcataggtatttttttttttttaatttttttgagacggagtctcactctgtcacccaggctggagtgcggtgttatgatgtcggctcactgcaacctctgcctcccgggttcaagcgattctcctgcctcagcctcttgagtagctggggccacaggcggctgccaccacgccgggcctgctagatttttgaatttttggtagagcatgcaaggtttcaacattttggccagactggtctcaaactcctgacctcaagtgatccgctcgccttggcctcccaaagtgctgagattacaggagtgagccactgtgcccagcctgagccactgtgcccagctgatatttaaatgttagaacgcagaatacttctttttgaactgttcttttttttttttttttttttttttgagaacagtctccctctgtcacctaggctggagtgcagtggcacgatcttgggtcactgaaacctccgcctactgggttcaagcaggtctcctgcctcagcctccccagtcgctgggattacaggcacatgccaccacacctggctaatttttgtatttttagtagagacgggggtctcaccatgttggccaggctggtcttgaactcctgaccttagctgatccacctgccctgggctcccaaagtgctggaattacaggcgtgaaccactgcacccagcccttgacctgttctttattattttgagtttaatgccaaatataaaataatgtttatgtataaagccccatctcacaggtaggaaatctttttaaaacaataataccttgctttcaaggaaaaaaggctgtgattgctgcaacctgttcattcaaaggataactttcaaaaaatgtataataattccttttttcccccacttagggcctacacacctaggagtttatcagcacctatatttactacttcacttaactttgtggagaaggaaagagatttcagaaaaattaatcacgaaatggccaacggtggtaatcagaatctaaaggtaagctccattgaaaactacagtttttttcaaggatagatagtctcatatttttacagtaatattttggtggtaatagaaaccaaatttttggcgatttgaaccctttttgcctattgttactgaaataatgattctcttttaaataaataatctgagtatctcatataactacgtaaataatatttgaaagtcacagaatttcttttgaaatcacatttatgtgtttccaacatatttttaaaaataaccattttgccgcttctctttgtatcttttcccttcggttgttggaaaagtcctcttgttgataatattgaaaatttctaagagactgtgttcagttagggagaggagtttataccgagcatctccagctggatctggaattgtattgagcatttccagctggatctgaagctaagggtctgtaaacactcacctcagcctgccttagcagcccttttccagccttccaccctttttgaggtcttgaaatcacacaggtttacttagtgcttccgaaatgaactctactcttgggttcaggccattctgtccaaatcgtacttctttctcaaaaccaaacacaaatgctgtatcctcactaacatttttcttaaccactccagcttaagtgatttttcccttttgtgagttgtgagagatattactgactatgcaatttatatgtcaataacaacacagtattttcttttcttcataaggatggttgttgtttaactactgaagtgatgtgtcttttcaccccatctgattgtaaactgagaacgggagttatctcctgtatctctctgtatctatggtagacctaaatcataataatgatcgctattataattgatctttaataattgattatatttaataatttattatatatagaaaaatatcatcagtagcttcttttttggcttacccttttgtagttacactcacataccacattgctgcttctgttttcttactccaatttatattttaaaaatagttttactctcaggcttgtagatttttatgtacagatgtgatagtgttaattcaaacattattgaacaattgtcatgtcagacatcgtgctaggcaatagaaatagaattgtcattcaagaatttgtcgttgcatatcatgatccttatcattagttatcattttgtttgcttgtttatacatttaggcttaataaccagctgcatattttagctgctagggtgaattctatcctattctattctaaattcttttatatagctattgaattcttcatggctgggttgttttttttttttttaagtctcactaatttcattggcaggtggcggatgaggcgttgaaggtagatgattgtgactgtcatcctgaattttcaccaccatcaagtgagtattgtttttatatcaattgttgccaagttaatataatgtctcctaaatttggatgccctacaatgtgcacaagccttgcttatatccactcttgttctcctttactttataatgcttctatgttaagaaaatattgaatatttatttgaaatcaatgctcagtctttttgtattatttagtgaatgtaattttggaaattcaaataaaaggaaaggaaaagatgaagtacatagctctttttggtctgcttcttaattttttttaggctgttgtttctcattattgaaagtttattattgcctcccttcctcccacctgctaggagcctgtttagacctttttaaatctaattgttctccctcataaaattttaatagctgtttatgtaccatatgtgcatctgcgctttatgtataaaaggaattgattttgtctcccaataactaattttcaccctattgggggtgatatcacccatattgagaacagatgctgctgtaacaaaaataccataaactagatagcttataagcaacaaacatttatttctcacatttctagaagctgagaaattcatcatcatgatgtcaacagattcgatgtctgctgagggtcttcttcccggttcatagatggccatctttttgccgtgttctcatgtagtagaaggagcaagacagccctctggggtctcttttctttttctttctttttttttttttgagacagattcttgctctgttgcccaggctggagtgcagtggcatgatctgggctctctgcagcctctgcctcctgggttcaagcaattctcctgcctcagcctcccgagtagctgggattacaggcatgcactaccacaccaggctaatttttgtatttttagcagagacaaggttttgccatgctggccaggctggtctcgaaatcttggcttcaagcaatcctctcgccttggcctcccaaagtgctgggattgcaggtgtgtgccaccacgcccagcctggggtctcttcttataagggcactaatcccattcatgaggggacagcctcatgacctaattcctcccaaaggttccacttcctattaccatcgccttgaggatttggttttcaacatgtgaatcttgtcggggacacagatatccagaccataacagtgctgtaggctaagtctcatttgttttaagttgtgtgtgctcagtgcatgtatttatttacatatctagtaaacacagacaccgcagaacctcattacttggcatcatttggagatgaaggttctggagaagtgaatatttttgtgcttcatttatttctgaatcttaataccaccagagtttgatgaaaatcctctaaagtatattacatgcttccctgccttttaacacggaatttaggaaaatacaggttttcttgatggcttaaggttgtggtcacacataacagtgactgacctcaagcctggtggtgttcctcccaggattcttcaggtgagattgttgattttttagttagtgatcctctcttttcccttgtcttgtttgttgggtggttggtttttctttccatagttttgcttctagcagccatttctattttttgtgacctgcagctccatgttcgctcaggctcagttagttccatagatacagctacttagtattgagcatttccatttggttagcacattagcgtaatgatagggaggggaaactcaggcagttgtcctacctgatgcagttccaacagcatataaaacatctttgaggataaaacttttttttggaagatagcttttaatttcttcatatttctcaggccattactatcatttaattaaataaattctgtccacccttcagcatttacatacaggggaagaaattgaggttccaggattaaggttaagtagttttgtccaaggtcacagaatggaaatcaaactagaattcttctacctttccaaaagctgcttttgttttctgaggccaccaaagcccaggctctcattccctccttattacattggctctgacttgtgtctgtgccctcccgttaaaccttcatcagatgcaccctgcccccctgccataccagttcttctacacagctctgagcatggctctccctgcccaaaaatatgcagtgccttcctacctcctgcccagcagaataaatctgggctcacagagctggatctgaagctaagggtctgtaaacactcacctcagcctgccttagcagcccttttccagccttccaccctttttgaggtcttgaaatcacacaggtttacttagtgcttctgaaatgaactctctactcttgagttcaggccattctatccaaatcgtacttcttcctcaaaaccgaacacaaatgccatatcctcactaacatttttctcagccactccagcttaggtgatttttcccttttgtgagttgtgagagatattactgactatgcaatttatatgtcaataacaacacagtattttcttttcttcataaggatgattgttgtttaactactgaagtgatgtgtcttttcaccccatctgattataaactgagaacaggagttatctcctgtatctctctgtatctatggtagacctaaatcataatgatcactattataattgatctttaataatttaatttattatatatagaaaaatatcatcagtagcttcttttttggcttacccttttgtagttacacccacgtaccacatttctgcttctgttttcttactccaatttatattttaaaaatagttttactctcaggcttgtagatttttatgtacagattttaggaacaaatacttttgtgttcacaggtcagcctccaaaacataaaggaaaacaaaaatctcgaaacaatgaatcagaaaagttcaggtatgttttttctctaagtatgtttttttccccttaatatactcttcccaagaaaaaggaaaaaaaattgtttttcgagtattagctactttaatgtatgtattatgatgactaccaaaatccctttcaaatatcaaaagcatatctttaggaaaggataatttttggctaaaggattattaatcctggatattaatatattgacttctgaaagtcacataatatgaaatatttccatattaatttcttaaatcccagaatatgtactctaaaaggaaaaagcattaagagagatataaggtgcacatgaagcctccttccctgctcacctcatttgaccctcctgcagtcccttctctaaggcctcctccaggaatacactgttaacagtttcatgactattgggaaacttactctgcatacgcagacatgggtatgcatatttcagatgcccttttgagtaattattgttagaggaaaatctttcctaatgaattctgactacttctaaaatgaattctatcaaacatccccatgaaaattaacagtaattaattgcctcctatctttttttttgtttttttgagatagggtcttgctctatcacttaggctgcggtgcagtggtgtaaccctagctcactgcaggcttgaactcctagactctagtgattctttttgcctcagctcccaagtagccaggactactactgctactatggtgcacgtcaccatgactggataactaaaactaaatgttttttagagacagggtcttgctctgttgcccaggctggtcttgaactcctggcctcaagtgatccttctgccttggcctcccagagtgctgggattgcaggcgtgtgcctggccttgcctcctgtctttattgttaacaccccattgacaacaagatataaattgattacaatgtgaaattgtaaatcttttaatacagaagtttatgaagtgaattaaagtgatgttggagaaacagcaaagccatgtctgccacaatacactggttttcaatttcttctccatttcttaatctgaatccatgatagatgcttcagggggaatgatttgaatatcaaaacactaaaaaaaaatcagtgaagtctcatttcttttcaaaaatgaccatttttggatgctgctacaaaaattaaatacaaagcaaggatatagcatattattatgtttttctattatttgatagaaaaatcatgagtcttcttccctgccctcccctgtacccctaaagaaaccagatattaatatatgataattttttaaatgcagagttgtaattttaacctgttttatttaaaaaaaatttatttttctgatattttgtttcacttttccaactgaacactcctttattaggtaatatctaccatatgggactatttcttcattaaatgggataaccacgtaaaacacttagagccctggaacatagtaaatcttcagtgtactttagtcgtcattactgttaccaccatcattttcattattattagaatgactctggcctacagcttgctttttgtcttttacaaaatatcttgtgtttcttcccatgttcagaacacagaggctcttccattcttcatttgctgtacagtattttgtaatatggctgtatcccccatttttgtgcatttaggctcttcattcctcttttcctccctcactttctatccctctatccatctctctctttttcttcttcctttgagagggatagatcagacagtacttcaaacatccttgcacatacacctttgtgcacctgttcatgtatatttacaataaatactttgtaaataatgtatagaagttgtttctgtagtgggattgctgtatcaaaggggatatgtaattttatctttgacagatattgtgaaatggttctcttagaaaataggcactgttcacactccgactaatctacaggagggtgtggtataataaaaatatatatatatttggtatttgtcccagttcctggtacagagctcccaaaacccatggcatttcctgaatgataggagtgtattttgttactcatcatgagcccctttccatgtacttgagtttatgctaatgaggtgactcaaggtagtgcctcagatagttcaggaggaggtctcgtcactggaaagaccaaacacctgattagagggttaagactttcagcctcatacctgacctccaaggagaggaggggggctggaaattgaggttaggcaccaatggccagtggttgatttaattgtacctacatacctacataatgaaaccttagtaaagtccttaaaagagggcatggggagcttctgggctgacgaacacattgatgtgctgagaaagtggcatgcccaaggggatcatgaagctcctcgcgccccccaaccttcctatgcatctcttcctcttggctgtttttgagttgtatcctttataataaattggtaatagtaagcacttccttgagttccattgtttttctagtgagcctgaagagggactcatgggaaccctcttgtagtcagcagggcaggagtgtgggtgacctgtgcaccccacttgcagctgaagtgagggcagtctggtgggactgattctttaccctgtgaggtctgcgctaactctgggagttagtatcagaactgaattgcattattgcacactcattttgtgttggacagttgaattgatacggaaaaatgacaatatttggtattggagaaaatctacacattggatgtcagaagtactttcagaaaactccacatcgagtgcctcagattttcttactctcaccaacttagggagtcagactttctgaaatgcttgtatcttattattagattttcccatcacattgaacatctttgcactgtttattgggcacatttattgttttaggcccatgttgttactagtgactacagatcaaggcaaataccccttaatttttctcttttttcaaaagctgtttttccatatcatctttataatcaattcatctggtttccctccacctctgattttataggaatgtttattgagattgcattggatttagagatttctaatagaaatattgccaaaatgccaattccccccaaagaatggccaacttgtatggctcaccatttactcactattttacatggccttcagtaaatatatttttttcttctatctgtcacattggagggatgagagcgaactaatattcagattctattttttttcttttttttttttttagatggagtcttgctctgtcgcccaggctggagtgcagtggtaagatctcggtcctgggctcaagcaattctcctgcctcagcctcccaggtagctgggattacaggcatgcaccaccacgccaggataatttttgtatttttagtagagacagagtttcaccatgttggtcaggctggtctcgaacacctaacctcaggtgatccacccacctcggcctcccaaagtgctgggattacaggtatgagccactgtgcctggccctattttttctttatatgagtagaacttttattttaaaatgatttttaaaaatgctttttttcttttagttctagttcaccattgactttaccagcagatttgaagaacatcttggagaaacagttttctaaatcttccagagctgcacaccaggtaatggagaagcttttccaatggaaaaagcaaaactctttgaacaaaacattgttcacatgaataaggttctaatcatgtacatctctaagttttttttatataattattgtattatattgtagttttgtagagatggggtctcactgtgttgtccaggttggtttcaaactcctggcctcaagcaatcctcttaaagtgttgggattacaggtgtgagctattgcactcagctattatagacatatcatttaatatatatgactgctaagaatccaatctatcactaatttaaatattaacttgataattacgttagctagaggtttaactaatgattagcactgtggaattatttgcttctcaaagagttaacagtagtattaactttaaatatttttaaaagatttaaacacagtttcattatacttattctaaaatcattagagggcaaacttttattctttaaatgatttaacttaatcagataatgttgtatataaaattctttttacgttacttcatgatggaaaatatacattaacatggaatagaatactcaattcaaaacatgtggatctttttttaggtatacataacagatattttacaaagaactaaaatagattcctaatcatttgcttaaaaacatttttgagaatatcttaaagttggagattttaaattatatctttttacattgatttttactgactctaaacaccatgaaatacttaaatagatgacagcctgtgaagatgaaaagactatttaaataaatatgatcgctgtttttgagcctctgtttgttcattcaacacagtttgattgaggctctctccatatgctggggagtgagagagattgggtgcacagtgatatgatttcggcctgctctgctggagctttcaggacagatcatttatgtcgtattgagggaagtgacttccaatgaaagcatgaggctgtatggatctgatttctagactgataaagaaagctgggcatggtggcacgtgtctgtagtcccagctcctcaggaggctgaggtgagaggattaaccactgcactccagcctgggcaacataggaaggccctgtcttatttatttattattctcttttgttttcttttttaagcctctcactagtttgggagccctgtctcttttaaagaagaaagaaaaagaatgagaacaagattaaaattgaatgagtttatgcaaggctaataactagtatttgtagggctagtatatcatcatttataacttcaagttcatatcttaaaacaagtatggctgtcatcgagcttttaagtttttctgaaagctgctcttttctatgcatattctggggagcgttctgccaaactttgattcattggttcaaaagccagcagaggccgggtgcagggtctcacacctgtaatcccagcattttgggaggccgaggcaggcggatcacaaggtcaagagattgaaaccatcctggccatcatggcgaaaccccatctctactaaaaatacaaaaaattagctgggtgtggtggcgtgcacctgtagtcctagctacccaggaggctgaagcaggagaatcgcttgaaccccgaggtggaggttgcagtgagccgagatctgccactgaactccagcctggacgacagagcaagactccatctcaaaaaaaaaaagccagcagaaggcttttgttaatgggtaaccaaactgctttttcctctgtgatttgtgcagtggggcctccttttggatcttcattgttaggaatggtgaggaatacaacatacatatttgcatttgcggcccctttgaatggcgcacacgtgtatagcaaggagtgaggagattttaggcttaatgtctagccttgcctctccaatctttgtggaactttggtgacttacagctattcccatgtcactaaaatatgaattcaaattataatgcgtattcaaattacaaagtttttctcactttaagggcacatgatagcaattttgtttttattttttattccttatgttattccttttgcatttaacctattgttatctctcccagtaattttatctacttatattcaaatatatgttaggcaggagtacagttaacaattacagtatttatttcttgcttagaattaaggtttgtttcagagcaggatggcagttgttaaaatctggtagtgatcagaatattgattgtatgttcttaagtgtctaattgttctactcccaaacaacttacttatttaaatgatggctgttgtttttcatatatattgttaaaacttaaaaatactgtctgtttagtctggagagcaagtgaggcttagtaccatgtagtgtaaaatgagccacctttgtcacaggcaacagaagaggtgttgcaattaggatggtaaagcagtaccttttcattttcactttaaaagtgtggtgctgagaaaggaatatgatgaataagggtagtttgggtattgatgtaaacattttatcattagttataaaatattactatgaacttggcatcttaggttttaaattaaaaatgtgtagattcaggttactgaaatagaatttcttttttccaggattttgctaatataatgaaaatgctgagaagcttaattcaagatggctatatggccttattggagcagcgttgccgcagcgctgcacaggcctttacagagttgctgaacggtttagatcctcaaaaaataaaggtaaatttgccatatcataacttgtttatcaatgctaatgcacctcagatgaatgcagaagagaaccaagggcttaactcattgtagtaatgtacctaagaccttgctgagattggctgaatctacttcaggttatgggaagcaggtactgctccaattcagacttcatgagtatgttcagtatgtgatccatgtttatattctctccttgactatagtttagggtcattagaactggctttttctctgaatcaaggttttcaactatctttagtcacaccttttcacccaggaagaaagtacaggcacacctcgtttcattatgctttgctttattgtactttgcagacaatgcatttgttacaaattgaagatttgtggcaaccctgtgtcaagcaagtctgttttctgaaagcatgtgctcacctcatgtctctgtgtcacattttggtaattctcacaatatgtcaaactttttcattatcattatcactgtatctgtgatcagtgatctttgatgttactattgtaattattttggggcactacaatctgtgcctatgtaagaaagggaacttaataaattgtgtgtgtgtgttctgagtgctctgccaaccagctgttatctccacccccttccttaagtctccctgttccctgagacacgatattgaaattaggccaattaatgaccctacaatggcctctaagtattcaagtgaaaggaagagttgcacgtctctcactttaaataaaaaactagaatgattaagcttcgtgaggaaggtatgttgaaagccaagacaggcagaaagctagtcctcttgtgccaaatagccaaattgtgaatgcaaagaaacagtttttgaaggaaattaaaagtgctacttcagtgaacacatgaatgacaagaaagtgaaacaactttcttgccgatgcagagagtcttagtggtctgggtagaagatcaaaccagccacaacattctcttaagccagagcctaatccagagcaagactctaactcttctattctgtgaaggctgagagaggtgaggaagctgcagaagaatagtttgaaactagcagaagttggttcatgagatttaaggaaagaagctatttccataacataaaagtgcaaggtgaagcagcaagtgctgatggagaagctgcagtaagttatcgagatctagtgaagatcattgatgaaggtggctacgctaaacaacagattgtcaatggagactaaacaaccttctgttggaagaagatgccatctaggactttcatagctagagagaagtcagtgtctggtttcaaagcttcaaaaaggatgggctcattactcattaggggctgatgcagctggtgacttaagttgaagccagtgctcatttatgttccaaaaatcctcaggcccttaagaattatgctaattcactctgcctggagccctagaaatggaacaacaaagcatgaatggcagcacatctgtttacagcatggtttactaagtactttaagcccactgttgagacctactgctagaataaaagattctttgcaaaatactattgctcattgacaatgcacctgattgcccaggagatgtggtgacatgtacaaggagatgaatgttgttttcatgcctggtaacacaatatccattctgtagcctatggatcaaggagtcattttgactttcaagtcttattatttaagaaacatattttataaggctatagctgccatagtgattcctctgttggatctggacaaagtaaattgaaaaccttctggaaaggatcaccactctagataccataaagaacattcatgatgcatgtgagagatcaaaatatcaacatttacaggagtttggaagaagtaaattccagccctcatggatgactttgaggggttcaggacattagtggaggaagtcactgcagatgtggtggaacaagcaagagaattagaagtggagcctgaagatgtgactgaattgctgcaacctcaggataaaacttgaagggataaggagttgctttttatacatgaacaaaaaaagtcatttcttgaaatggaatctactccttgtgaagatgctggaatattgttgaaatgagaaacttagttgatcaagcagtggcaggatttgagaggattcactccaattttgaaagaagttctagtgtgggtaaaatactgtcaaacagcatcacacattacagagaaaccttttctgaaagtaagagtcaatcagtatgacagacttcattgtcttattttaagaaattgccacagcaccttaattttcaggaactaccaccctgaacagttagcagtcatcaatatcaaggcaagaccatccaccaacaaaaagattatgactcactagaaatacccagtgtagatgacggttgatgggtgcagcaaaccactgtggcacgtgttatacctgtgtaacaaacctgcacgttcttctgcacatgtatcccagaacttaaagtataattttaaaaaaagtttaaaaaaagattatgactcagtaaaccctcagatgatcattagcatttgtagcaataaagtcttaaattaaggtgtgtacattgtttaatggacgtaatgctactacacacttaataaactacagtatcgctaaaacataactttaatatgcactgggaaacccacaagtttgtgagactcacttgattgtgatatttgctttattgtgatgctccagagccgagcccacagtatctctgaggtatgcctataatagctaagtaaatgtcttaatctgtcactagtactgcttatatgcaaaataatatgactttaattataaattaatctattatgaatcatgcctcaaggaactctgagacagtgattctgtgttttaaatagcaggataactgctttattggaacaaaaatctcttttctaatttgatttggccaatcatattgattagtgagattttatgacaatcattgattcgtaagattgattagtgagattctattacacttctttttctgttgtgactggatgcaaattgggcagaattatattcagatttttaactgaggcatttttattgacagcaattgaacctggccatgattaactatgttttggtcgtctatggacttgccatttctctccttggaataggacagcctgaggtaagatttgtaacagtggtaataaacaattaaaatgatattgacatatcttataaaaattattttctcatttttacccattttcttctctgtaccttctgataattttgtctgaaatatctcagtttaatttagtttgtgtttttaaagaatatttagtttcctattagaaaaaggctttgccaggcaatcagtgggaatctactttttatttgtgtaaaaattagtatgtaatgtatcatgattgatagatttcagaaacataatcttgagggaaaggcaagttggaggacataaacattgtgatcccacttatatactttttggaaaacatacataacagtactatatactgtttatgaattctgtgcatcttgtaaaaaagtgaaaaaatatggattatgtttatataaaatttaagataatggctgcctttagtgatggccaggagggaatggacctggggaggtttcgtgttatgctgttttcctagaaaaacaaaggtaacaatgataacgttagtatctcttatttgtacgtagaaagtacttggatattgtattatttctagattgcaggcttcctataactgcatgtagtcagtgtatagacatgagctcccaggatttccattagtcatgctcctgcctggctctcctggaatgtttacctacctatactgtttggcattataactttgctttctgaggttttgagtttgctataaatgttgaaatgctctagaattactcaagtataatatataatttggtctctatttttccctgtctagatgaaggtttaactctaacttgccacctagtgaggatctaagtagtcttttacgttctgttctctcccagaagttgacagtgcccaagattcattttccttgatctcagtgtcacagattaataatgtctcccatgaatgctctctaattctattttccaagagacagttggagacagaacttcatgattttcattttattcctgacagaataataataaataccatattttaccttattagaattgaagaaatcatttattacatttgtgatttaatgtaaaatagcgagactgatttagaaaaaaaaaatgtgttatagtagaacttacatgtttaaaagaatttcatcagaggacagcccttgcttcaaacgtttttagaatgcctcctttggaactggcctcaaagctccattttgtagtgacatttctttttttcactcacagtagggttaccagtatttcttagaactatgtatcttttggatgttttccaaaaacaaaattcattcaacttagtggtttttcactgttgagaatattcaaaaaagaatgtactctaagctatgttaagtgtttactaatgggctgtttttaagacagagctttcatccgtcttgtgccacaaaagactgtgacaacgtcattggaatggcattccttccaagggattagcacttaataggatctatgttatggtgtgtttacaccataattagccttttttaaaaaacaaaaacaaaaacacgatttgactctttttagtattagccagcacacgccaggcccttagtgcgtactagtaaatgcttataggttgattgtctgatgtgttcagcaggattggtttggttgtgtctctgactatccatatgatcagaaatttatataattcctaagaaagtgaaacacagaggtataattttgccacaggaatttggggatatgcagttgttattttaatattataaaaaaaatcaacctttagataaaatttatttcagtatttctctttgtatgtaagtgatcattgttttcactgctattcaaggaattatctgaagccgaaaaccagtttaagaggattattgaacactaccccagtgagggccttgattgcttggcctactgtggaattggaaaagtatatttgaaaaaaaacaggttagtagaaatgacactactttaagctctaggctggtaactcatttaaaatccaatgtgataatgatccattttctagaattattttgatatctcctctgtagcacactatcataattgtgatttactttgaggacctgaaatttcactatcagtattaattgttaaagcaaggccagtcattgcagttcttggtacttcctgattttaaatctaataagtcaacaatatagtaatttgacattaaagatttaatagtctagtgtataatcatctatagatagtgagtgaattgatataaactaatgtttttaaaatctgattgtttaatttttttgatttaattattttttaaaaatctgtatgaagatggttttaaataagaggtatatatgtgttcaaagacatcatgagtgagttaggaatataaaagtctgtcctctgaactctattgtagttgtaatccttacctgcagtttaatattgaagctgttctctaaatgcctcatgtctcttagtcttgtctccccgaatgtcagtatgtccctgaggggacaggattatgtcttgagctttaaaaaaagaaaatctgtttctgccacttgtacccaatatagaggtaggtatgttagattataaagaaataattgttgactgattgaatattatttataatttctaactgcctttaaatttccatgtaacttgttaggggaaattttatgagattttgggaatccccccccccagccatcttagaatgtgcctagaacctcctttatagttttttttaaattaaagaaagtttttttttgccccagccacagtggcgcacacctggaatccccccactttgggaggccagtgggtgaatcacttgaggtcaggagtttgagaccagcctgaccaatatgttgaaaccctgtctgtactaaaaatacaaaaattagctgggtgtggtggtgcgtgcctgtagttccagctactcaggaggctgaggcagaaagaatcacttgaacccaggaggcggaggttgcagtgagctgagattgcaccactgtactccagcctgggcgacagagtgagactccatctcaaaaacagcaataacacagagacacaacaaaaaaagagaatttaagacaatatccctgatgaacatccatgcaaaaatccttaataaaattactggcaaacccgaatcccagcagcaccatcaaaaaagccttatcccaccatgatcaagtgggccttcatcccctgggatgcaaggctggttcaacataccacaaatcaataaatgtaatcccagcatataaacagaaccaaagacaaaaacccgcatgattatcctcaatagatgcagagaaggcctttgacaaaattcaacagcccttcatgctaaaactctcaataaattaggtattgatgggacgtatctcaaaataataaaagctatttatgacaaacccacagccagtatcatactgaatggacgaaaactggaagcatttcctttgaaaactggcacaagatagggatgccctctctcaccactcctattcaacatagtgtcggaagttctggccagggcaatcaggcaggggaaagaaagaaagggtattcaattaggaaaagaggaagtcaaattgtccctgtttgcagatgacatgattgtatatctagaaaaccccatcgtctcagcccaaaatcttcttaagctgataagcaacttcagcaaagtcccaggatacaaaatcaatgtgcaaaaatcacaagcattcttatacaccagtaacagacaaacagagagccaaatcatgagtgaactcccattcacagttgcttcaaagagaatacctaggaatccaacttacaagggatgtgaaggacctcttcagggagaactacaaaccactgctcaatgaaataaaagaggatacaaacaaatggaagaacattccatgctcatggataggaagaatcaatatcgtgaaaatggccatattgccaaggtaatttatagattcaatgccatccccatcaagctaccaatgactttcttcacagaattggaaaaaactactttaaagttcatatggaaccaaaaaagagcccgcattgccaagtcaatcctaagccaaaagaataaagctggaggcatcacgctacctgacttcaaactatactacaaggctgcagtaaccaaaacagcatgttactggtaccaaaacagagatatagaccaatggaacagaacagagccctcagaaataataccacacatctacaactatctgatctttgacaaacctgacaaaaacaagaaataggcaaaggattcactattcaacaaatggtgctgggaaaactggctagccatatgtagaaagctgaaactggatctcttccttgcaccttgtacaaaaattaattcaagatggattaaagattcaatgtttgacctaaaaccataaaaaccctagaagaaaacctaggcattaccattcaggacataggcatgggtaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacgaagggctaatatccagaatctacaaagaactcaaacaaatttacaagaaaaaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccgtctcacaccagttagaatggcgatcattaaaaagtcaagaaacaacaggtgctggagaggatgtggagaaataggaacacttttacactgttggtgggactgtaaactagttcaaccattgtggaagtcagtgtggcgattcctcagggatctcgaactagaaataccatttgacccagccatcccattactgggtatatacccaaaggattataaatcatgctgctataaagacacatgcacacatatgtttattgcggcactattcacaatagcaaagacttggaaccaacccaaatgtccctcagtgatagactggattaagaaaatgtggcacatatacaccatggaatactatgcagccataaaaaaggatgagttcatgtcctttgtagggacatggatgaagctggaaaccatcattctcagcaaactgttgcagggacaaaaaaccaaacaccgcatgttctcactcgtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgcacgttgtgcacatgtaccctagaacttaaagtataataaaaaaaatatatatatataaacaacaaacaacaaaaaagtgtacacctgccacaataaagccagtgtccaagacgagttgtgtttaatgtatattacttttatagcaaacagcaatagtgactttgtttttttaaagaaaatttaggttacattgaatattgctgttcagtgattcatcaaatgtattcgtcccagtaagcttgagatctttggtgacttttgaagggagtgaaaataccattttacatctttaatgcctttttcataattatgactttagatttctagaagctctcaatcactttgagaaagcaagaaccttgatttatcgtcttcctggagtgttaacttggcccacgagtaatgtgattattgaagagtctcagccacaaaaaataaaggtaaccatttatttttgcagagtgtttcttactgtgaatgcttatctgcattgactgactcaggtatcaggaggcggagaggtaggagcattccatccccacctcccttacacgcatttcccctctactgtctaatgagaatctctgacatttattgaatgttttctgtgtgccagtgtgtaccttcatttatcattatgcttaatccttatagcagccccgtgcaggggggcactgtgatcattcccattttacagatgaggaaggttaagtttagagaggtgaaatgatgcactcaaggtgaaacagcaagcaaattgtggtcctggaacttgagtccaggcattctgacttctgagtatgcatgatcatgcactctgctggacttggttgtacttagaggaaggtatagtattgttgtttcatcataaagttaccacagttactgagatggtacttgaagatttagaaaaatatgaatttagtctcatatccagaagcataaagatgctttgcttgttctagaaagacttacgtgtgaaatgactgagataggcttttacttgtagtgaactctcacatgtactcagaacttgattttggctgaagcttttaaaatcacagaagtcaacttttacaactcaataataaaaagacaaataatctaagaagtagtcaaaggatctgaatagacatttctgcaacgaagatatacaaatggccaaaattagcacatgaaaagacattcagcatcattagctatcagagaaacacaaatcaaaaccacagtgagataccacttcacactcattaggatgtgggcagacaataaatattggcaagggtgtagaaaaatgggaacattcagacactgctggtggtaatgtataatgatgcagctgctttggaaaatagtctggcagttcctcaaacagttaaacatagagttaccatgtctcagtccatttgtgttgctataaagaagtacctgagactggtgatttatgaagaaaagttggcttatggttttgcaggctgtataagaagcatggtgtcagcacctgctggtgaaggccttcaatagctcctactcatgtcagaaggcgtaggagagcctgtctgtagagatcatatagtgagagacagggaagtgccaggctctttttaacaaccaactctttagggaactaatggagtgagaactcactcaccccagggagggaattaatctgttcatgagagattcgtcgccatgactcaaaacacctcccactgtgcctcacctccaacaccggggatcagatttcaatgtgtggtttggagggtcaaacattcaaactgtagcataccatatgatccagcagtttcactcctaggtgtgtacagagaaaggaaaacatgttctcacaaaaacttgtacatgaatgttcatagcagcattagtcataatagcccaaaatgggaaatagcccaagtattcgtgagctgataaatgggtacgtaagtattggaacctgggaggttgaggctgcagtgagccttgattgtgccactgcagtgcagcctgggcaacagagtgagagtctgcctcaaaaacaaatggccagtcttggtggcttacgcctgtaatcctaccactttgggaggccaaggcaggaggattgcttgagctcaggagttcaagaccagcctgggcaacatggcgaaacccatcaatacaaaaattagccaaacatagtggcacatgcctgtagtcccagctactcaggaggctgaggtggaagggtcagttgagcccaggaggcagaggttgcagtgagctgagatcgtgccactgcactccagcctgagtgacagagtgagacgctgtctcaaaaaaaaaaaagagtactgataacatgctgcagcatggatggaccttggaaacattatgctaagtaaaagaagccaaacacaaagggcttgtgtgagtccattcctatgaaatctccagaataagcaagtctgtatatagtgacagaaagtagaccagtgattgctgggcctggaaggttaggggaaaatgaggagggactgctaatgcgtatggagtttctttttgaaaatgttctaaatttagaccgtggtgatgtcagcacatcctgtgaatatgctaagaacaccgaaccgtacacttcatttgagttgtatagtgtgtaaattatgtctcaacaaagctattataaaaaatacaacacagggattcttggatttacctctcttcatacaagattgggatagaggcataggagctattgataacaaaaagccagcactggaagcatggcatgagtctcttgggggcttcattagcagtggaataattctccagggagtccacaaacaacagtggcagagctgcaaggaggaagataatgggagtgttaggattctggatgaggtgatgttgggcaagaggagcctggtaaagtcctcaggattaccctaagggttattctgccttacttgacttcctcttaatgcttatggaagatttctgagagctgtaaattataaaatgcgatttgatgattgtaacaggacaaaattttgattctttcgaaattctgaaaaaaaattttgtccagtcctctttttaaatctctcttatgtctcttatcagccttccttttaaaaggaaaaactttaaaagttgtatgtagtttgttgttggtgaaaaaatttagtcattcttatgctgaaaatattttgatggcaagaggttattgaaatcacaagcatttttattgacagattagtattgtaatggtatcatttttgtttattttgttttagatgctgttagagaaatttgttgaagaatgcaagttccctccagtgccagatgccatttgttgctatcagaagtgccatggatattctaagatccagatatacataactgatccagactttaaggtaaataatgagtgtacagtgggacattaacttgcaaaatcatttcttaaaatgggctcaaaacaatctgtaattggaggcacccaagttctctggctagttagcagtcgtccacccctttcccaggattttttttttttttttgagataagtctcactctgtcacccaggctggagtgcagtggcacgatcttggctcactgcaacctccgcctcctgggttcaagcaattctcctgcctcagcctcccaagtagctgggattacaggcgtgtcccagcacgcccagctaatttttgcatttttagtagagacagggtttcaccatattggccaggatggtctcgatctcttgacttcgtgatccaccccctcagcctcccaaagtgtgggattacaggtatgaaccaccacgcccagccttcctggacttttttaggtctacatcgtctcacatgggaaccagagccactgatgtataaacgctctgggctggggtagtgacctgagaaggcaggctggctcattctttttcctcttcaagctaccttaggaggataggaaacaaagtgagattgttacctctgatttgttgcaattctgatctctcataaaatttgagtcccaaatctaaaggtcattgtgatcattgaattagctgttagagacctaaatttgagataagtctggcacttaattgagttatactggtttattcaagaagctagtagctgcccttgtcctgctgttccaatgtccctggttagtaaatcagatgaaataatgtttataaaatatttgatatattttgaagaatgatgcaactttatgctgtggaaataaatatgttagtcaagctctctctgtctttatgtatgttgtagtgagtgagtgtgcagagacatctttaaaacgttaattaaaaaattttttgtaaccctagggttttatacgcatcagctgttgccagtactgtaaaatagaatttcacatgaattgctggaagaagttaaaaactacaacctttaatgataaaattgacaaggtaaagcataacaggattgtctgaatttttcagtatacttattgtatgtcaatttttcccccaagaattccttcctgaacattctgcacataattagaaaattttaaattataactttaataataaagtggaaaatcaaatttgtttttatttggacaatcataaaggcattaaccatagaggctttgtttttttaaagagacggatctcactgtgttgcccaggctagagtgcagtggtgcagtcgtagctcactgcagcctcagactccttgacccaagtgatcctacttcagcctcccaaagtgctgggattataggcatgagccactgcaccaggccccacttgaaagttttgatgtggaattagggatttcaaaaccaaaatttgatgaggtaatttgtactaagaagtcaactcaaaacaatttttttaatgttgggaagaaagatcaacttcaattttaaactgccatttctctccagggattttcttattaccaagataatgatgttaattaccattaagtagacatactttgagggaagtcatagtattacaatcttatttgtattcatagaatttgtttctgatctatagaaactatggaccttttcctacacttcttaggcttatgcagaccactgttcttattggggaaagaatgaggcagttgtactaggcatctgttaacaatagcaattattaaagtatggtagaaataaattctcacattttgtacattttcacataattaattaacaatataatgatatgagtaaataactgtcacctttgagtcacttctgctatgtctttgtcttacctaaattgagtttctctagtgatataccctcttttagtggtcttaactattcccatcattttaaatacactctgtaaattagtcagctttccctaggatatgctgaagtgatgcaacccaaatatcttgtggcatacatcagagaagtttgttttttgcttacatgacttgtcctgcagttctgcagttgttggctgggactgggctgtagcagctttattttgtgtggctctattccttgtttctcaatctaagttgaagaatgacccttttctggaacatcttcctgtgtcagaggaaaaagaacaatgtccagtctatgaagtgtttgttaaaccttttgtctagacatgtgtatgtcatgtctggtcactttgcattgatgaaaacaagtcacatggtcagacccacacctgaaagtatatttttcctacacggaagccttaaaattcgcatggcagtgagtaaggattttcaccacttgcctgaagatggttttagtccgtattttgactgttcctagtggtaaaaatagtatacgtgtatagatttatcccccctagacataacatttttcttgttttttttttttttaatcaaataggattttctacaaggaatatgtcttacccctgactgtgaaggtgtcatttctaagattatcatcttcagcagtggtggtgaagttaaatgtgaagtaagtaataaaggggaaaccttgttagatagataaccaaaatgtttacaccttttgaaacatgatttgaatttgtagatatcatgtaatttggatcttttccaggaaagaaacaattacttcatttaagaaaatataggaaatactgggatgtgagaactgcttcattgtaatgaaagcattcttatattcttttatttcttaataggaaaaggaggctttttatatcttagttttactatttttactgtttttgataacttcattttcttaatcccggtaaacttttgggcagtagtgggtgtgcaggtttttagggagggggaagagcgtcttgagggattacctttaacttcatgacatgggaatggcaagagtgggtagttgtaataatatttacactttattagatcgtctgcttactcttaattttttaaaaactttttcctcaagtgtgtctaccctcttgttcctcttcagtaaattattttgctaaagctttctgggcttttgtctgggtcagaacatcatcactgttctctatcaaactgaacattatgtgtgcttctgaaatacttgttacttgtggttttgtgttttatgtcatgggagtatgagacaaattttggatgtctttgttttatttaaagtttgaacacaaggtcataaaagaaaaggttcctccaagacctattctgaaacagaaatgttctaggtaagatttttaacaatcaatcagtggtttgatgatgtctcttagaatataattctattaaatgcagatttctaaattatgcctttttaaaaattggctgtgtatacatatattcaaataagtgttttttaaaatgatttttatggaaaattaaaacttaaagagaactagcctagaatgattaaatactaaaaacttgattcagaattatttatctagtggttgaatttacaattaaaattataacatttgatgctgtgaaattacatgtttgattaatagatttggcatttatataaaaactatacagtttgctctcagttgttgaaactttaattccaaaagcatatttttctttttatctctcttcagtaaacattttgaacctatgactattttttaccctgaaatactcaatgtactgtctaaattattacttctctatagctttttgtttagatcaaataattcagattcttttttcttttctttttggtcctgcttcttgtttttctttctaagaagtgatttttttttatcatttgtgaccaagaaaaagcaaaagaaaagatgaacagaattatttgttggagagaattcattgtaaccagatcaaccaaattatagtgttgtgggttattattgagatgtgaaaattatattttactatgggacctttcttagaaatgagagtttacatgaattattttgcagagtaatttgtactatttctgtttaccctatgaagtaacttagatacatgaaagtgacatctatacaatctgtagactgcatccttagacatcacctaatcattgaggtttttgttttcatgaaacaagtacccttattttgacaatactgacagtttcttacattgaatggaagatgtaggccgggctctgattaaaaaaggaaaacttctaatatattgcttggaagatggtttctacgatagtcaaaggaaaacagttcattgagttgtcactaattgtaaatgtttatcagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaaggtatgcagaagccaaaggcatgataagaataatatactctcatttaaatgtataaatgtaagcatcttttgggccttatattcatcattattgaattgaaataaagatttcacttagtaatttaatactatcactgtcttctgttactcgaagacagaattgggttggtgtaaagaacactgaaaaacctttcagagattgtattcccactgaaaaacctttcagagattgtattttaactttctgtgcttaatgactaaacatatttattgtatataaagttaaggtagttgatgaggctgggttaggattgttgaaggaagtggccgtattttaggggaactaagttgttttttttttttgttttttttttttgagacggagtctcactctgttgcccaggctggagtgcagtggcgcgatctcggctcactgcaagctccgcctcccgggttcacgccattctcctgcctcagcctccccagtagctggaactacaggtgcccgccaccatgcccagctaattttttgtatttttagtagagatggggtttcaccgtgttagccaggatggtctcgatctcctgatccaccctcctcggcctcccaaagtgctgggattacaggcatgagccaccacgcctggcctagaggaactaagtttcaaatgctactacatgaatggttcagaatgaagggtgtaaaatgcttacttttggtatgtttattttagcgtacactttcatgtcttttcaaaagtattgttaagtgtttatatttctaattaaagtttcttgagtttagtaaaacagtataatcaatctgaatcatattttatattatgtaattttgttatttctaagtttatgtaattgtgaattagtcctatttatcactttaaccattgttatttatccttagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggtatgtccctttatattccagagcaataaactttaatacgaaggggaagtgtaggtctctgagtcattttcattttcctgccatataatttataactttaaatgcaggactataaatttgtatggttaagaatacttttccagtcccagctacttgggaggcggaggcaggatgattgcttaatctcaggaatttgagaccaacctggcaatgttgcaagacctgtctctaaaagaattttttaaaaaaagaactaaatatatgaaggcctttaaaaaacagaaaaactattacacacacacgcacaccacaatttttaggttattttatagataggttacagtatacttcttcaaaaggtgcaatctaaggaaagaccagtcagtaaagaaatccagacctatattagactaaactatttgtaaatgtgtagatgtgtgaatactaggcacaaccatggtaaataacacatcctggagtctgccccctgctcaggagctgtgttgagaagacaaatctataattcagattctttgaagaaaaatttagaggcaagagtggatgagactaattgctcagggtcacctaaggcaaatctgtatctagagattaagaggaacatatcctagggttggactgagctgtggtaaatcacaggattatataactctgtactgtgttctgactttcgtaacttggctgggagaagggaagagtgagcaagccccctgccctcccctaaagcaggcgctttgcctaaagccatgcaggactgcagaaggcagctgcagatacagttgttgtgtaacacgaggtagggatgctttgggcacctaccagggcactatttatcttgctgactggatagcaactggcctagcacaatagttcattcagtcggcagctattagataagaggctaaagtacgccacgggaaaaaggcagggcctttagccgcagaccacagagtgaggcctgctaagcctctgccagccgtccccacctgtctgaatgtttagaaacgtggggctattagaattctagggtttcagagaagatactggtcagcttctgccagaagagacgatgtaagatggcagcaagcctggcatagttagacagctgaacatgcctgctttgaacatagatcctcatggatttgtgatcccggaaagttatttttaagtgacaagattgtcactagtgagtatcaagtaagcaaattataaagttaatgcttgctttaacatgctttaggagatactcaggactggagaaataggtttgcctgggttatgctacacggtcaagactgccagccactgttcattcaggtaaatgcagcacttgagccctccagctcaactggcaggaaagggtgaacatgtcttttgatataaaccatgtgttttttttgtttgtttgtttgtttttttgagacagagtgtcgctctgttgcccaggctggagtgcagcggcgcgatctcggctcactgcaagctccgcctcccgggttcacgccattctcctgcctcagcctcccgagcagctggtactacaggtgcctgccaccacgcctggctaatgttttgtatttttagtagagacggggtttcaccgtgttagccaggatggtcttgatctcctgacctcgtgatctgcccacctcggcctcctaaagtgctgggattacaggcgtcagccaccgcgcccggtcgatataatccatgtttattctgtagattaaaggtatcattttaataaggatatatgtatactatttaaagtagcaatttttatttaaagttgtgaaatgagttcaagcatgttaattagtaaggctgttactacagtcctgaagtaaaatgcacacttacttaaatagtaagtaaagcagttttcatttcctggaattttacttcaataaaacgactattgggtggacttacatcatgcacatatttaccataagagaggtccagtttttatgttcagcaaaagatgaagggaggaaaggaggaaaggagggagggagagagagaaataatagagcactagtgagataaatttaacatcccaatagtgaacactgcctgcctgcattcccctcactgaccacaagctctgacgtggatagggaacgggaatgtgctattttttcattcggctctcataaatcttttattgtgtgagtattctacatggtcccttattctggtgtttaaagatcctaattttcctgcaacatgatctctgcaagctaactctttaatccagaagcaagcagtctaggataattttgactctgagcaatctctgcttcatttgttgacttcatttgttgactaaggccctcggaagaagtgaccgttttatattagaggcatgatggagaaactggacagagctcctttttgctggctgttcatcaggagtggggcttcaccgtcatttcagtaggagtctgtatgagattgtagtcacctgttttctaatttggagagtggagaataaaagtaggcatactgaccaccttgatttttgtagagaggggtgaggacccacattttggggaataaggaatgttattttaggtgttggggaatgggtttacccatttcctcttttagacacatttgggaagattctgcatattgttgatgttttattactatggaatccatataaagaatcataaaatcttgctagtttatactaattggaatgaaagtctttatgaattagtgaaaacattgtttgggtttgtttttttttttagagatagggtcttgccccatcacccaggctggagtgcagtggcgccgtcatagctcactgtagctttgaagtcctgggctcaagcagtacccccacctcagcctcccaagtagctgggactacaggcatttaccaccatgcctggctaactctttttttttttgtaaagataggggtcttgctatgttgccagggctggtattgaactcctggctcaagtgatcttccagccttgtcctcccaaagtgctggggttacgggcctaagccaccatacctggcctcattgttatatttttaaaggaatttaatgctatactttcatctcctaggtctaataaaggtaactatgatagtagaaggctttggcccacattattcaaatctaatagacaagaattattataattagcctaacaatgttaaatggtgtttctaaaatgcccaatagcttgaacgaatctgttctcaactatttaaatgtttttgctgagaatataagcaaactataatcagctggctttcagagatgtgaaactaaatgtgattttacagtaaataatttccctcctcttctgatttgggttttgtttttattacaggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatgggtatgtggactgagtttagacttatattacatttaatcttaagggggaaaaaatctgtgaaggacctagcttgtttaaatatataacaaagaaaatagtgaaaattattatggtacaatcagtttatgtggggaagttagtgattaacagtagcaatttttttatatcatgaagcttttttactttatcagttaaagagatactcaaatgtaggtatgttatgctaacaatacacaatgttcttcccgtcttagatattttcacagcatcatgggaaagattgcatgttacactgacagaatctattagtaagtggtttgatttatagcattttagaaaacattggtctgcagaagtaggtgatgtttgcagaatctagaatggatagcattctaggatgttttaatgggaagagcctagaactgggggtcaggaaaagtaggttgtggcacagcttcttccttagtttggttcattaaaaaccctgtgggcccagtgatgggtgttgagaaggaattcagaaatgcttacacttgtctctgcccttgaggaccttgtgttctagaaaagagaataagaagcatgcactaataacagtaacatggtagtaaactcaatacgggagggccagagaaggtgccaagggcatcaaaggaaggacccaacactttctttctccctgggagagaggaaagctgtggtgcaggggtagagtctcagatgggctgtgaacgtgaaagtggaattagaaagctgggtgtcagggcttatttggaattggggaccctatttgggtaatggcatggagtccagcttgaactaactagctagctagcagctaattccttcttttctcttagatcttaatttcctcacattaaaatgagatgatttggaggcagtgacatgtgtggtcctgttttacttaaaaattataatattcctagattctaaatgataatttcttacctttcatactatatgaacatattatgataatccccaagtccctcagaatcagaagtctcctttatgtgttgttaggagttagacttttaaatgtcatgctgtttgttttaaagggtacattaaaaggtctggccttgtacgatggtgtcacagatgataaagttccaatgcatataaggagtggaaagcttacttttgacaacaaaagttcttagaaaagagcacactcaaatacagatggctttatcttttcaggatactgcttcatgactgaaggtgacatgctacttgatagcctgaatttattgccatcagtttgctgctgctggtaataaaatgctgtcccgggactgagcttacaaaacctgatgcatgtttggatcacaaaacaagacaactaaaaaggacacaattccctctcagcatacactcgtcctttaacttgtgttctctacatataatacacagcacttccagctgccactgtttctctgtttctagtcatgaggtcagaagccactaaccaaattattggcaatcccaatggattctcaagtgcagtagctctgccttccaccttcaccccaaacattttcagttttatctcttcatttaaaagaatagttatatttcttaaaacttttcaaaatctactgatcttgtagatcagagtgtttgacaatgtcatgagtgctttgataattgagagccccgactttttccctgacctcttcatgcatgatcccctagggtatttctgtgagacagccaaatagccccttaaagcagtatgactgaacccacctatcacatcttcagagatctgtttttcctcaatttatctcagtcaataatattgtatatctagtatttaaacaggaaactctgtaattagtctcaattctttcttttcagtattaagagtataacttgtttgtcatcaatccaaatgagctttgtccttgatctgtcctttgctgtccaccccacttcccgaggccaagaccttagttgtctttccacagttagaccactatagtagcctccaaactggactccatgcctctagaatctcccattttccgtcttcctcttatattgcagctagtgactcttctagaacatctgtctaacattctgttaactattcaatttgggaaacatttgtttagttttaattgcagattaagttcacatcatctggggtctgggttcatcatcatcctctatctctgagcacacaccccactactgactgtgcccaaacctgccttgtgctttcctgcctcctgtcttcactcacgtagttcccccagccatgccccacccctttgcttgttcatttcaagagtaacttaaatgtcccctctacctcagagcttctttgcccctcctgtgggcctctcccttgcagacttcagacttgagtccttcgtgagcctttgttgccttgtgtttcacgtggtccttagcacgctgggttacaggagtttgtctgtttgtctttctggcagtagaacaggagttcatcaatggtagggactgtcttgtgcatctctattcccaggactagcatagatggtacctagaaggcactcaacattatgctgaatcagattgaagttttatggttctttgtagttggtttcccgtttagtcagccattttgcccttggtttctaaaccacacttgtgtcaaagccaaataaggaatagaacatggcctatgccagtagtatgaggagttattttaaggctttagtgtactatatggaaatgtaaatatttagttttctcacaaaaccatctgtatattcctacagacagccgctgtactgtgttaaggaaacaagatagtggtgaagcaccggtaagttacttgatcacttgaaatcttacgttctaatctatgttaaaccaaggatgagaaggggacccaggccagtgtttattgacatcacagccagcattcaagaaccacattaaaaggacgtctgggtagtacgtactattatttcattagaaagtcactgccagttttcctctcggaattggagcaataatcagcaaactatgaggcttaaattagacaatttctataaagtttcagagctgataaacattaatattctaattaagaaaggaagagttcttcatctcctggcataaaaatgaaaagttgtctttaataactaaacttctaatgttctgctctagaaggaaaacaaagggactttgttttgagtggctctaaattacgtttaagttaaaacagttccagagttgtcttccttagtagtttgcagttgccttttattcattcttcagaaattcttcagtttaggaaagtgagtaaatagagaaaagcacaacattgtggcagttttcaaagagaaaaatgcctgtttactgattttcaggagcaaatcatctatctatatgaaattttgtcttaatctgctccatcaaatattgcccagctaagcagggaaacacagctgaaatactccataaggagctgaaggcttctttattcactgtttgtgccccagtgtctggtcaggtgcagaatgtctagtttggcttagtaaaagaaatatattaataataaaaatactattatggcatctaactggaattacttaaaagtctgattaattacttgaaataacagtccaaccctgtggaaaataagataaaaatgttggaacaacttaattttagttataacattaggtattattaaattttgtttgttttctattataaatcgtagcacttgggctgatacactgtagtgttatttttgttaaacattttatgtacatttaacttatggctagtctgtaaaaactcatatggtttctttatgttgagcttcataatgctgttatttgagtgttcactgatttttccccccattttttagtttagttcaaccaaggtgaaaaacaaaagcaagaaaaagaagccaaaggattcaaaggtatggagtattttctgtattaattcttgtctaaactctccaaaatagttagttggacatatacattagaattgagcaattcttgggatattttgaaacatttgtagagaaagactttctaggacttaaagatgttttggcagtcttctacattttgaagaaattccaggttcatattatataatagcaagtcttgacactcgtattctttattgtcttttttatttttctaggtatttctgagtaaaaaaaaaaaattgtcataatgtcccaaaaaataaataagtctcaaaaaatagataacatatttaaactaaaaatgatgaatactaatcattatgacagtcccaggattgatagaatcccttccttcctctcaccaaaggctctcctccaagcccattagataagtagggcatttttatttttatttttgagacagggtctccttctctcacccaggctggagagcagtggtacagtgacggctcactgcagcctcaaactcccaggctcaagtgatcttcccacctcagcctcccgagtagccggaatgacaggcgcatgccaccatgcccagctaattttttgtattttttggagagatggggttttgctatattgcccaggctgttctagaactcctgcgttcaagcgatctgcctactttggccttacaggcgtgagccactgtgccagagtagggcacaatttttaagtctttggtgggttcttcatggctcttgtgtgtatgtggggagcagaaagggggatggagtgagagagagtagcaaatcttcaaaggatgagaacagttaaggagttccaatacaacttttatttttatctttgactatgtatttagtttagataaaatgggagtttaaactgagtaacatttaaatttttttggagcattggaaactatcctaaatgttaatttgagcttatttttggctgttgaaacttttattactatgtgttcctgtttataagaaaatttggatagatcttatatatcagcaatttgtatgtgtgtttatataagtattcatcaattttaatgattttttctctttaatggaattttaaggtagaaaatcattgtcatttttctgtcttttaaaccagcctatgttagttgggtctggaacaacttcagtaacttcaaataatgagatcatcacttcaagtgaagaccataggtaagtataatttttaaatttttgcttcattttaactcaaatgtctttacttaataagttgtgttaatttaatatatataaacttgtgttttatttccctaactttcctttctaaagctgtgcatctgacaacctgatgtaattccatcttgattacatttatatagtgtggctagaaggcattaagaattcattcaaactgtgttaaagtcacgacactggtgacattcattcactaagtacatattgagaacctaccatgtgcaaggctctgtgggaaaatcatagaaaaatgtctagaaattattctttaaaatagtcaataaagagaatgtcctgttaatacttactagcatttttgctgtaagagaggaagctgttttgggagctgtatatgatgttatgttttcaccttatatattagtgattttcaatgccatctggttgtcaaaactgagttttcaataaacaaatatttaagaaataaaactagtgagtagcagtaacctttttatatcatactcctttatgaaccaaaaatgtacaacatggttttttttttctcatttcttaaaggagctatcagagcagttaaaaatttacgtggtcattttcatggattccttaagtagggtaattgttttaagttaaaataatagcctgtcttagtcagtttgggctgctataacaatataccataaactgggaggcttacacacagaaatttatttctcacagttctggaggctgggaagtccaagatcaaggtactggcagattcagtgtttggtgagggcctgctttctggttcatagatggtgccttcttgctgtgttttctcatggtggaagggacaaggcaactctctggggcctcttttataagggcaataagtccattcatgggggtagagcctaattacctcccaaggaatccacatcctaacaccatcacattggtgattaggtttcaacatatgagttttgcagaaacacaaacattcagaccatagcatagcctttactgagattaactcttatgtatcagacattgttttgggggtttacatacataaactctttcaatccacttatcctgcctaggaggtaagtgctattatattctgtccaatgtacagataaggaaactctgaggcacagtgcagagcgacttgcccaagaacacaaagcttataaatagcagagctgggatttaagtcatgcagcctggttttagagtccacactcaaactactacatctttttagagtgctaacatcttacatttaaaaaaaacttttgtttagatggagtttcgctcttgttgcccaggctggagcgcaatggcgtgatctcagctcactgcaacctccacttcttgggttcaagcaattctcctgcctcagcctcctgagtagctgggattacagccatgcgccatgacgcctggctaattttgtatttttattagggacggggtttttccatgttgatcaggctgatctcgaactcctgacctcaagtgatctgcctgccttggcctcccaaagtgctgggattacaggcgtgagccaccacacctggcttaaaaaaaaccttttattaataccatttaccagtctcagtctcactttaagttaatttatagcagttataatacaatcttcatttgtctttcagtcatttaacaagttataattaatgcaactttttttaaaaatatggagttttaagaattttgctctttggagcaagactaaataattgaaagtgcttacttagattgtcagatatgatatttctcgcctataactgtggaagggtaacttttctacactaagttccctggtgctatttttttgcaacatagagctgagtaatatattgccattattgtgtttatttcaattagacattcttctggttaaataataaaccaaaggtctatcatccacaaaattgggtgttttttgttgttatttaccagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgagtaagtgggttgaaatttttacaaccattattttatactaaggctgccaattaaagatcagaagttgtttaatttgtgcctgtttttagagattttgccacattttacacaaagttaatttaggattttttttttttttttgagacagagtcttgctgtgtcacacaggctggagtgcagtggtgcaatctctgctcactacaacctctgcctcccaggttcaggtgattgtcatgcgtcagcctcccgagtagctgggattacaggcttgcaccaccatgcctggctaatttttgtatttttagtagagaagggtttcaccatgttggccaggcaggtctccaactcctggcctcaagtgatctgcctgcctcagccttccaaaatggtgagattacaggcatgagccacctcgccccgccctgaggatttttaattattaaatttagagtcctaatgattattgattttgtcagtttgagctactaagtcgatactgagtggggtggataaaacaagtaaaaaattcaggaaaatctcagatagcttaccattttgagctttgtgttattagatagtgcatgaggccttccttttaagaaaataaatcaagggctgaggtctgtaatagagtattaatttaaaagccaactcttctcctggaagtcctgtcagtagcatatccaccatatggccctttcttctgttttcctgtattgcatcattcctatttagttctgtgctcttagatccttcttcatggtttttctttagagttgaaatgctgagcaaatcatatttccagagaactcttgggtgacagtgtggaaacaactgtaaaattatactattatttcttaaagtatgctagaatttgcttcaggcatccaaaagtaaagctaaagtatgtagttttcagtatttactgtacgcaaattcaaataggatttgtttttgagatttgattttctctttttatttaaaattcttattggcattattatctttcctgaataaattttttgttgttgtttttagaataaattatgtaattacatagttgaaagttatgaaataactttttgatttccttttgctttcccctgctcccagaaaagttttaaatgatcattttctaggaggtagacaaaattttctttatagtatcattgattgcagttaaccttatgtttgttatatttgttgttgaggaaaggttgagatcagtgaaaagtgaaacagtgttttcctttgggagaataaaagtttttttcaaatagacatattcaagtacttccttatagtaactcatgtaaatgtaaattttttccaagttacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtaagagttaaatagaaaagtcttcttaatactgaagttaaattttccttttcatttttcattgccgttatatttgcaagaatccttaaagttgattgactttataatgattactgaagcttttgcctgaaaatacttttaaaatatgaactcttttgtgaggcatgacaggtaatcttctcagaaagaagcttgggtccaataaacaatacccatctttgctactgaaattctacacagattgagaaataagacagcaggtggagccaaaacgtcatcctaagaattaataaaggtgctggaggagaaggtggctgtttgtaggaaagttcaagtgctagctggaagtgtagcctgcatcacagtgccttacctgccagttacaggagggcccacctggaggccttccagcgtggggtgcctgccccataggacttagcgcatgaaggaggaagggaaaatgtgctggcagctcctcagaaagagaaggaaaaaggaagactctgacctacacaggcccagcttctcctgtcaaaccaggggaggaatgagaatgttaaaaagagacagccaggtagaaacaagagggatgtgtatgagttctttcctaacaaggaagagatgaaatcaagattctcctatggttgcctttatagggtatgaattcattaaatccttattgaattgccccactcattatgttttctaggaagctttgaaaaaaataggttaagagcaatggatcataatcattttcagttatactaattctaaataactttcctaatatacatgtttacggaaagcatggaacatgatctaaatgggaaaaaaaaacttgaaaaaattgtgggtgtgttttaaagtgttactacttgatgggcttattttactagagcgattgagataaagtgaattttaattttttgttttgcccacaggtatcttggaacataatacaccaagaagtcaatactgagccatataatccttttgaggaacgacaagtgagtcaaaattacattaaactgtttaaaggtttagttttcattaatttatctagatggaatgatgaactagaactattttggagtcagcttattccacacaaagttatcatggaataagcttgagaacataacaaaaaaatgattttgtttttattgttgaaatttgagaagggaaggaaaaggtaatttttttccagcatacttatttcaaattataacagcgttattgttttattttattatttttaaaattttatttatttttattttaattatttttgagacacggtctcactgtcatccaggctggccagctttattgttttaactggtataatgagcatataataatttataagtaagcttattcatgcgaataatacagaaagataaagaccttctctactataataatgattcaattagaaaacctactaatataatttagttcgttaatatgcatcataagagaaaagttgtcttatcaactcaaagttgctgtaaaggtattggataaaattcaggtcactgtcttgaccaaaactagtaagaaaatgggaattgatgaatatttctcaacatgctaatattttaagccaaaagccatcatcttgcttaatggtaaaacatcaccattaatatttattgttatcctgggtatattaactgagaaagcagatatgagaaagaaagaagatagaaaagaggagatgtgagtatcattatttacagaggctagggctgtgtaccaggaaaatccaaaatgatcaactgaaaacctacactaacctatataaacctatacttgtatataaaaatatatataaacaattacctgttagaaagtatgttgaaagaaaatattttcaataccaaaaaagagataaaatacttaaatgtatataaagaaaaatttttaaatgctatggagagacacatagaagccttaaatgaaaagatatttcatgtacttggataagaacacatattatgataatgagattggttctccctaaagctttttaaaatttaacacaatcccagtatatacatgaacagggcaaattagttatgtatattgctgtatatataacaaacaacctcaaaagctagtggcttaaaacagtaaaatatttcacaattgtgaaatctcacaatttcgctaagtcaggcattcaggagcagtttagttggatgcttctggagattctcatgtagctagccaagatgttgaccagggcttggtcatctgcgggagtaactgggcccagaggttctacttccaagatagctcactcacatggctggcaagcggatgttggcagttgtcaggaagcttcagttccttgccttgtggacctccacctagccctgcttgacctcatggggctggcttttcccagagtgtgtgatcccaggcagaagcggcagtgctttaggaagtcacaaattatcacttctgctgcattctcttggtcacatagatcaatccaccaaccctgatacatggtaggagaggtctatacaaggctgtgactaacaagaggcctggttactgcacaggattaatttgaaactagacaaattgattttaaacttcatatgtaaaaatgaacatcaagaatgggtatggaagagaaactaagaaaaggagttgtgcaactaaatatcaaaacacaatataaatctatctatattaccacatacatagaccattaatatgagagtgcctggccaacatgttgaaaccccgtctctactaaaaatacaaaaattagccaggtgtggtagcttacctgtaatcccagctacttgggaggctgaggtaggagaattgcttgaacctgggaggcggaggttgcagtgagccaagatcacgccagtgtactccagcctgggcgacagagtgagactccatctcagtcagtcaatcaagatggtagattggctgggtgtggtggctcatgcctgtaatcccagcactttgggaggctgaggtgggtggatcacgaggttaggagtttgagaccagctggccaacatagtaaaaccccatctctactaaaaattaaaaaaaattagctgggcgtggtggtggacacctgtaaccccagctacttgggaggctgaggcaggagaatcgcttgaacccaggaggcacaggttgcagtgagccaagattgcgccactgcactctagcccgggcgacagtgcgagactctgtctcaaaaaaaaaaaaacaaaaaacaaaaccgaagatggcaaattatcagtgagcaaaaactggattattaaatacataggagaaatggattgccatctagaaaaaatcaatcttggtccctacctcattccttataccaaaataagttccaggcagattaaagattttagcataaaaaatggacctataaaagtatccaggaaaaaaacgggaaaaattttttgtaagatcagtaaacagcatgggaaaaaagaatgtttatattcatatacacatgcatgtaatgtgtatatcctatatgcatagcatatgtatgacaacaaatacatacacatacacatatcaaaacacaggagagaaacaaggaaaattatgtgcagtgtgaaacagatagagaactaatttccttaacaacaaagtttctataaatcagtaaggaaaagatcaacaatctgtcacaaagatgagaatggatgtgaatagacaattcacaatgaaagaaatacagatgatttttaaacatataaacagatgcccaccccacttgaaataggaaaagcaatcattcacattttgaaagatagtgaaactgaaatttctgggaaggcagttaggaatcgatctgcactcatatatgtatagagagaccagtgagccaaggggatttgtatgtttgttttgtctgtatttgaatcagcagaaaattgaatacaatctaaacctccatcaatagcggactagttaaattatgatatacctataaaatgaaatatcatgctgtcatttaaaaagcagttctatagttagatatggaatgtttgacaagatcaatgtctagttaagtaggaagaaggtcagagcttgtgtttcctgctgctatttgtacaaatagtgtttagtttttgctaatgataaaataatatatagagttcttaaattttttaaatgaataataccaaaaattatgaaagagaaattgaaaatcatctaccttcccatcactcatgttaatattttgatgtgtagccttccaggatgtttgaacatttacatataattaaacaatagtttttaaaagatgggatcacagcatatatattttatttgaaatttgcaggcttcaattaatatattgtagacttgtttccatatcagtaaatacgatttatagcatcattttaaatggatacttggttttccattttattaatgtgtgatcatttatttgaccaatttcttgttgttgaacatttagattgtatcagctttttatgcttacaggcagtcttatagtgaacattttggcctgtttactgttgttgaagtcttatgctgtgcttagctttaaaccaggtaggctctgttgtttaatgagtcagtgcttttgaccatcaaatgaatgtttttatcagtgatgggaatgttcacaaatgctttcttaaattagctgttagttttaggaccttgatgctagtataggtgattgctggcttctcaaccagtgagaattgcatttgaatcccagcattgctactttctcctgggactttgagaagttgcatcacttggttctctgatctattaaaggcaaacataatgtatttctcacagaagtatcgtgaagtttaaatgtaataacatagaggtggcatttagcttcctgcctgtctctgttggtaatttggggcatgtaaattcattcacgacagcaagttactattcactgtgatccttttgctgaattaagaattaaaatggaggtaactaaagtcttaaaccataaagttttgctcctggttgatagtaaggttgactgtttaattaatttagttaagcatggactctatttatagtactaaactttcggtctgagcagacaaagtggcatgctccaaggcaaaagggcatgtatggtcaatctgaccataattcacagttctccaactgatcattcacagagtttcaaatacttgattccctgcttttttacacttgaaagatactaaggtattgggggaaggtacaggaaatgtcagagctggaccaggtttgtgcctgggatagatttctaaagcctggctgccacagggaggacagttacctgcagctggagaagctgccagcatcaaacagatgctctttcagagttatatgcagtttgaaaggttttaaaaaataattacataaatgacatttattgtttgccaacagaatggtttctgggtttggggttttttttgttgttgttaagctggtgcaagaaatataactgacaataattcatagataatattttaatttgtcattttgaaataaccagcaactatttatttgaaacacctaaaagtaaagccaaagttaaaatgttctgtttatatctaaaatatgtataatatgtgcagctttttaaacctaataaataatcgttggtgttaattgtggagagtgacatttaaatcaaactgttgatctggtattgaacccttctaaagcaaatattcagaactaattatagtatagattggagaatttatgaatttcaataatatgaatgattatatttataaaagtgctggttttgctaagcagtgtttaggggtttttaattcctgaatgattgtgacatttcccttgtaaattttcatctgctttttactctcctttgtttattttaagaaacagtaaagaacaagatcataagtaggcattttaaatgatttttaatagattgttttgtaattcacttttagggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaaggtaatcctgtctgaaacctgtctttaattgcatgtagcatagttaggagaatgtgagtgtagctgtgcttgtgcggcctcagctgaacttctgcattggtggctaaacaaaagattctttctcagaatcgcctgcttcagatttcttcatgacatattaaagtggctgttgccatgctttagaacttctgcaaactgccttatgagaaaggggctgtaagtctgggttttcgtttagctatagttcagtttccctggttaactaaaactctattttatggtgactgagctctgaggtaaattcttgtttatattgagaggcagcataggaatagaggttcagaatgagagccctggagacagactggctgggttcagatctaggcatggttctatactagttctaatcttgggcaatttacttaacttctctgtgctttagttccttacctggaaaatgtgagtaataataactcacattttgtatggttagattaatacttataaagtacttaaaactgcctcgttagtaaggactcagtaagtattgtctgctactgttatgatcatcatcttcatcttactcctaaggaagtataagaataacacatggagccttagacatactagaactgtaaagtcacccagagtattttgttgagatctgctgaccttgaattctgttagtcaagactgatcatcagatacatggctagtggagggatagcaattagtggcaaagccagattgaattagtgagaaaatggaatcacagatgtgaggaaatcatggtgcatttgtttttaaaagctaccatcatctgtttagaaaggtaacaaaagaatagtaattcatttaagaaaggaggaatttgttccagaagtctggatcaatagctgggataacatattaaatagaagaaaactagcttagtgggaccttaatcaggaaacctatttactaagattttagtagaaatcttagggtcagtttgtaaaggtaactgtcataacattccccaggacctgtttatactcaagatgaggctggggagagtctaaggacaagaagaattagatagatcctgagactttactcagtttcctggctgggagaagtaaagaagaacaaaatcctacacagcatagtgacacatggaacacaagtttctataagctacttgtgggtttaacaaaacaaaatagttttataaactttatattgcctcaggaaacttcagttttaattcccatgtgggaattcctgtagctgcctgtttgagtgatgaggcagattggagacatagtcttaaaggtagcattcagccggtgagatatctttctttctggccgaggctttcctggctttataaattgctggtctgactgtgtgttctgtgtgcacagttcatcaaggctctttctttgtacagtcagtccagaagagtctcggaaataaagcacccagtgggagggccccagctctcaggcttttttttaacttgttaaggctttgagtctgctgttgcgtggccctactcaagagtgccttaaaagggcaattactaagccccccagatcacaggcctgataagttattagacttgccacgtaaaatgtatacctattccctaccaggataagtcgctaatctgagttccttgggttggtgtccacataagagtagatgagatttagccacagtcatttctttattaatggtggttacgctcatagctcatggagaaatttcttaaaacatagaaagaaatgagtggcttttcctgatatgtccctttggcctttgactgcagattgctgaggttatgagctaaccaacttttcctttatactccagttacttgatgccatgtttggatgtagcaaatgcatacccagccccttatagagaacagaaaaacagggaagctatagaaatctgagtgcattagagtcccactgcccataccacaccctagcacctccatgtagtagctttgtgatgttagacaatttcttcagcctctttgaccctcggtcttctcattaataatgtattgtctacttcacagctttgtgaggcctcacctggggtggttgaaaaaggacaggggctagccagagatagtaagtacagtactcaaggaggaactgtcccacccaaaattctgcttgtgcctctgctaagcaaattgtttttttacaaaccactttaagaatacttagcatatggccaggcgcggtggctcacacctgtaatcccagcactttgggaggccaaggtgggtggatcacgaggtcaggaggttgagaccatcctggctaacacggtgaaaccccgtctctactaaaaatacaaaaaaaaaaaaaaattagccaggtatggtggtgggtgtctgtagtcccagctactcaggaggctgaggcaggagaatggcatgaacccgggaggcggagcttgcaccgagccgagatcacgccactgcactcccgcctggacaacagagcgagactgtgtctcaaaaaaaaaaaaaaaaaaaaaaaggaatgcttagcatatacaggccgggcacggtggcttacacctgtaatccttgtaatcccagcactttgggaggccaaggtgggtatatcacctgaggtcaggagttggagaccagcctggtcaacatggtgaaaccccatctctaccaaaattacaaaaattagcctgatgtggtggtgggcgcctgtaatcccagctactcgggaggctgaggtgggagaatcagttgaacccaggaggcagaggttgcagtgagccaagatcgcaccattgcactccagtctgggcgacaagagctagactccatctcaaaaaaaaaaaaaaaaaaaagaatgcttagcatatactaagcatcagtaaaaatctgagcgaggtattatatatagctgatggggttctattattattcatgagctaagaatggcctctttaggcaattaggccagttatctattctctgccggcggaaaagtggctttttaaatttttttttttattttttagatggagtcttgctctgtcgcccaggctggagtgcagtggcatgatcttggctcactgcagcctctgcctcccgggttccagcattctcctgcctcagcctcctgggtagctgggattacaggctgcacgccaccaagcctggctaatttttgtatttttagtagagatggggtgtcgccatgttggccaggctagtcttgaacttctgacctcctgtgatcctcccacctcggcttcccaaagtgctgggaaggcaccgtgcctggccaaaaggcacgtgaggcaccgtgcctggccaaaagtagcttttttaaagccagaatctcttgttgtttttattgtaccctaacctatgactggcaggttataactggttgcaatattgctgaaggacataggttcatttttgtttgagaataaaattctcataacataaaatttgctgttttaaccattacaaagtatacaatttagtggttttttgaatattcacattattgtgtaaccattaccactgtctaattccagaaaacttttatcaccccaaaaaagaaaccccatatttattaatcagtcactccctatctgcccaggacatatggtcttaaggtgctttaatgagatgctaaaatgggcattgagtcaacattaggtcttaaaacactgtcaaattatttggcccagaataatttacagggtagaattttggacctttgtctgtattagaacagaatcttggccctgcctgccaaaacttcctcagcccacactggtgcagaggtgggattctcctcttcagtcatgggtccttgtcaagttcagccttttttaaatctatcatttatgaagctcctactatgtgccacactcaattgtttttacatgtatttaatctcaaaacagtccttatacaatagtgttatactgtagtacataaataaatctccatgttactggtgaggaaatggaggtgggagcagctgatgcagctttccccaagccacaccagtacgaagtggcagaacaggttgtgtcaggcttcagagcccatgcatttgttctcccttaagagaaggtcagctccacggcctagttcaactaactgttaggaatgtttctcaccactttacagcagtgtaggcatatcagttaatcactgtcataataatgctgagtgactcccagccacaaaaccccagtgacacatgactgtaatcgctaagcgtagaagtctggatcagctggtcctgcttgggctcggctgggtcagttcaccttagggctagcaagagctctgcagcatctttgctgttcttgcctacatatctgggttcagctggctgtagattgatctagaatggcctcagctgggatgactgggacaactagctctgctccacatgtcttgcatcttccaccctgaaaatcctattctgaaggcagtaggaaggtgcaaaggcaagcaaagatggccacacggcacctttcaagcttctactgacttcaggtctgctcagaccccaccggcaaaagcagtcacatagccagccagagcccgggctggggaagatagactttgcctccttagcgaagggaactgcaaggtcacatgataaatggaatggctagagtgtgaaggatggagctatgaatgccatccctccactacagtaggtcagcgccagtaatttactaacactcagtaattaccaagagccttctgtgattggtgcctgcttcatcttccgccttctcccttgccagttctctacattgttctctaatttaatggataatgtttgtcattcgatttctcacttccaaaccttttcccagtaccatcccttctgcctggagtggttttccttctccctgagcctgactccctcctgcttctcctttgggcatcactttcttgaggaaacagttgttgatggcaacctcaggcttgcttacaggcctttgttaatgcagtggtggtaataatgactatgtgagatggtaattatcattttataacatctttattgagatataattaaccatagcataacatttacctattaaaaatagacaacttaatggttttgatatatgcccaggtctgtgtgtagcacaatctaagtttcaaccattttcatcaacctaaaaagaaatcttatactcactagctgtcactccccattctctcctgtatcccagcccttggcaaccactgatttactctctagatttatctattctgggcattttgtataaatggatcatgttacatgtagtcttttataagtgtcttctttcacctatagtgttttcaaggttcatccatgtacatccatctatgttaatatgtatcagtgtgtcattcctttttactgtggaataatattctattgtatgactatatcacattttattcattcactagttgattgacatttgcgttctttccactttttcactattctgaataatgctgctgtgaacattcatggacaggtttttctttggacatatgttttcatttcttttggatatatatgtaggagtgaaattgctgatcatatggcaattccacatttaagcgtatgaggaactgcgagcctgttccaaaaccatcctaccagcagtatataaggattccagtttctccattctcacttacacttatcatcgtttgtctttttatttaggcctcctaatgggtatggagtggtatctcattgtggttttgatttttatttccctaaaggctaatgatgttgagcatcttttcatatgcttattagccatttgtatatcttctttggaggaatgtctactcagatcctttattcatttttgaattgagtttgtctttctattattgacttataagagtttttgggccaggtgcggtggcttacacctataaaaccagcactttgagagaccaaggcagaaagatcgcttgagcccaggagtttgaaaccagcctgggcaacatggcaaaatcccatctctacaaaaagttaaaaaattaaccaggcatgatagtacgcacctgtggtcccagctacttgggaggctgagctgagagggtcacttgagcccaggggttttgaggctacagtgagccaggatcatgccattgcaccccagcctgggcaacaacagagtgagaccctgtctcaaaaggaaaaaaaagaaacaaaacagggctgggcatgatggctcacacctataatcccagcactttgggaggctaaggcaggaggattgcttgagcccagtagttcaagaccagccagggcgatgtgatgagaccctcactcgctacaaaaaaattaaaaaattaaataaataattaggtaggtatggggatacatgcctgtagttccagctactcaggaggctgaggtgggaggatcacttgagaccaggaagttgaggctgcaatgagccatgatcttgccactgcactacagtttgggcaacagagcaagaccctgtctcaaaaaaacaaaaacagagagtttttctatattctggatacaagttgcttatcaaatatttgatttgcacatatttacttccatcttccatatttgtaaatgtatctcctgtctccattttgtgggttgccttttcactttcctaatggtatcatttgcagcacaaaagtttttactttgagtacactaagtccaatttctcttattcttctgttacttgtgcctttggtgtcatagctaagaaacccgtctacttcaagcgcactgcttacccatttaggtctgtgatccatttcacattaatttttcaaatagtatggtatagtaattatcttttatgcatattttctctaccaaactgtgatcttgaaagtaaggactgtttttcattttgtttgttttttgaatgggggtctcattgtattgccaaggtagaactcctgggctcaagggatcctcctgcctcagactcctgagtagacaagactacaaacacatgccaccagccccagaagggtggttttcaaaattatctttggttgacagcacctagcttagtatacaaactaggagctttgcaaatgtttatcaaacagtgtgtgcttggcccctgaaaagctgcatttaatgaattgtgttttcatgttctctatcagcctacatcagaggacatcaggctcacattctgtgaagtttgctgctttgtttactgctagtatggagttggggatattatccattctttcatgtgacagatatttcttgaatgttctcttaagtgtcaggctctgtgctggtcttgtggggcgtttctgcagcatcctcttcttgaggcccttctgtctgccatcacttccagggcctctcttgtgcaactggtttgtttttatgttttatattgaattgtacagttcattatattttctctttgaccttgtctgccagaaagttttcatgttatttctaaagaatggttaggactgcatgccattcatttttatattactctcactcatggttttgtattgtcattcctctctctctattctgttttctttatctgcttagcattctttttattttgtcttttaaatatttatgtatatattatctttttttttacaccatggaatactatgcagccataaaaaatgatgagttcatgtcctttgtagggacatggatgaaactggaaatcatcattctcagtaaactatcgcaagaacaaaaaaccaaacactgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaatggctttataaggagaaaaaaaaaagaatgttttaatttcagtaagaatgaaacaataaaactttagaaaatgtaaaaaaaaaaaaattaaatatttatgtatatattatcaaaggtacctcaaatatttattttagaacaacactgaggtttaataaaaaagataagttttttcctaattgagaaaaagaaattgtttatagttatgtcaataaactgtaatatagcagatacagttgtgtatagcctatttgttttatgctaagtttgaaagaaaaacgttcaggagatcattctgtcttccatgcagtcagaaacaagctcgtgatagctgacctgtttagcattgtgaggcagctatggcattcagcagtggttagtacaaacagaagatgaactcatgtggtattttcgttgcctgagctatatgtgtatgtatgtgcacatatgtttataatactttgtgcttcttgatacttgaactcccttaggtacttgttgccaactaggttcttatgcctcagcataaccttgtggttgcacataatctcccagccaaagggatggatcccaggtgagatcattggctcagaataggagcacaggataggtgagaaacaagattggcttggctgccagcagcaaggcatacaaattcacattggtcctggtagaaccgaaccaggtggaacacaggattcttaagtagagtaggcatggtggtcacctcagtcacagtaatgactcaagaaattcaggatcaacaaggttgcagctaagaagatgtgggaagaactggttcctatgttaaagggaacattactgagctgttgttcaatttttgccacctaagaacagttgtcctgtgccaaaatcaaccttatccctgctgtaggattcagaaatcttaaaggaccttgactggttagcaaatctgcctttaaaaaacatgaaaaccttggtgtctaaggctgaagagggagtagtggtctcttaagttgatagagcttttgacctgagggccatgatttcctatggaatccatgtaggttgactttagtgtcctttcttacagagaagacctcgagtttctatagctgaaatgacctacgtgtgctctaagcctaagcaggaagttcaggctgtagggaacctgataggaagtaaaaaattaaaagtttccctaaagcaaatgtgaagttaggatttcattaagccgtcattgataatagtgagattttaaactagaaaatatttgtttcctttaaatattgctttgattcacgtttaaattaattattagaaatattaacatagggaatgttttacttataagtgactggtatttataagcatgtgccccacccaaaccccttgctacaattaaatagatgatacttcaaaaaagacatcaaacctttagagaatgtgtagattcagaagtttcaaaccagcaactacataggaagttgacaaagagggttaggtgtcaagtggtgctgtaccaaaccctccaggggaacggtaactagcattgtctccaaagaggttttcatttctctttgtcacactgcctgaaattctggcaggtatctcaacccaaatgcctttaatgaccagcaagaggattacatttatatttataaaagcaaacaaaaactattggccttgccaactaaaacatgcatacactccctgtagattagagaatcatttaggctggagagtaagtgtgaacacttctgggcacgtcggagtggttcttcggggtgtcttactgtaatcaggtacacgtagcgggtaggatgtggctgtctggtgtgacttggtgtcccaggcttggctggggggcatagtctgccacagggcgccagcttgggagtgtgttccactgaacttaggtcattgtttaagctatggcaccgtcacaattctagcctttcagtctcttttgttaaaaagtatattttgccatttatttaagtactttctaaatgtttttagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtaagtaatgattgaaaggcagtaatttttatttaaaaaaaaatattgtggcttttggttattttcacatttttgatatttaatattaaactacatcaagtaaagtaaaaatgaatactgttttcattgttttgtctcatttaaaaaagtattcattgagtaattatctcacctgaatttttttctaaacttaacattttttcagataaattatataaaagtgagagtagcatggaactgagaatccccaaggaactgacttccttccagtttgaacaccatccctttctctggccctcttttttcttatcagcaaaacatgggggctggtctaaaatctaaggttcttttcaaaagtaagattctgtgatgattatttataattacttttatcctgaatctataaattattaaaatttgtcttgtagtgtgaacgatttgataacatatacagatcctaggaatgattgtcaggtgggccaagagtgtgttttaagattctctgtgatccatccctaacctccctctgctcttaacagtgataggtcaaattcttcagcttgttttctaccactgtgtaagaaaacacccaaaagtcagtttctttattagcagccattgtatttgctcatggtcctgcaatctgggctgagttcagctgggccattcttctgctggtcttgccaggagtcctcatgtggctgaatttagctgggtgatgactgggggtggcctcagctgggatgctggggtggcttggcctcactttctctctgtgtagcctctctgtgatttttatttatgtggtccttccatatgatctctattatgatagccagacttcttacatggtagctaaggacttcaaatggtgcagaagtggaagccactaggcctcctgaaggttcaggcccagaactgtcacagcatcatctctgctaccttttattccttaaaacaagtcataggcttggtccagattcaagggcatgaataatgggaggctgggttcactggggggccacgctacacactcacctttcaagggcttttgtgtttttccatgccgcatgccatatgatcagatgactttcattatgagtcttgctagcattacatttaggcagtcctcaaacaatgaggaaaagtaaaacactgcctcagaattttcactccctgtgtcatgtcattttgatgatcaaagtagcttcactagtagaacacacttacggaaacaataatgtctgtaaagctttttacctctaatatttgagcatgaccagtcttggtcattttgttactaaaaagtgtggaaatatttatatttaacatactttttttgttcaattcagacatactgtcaaactagacaaggtaactagaggctgttaatgataagaaattttttttctgtactagcataaaagttaatttctgctggagaataaactttttattgttgacttttttccattttattattagatttctttacctttcctgtcacaatttaaagataagccacacgcttctctctaagttttttgcttttttttttgagacagagttttgcttttgtcacccagcctggagtgcaatggtgcaatctcagctcactgcaacctctgcctcccatgttcaagcaattctcctgtctcagcctcccgagtaactgggattacaggtgcccaccaccacgcctgactaatttttctatttttttttttttttttttagtagagatggggtttcaccatgttggccaggctggtctcgaactcctgacctcagatgatccacccatctcggcctcccaaagtgctgggattacaggcatgagccattgcacctggcctgctttttacattttccaaataaatgctttaaagctcaatttttctatttagatttttaagtaaaatctttaaactttttggatctctttctcagagatgcacaagggacatgaaaaatgatttcttggatgtttctgtgctcttgatcacacttagtattcgttaagaaatgactagaacatagagctcatgattggtacagtgacacaaaccacagatggctatgaaagaaggcagggcttccatgagagtgtcagagtgtcacccagtatttgtctatttagaggagggaggaagtgttttacaaaagaagtaaaataatagttaaactggcttgtattagaaacaagcggctttagtaaacagagatgactgcaaaggtatctcagggtagcatgaaagaagaggcagaacccgccttgtgcagggcatggctcaagaatcggagattcacacacttgttttgaaggattatcagagaatgtgagtgtgtgtgtgcgtgcgcacccgcgtgtgtgcatgaatgcttgttttgactttaagttctgttttaaagagtagaaggctgttttcattttgaatgagaatccacatcttctcattttgaataagatctctggttacactgatgatgatgccgcagtacctgtgttctctgcttgagctgcacatcttagactgagatagggtgatttacctgtaagcatatgccttagagtgaagaaaaaggtgatctggaaggaaaatttcccaaaagggaaatgacctcaaattattttcctatttagaagatactaaaaatgaaacaaaatgtaaaaatatatatattaaaaaatcaagaaatgtttttaaggatatgggtgcaatttactgtgtgggggtcctgttaaaaatttttcaaaattaattaatatttggtgattatgcttttataggtatacccagaaaaatgatggaaaggaaaaggaacatgaattacatctggatcagtcccttgaaatcaggcaaattaagcttaaatttatttttaatatattttaatacttttaatgccaggagtacaagcacagtagactttgaaatatattgttgcttgtctatttcttttaaataattatgtttctgttttctttatttctatttctgttgcattttaaaaattaatttataaatatattctttgaatatttaaatatttttattttacaagatttctgcatttatttcccattgtcaatataaaaatactgaatttattgttgtcaactttttttggattaacttgaaactataaacatgttgtaaaaacttttcttttgtgttacttggaatattcgtctccactgtaggctggtagtttgttgctgttattgctttataattataggttcattaaatttttactatgaatctatgcaaagtttccttttaacccttgcttgctaatggaaataatatgttttcacatactgctaaccagtacattcagtgataagcagttgcattctgcttttctcactattgtttcttacgcacattcccatcccggtttttgaataattttgtacagatttctttttccctttgggttctgtccttgtaatatgcgtcaaaacagagtttctggctcaaaggatagggaatgttttataaagcttactttttaaaatttttatttatttattttttgagatagggtcttgctctgtcacccaggctggaatgcagtagtgcagtcattgctcactgcagacaccatctcccagctcaagcaattctctcgcctcagcctctcgagtagctgggactacaggcacgcaccaccattgtattttttgtagatatagggttttgccatgctgtctaggctggtcttgaacttctgggcccaagcgatccgcctgccttggcctcccaaagtactgggattacaggcctaagccactgtgcccggcctatacagtttattaatgtcaccagattgtactccacctgccctcataaaaatggtgaactggaacagtaccctcaccttgattctcagcatgcccacctaatgtgcacttccatttcatatctgcctttgatcacttataaagcacaaagagcacacttgagcctgtgtattgtgtagtaaaatatgagatgagaaactgctctggaagatgtagctgaggctatcgtggtgtggtttcaaagctcatccagcctgaaacctttgtcatctcactgtgaaattttgttcaagaaagttttttttttccttcaatatttgtagcaacacacttacaaatgagaaaatgaaaatagaagagtatataaagaaagggaaagaggattatgaagagagtcatcagagagctgtggctgcagaggtgagtccatgacacttagtgaccactatggcatttgtcatttgtttttgtgtttctttaatgacatatgaggcataacagacattactgaaaagtgtggtgcataaaggatatcctgtaacccataatatatcctccctaaaacgaccactctttttccttgcctatagccttgtaatgttttaccggtattatgttgttacttaaatgcactcatagtgtacaccaaattttgtaacctgccttccttatttaccattataattcagccatttcctatattatacactttgaatactttcatcatatttaatcaagtgatgtaccatgaagtagccaaccatatttgccaatacttggaaaggaacttgaaaataatccacatattaagaatacgctccttctgcccctagaagaatatatagcaatgtcagtacactgtttcagaaactactgagacaaaaatcaaaattatgacatctggctgtattttatttagttccagaaacatgattctctatgtttctgtagctgagaaacaaatgatatttattggcatatgtgtctgtgattattctggtaaagtaagaaaagacttagtttatacagtctgcaaacattaggcttttcaattaagaattgactatgcacctgcttctaaggacaggaaaggaaaaagagccaaagtatgaatactttttgggtcctacaccagcatccgtattcctgagcttgtttaattcacaccaccgtttggtaagcaggtttgcctggtgggccctgtcaagtttactgacacctggattaaaaggctatttaatggatcatttggaccatgaggccattttacatttcctgcagtgattctcacaaaaatggccagttggtttgtggggaagccacagagagtctaaaatcttaaaagcataccccgaagcttttgatgcccttgccgagaacagcttctctgaggcttttctaaacttgcagaggatgcagcctttattaagggttattctgctgcaggaccataggtaatgcacactcgtgtacacatgcagttaacctggctctgtgcttatatatagcttaagcagaaagccatgtacagttattcatatctgcaaaaaggatcatggaaggtatgcatttgtgatgtcattttgttctgttttcaaatctcaaagtctaattcatgttcacctatgatacaatcaagttctgatgattctgtcatgcttcatttaaggagaaatgggaaagtggtttgaatgtttaagttttaacctttaaaatagtttcaggctgtcatttgtaaaatactcatatgtcttctgatctactggcaggtatccgtacttgaaaactggaaggagagtgaagtgtataagctacagatcatggagtcacaagcagaagcctttctgaagaagctggggctgattagccggtattgcagtttcgtgggtgttctcagcacgtcatttagaagataaagctaggaccatttgagaaaaacattattttgtattaggaccattttatttttaatagttatataattgatacatgttcaattgtagaaaagttaagacatacaaacaaaaatgataaaaatcattcctaattctaaatggatagataacatttgtattttggaataaattcatgaagtgtttgaaaaaatgaaaatttatgaattatttttactaaatagtatataggaaatttattttcatattggtaattacatatctccaacctaattttgaaaagttggatagtaattgagcatagaaacatgtcatgatttaccaaacactgctgtgctggaacagtggagttgtttgtgaatttgtgttaatataagccaccctgcagtgagcatccttatagttaactttttatgcacattattagtcatttccatgcagtaaaatttggaatgaagatcacattttcaaggcttttaaaattttttgccaagttgctttccatagtagctattatttaacagtctgcatgacagcatgcgagaatgtttacaaagtatattcacacatgttaattttttttcaactctccacataatctctacctgtttttgtttgtttttttgcgacagagtctcgctctgccacccaggctggagtgcagtggcctgatcttggctcactgcaacctctgcctcctgggttcaagcgattctcttgcctcagcctcccgagtagctgggattacaggcgcgtgccacatgcccagctaattttttgtatttgtagtagatatggggtttcaccatgttagccaggatggtctctatctcctgacctcgtgatccacccacctcagcctcccaaagtgctgggattacaggcatgagccaccgtacctggccttgttcttgtttgtttgtttttgagatggagtctcgctctgtcgcccatgctggagtgtagtggcgtgatctcggctcactgcaagctctgcctcccgagttcacgccattctcctgccttagcctcctgagtagctgagactacaggtgcccgccaccactcccagctaactttttgtatttttagtagagatgaatttcaccatattagccagggtggtctcaatctcctcatcttgtgatccacccaccttggcctcccaaagtgctaggattacaggagtgcctcccaaagtgctgggattacaggagtgagccaccacgccggccggccttgtttgtttttaagataaggcttgctgggattcctagaggatcttcttcaccctagtacttagcacttctctatgtgggattacttttcattgagtccttttaccatgttctatacacagattttgtgtttttaatcccagggttttgatccttcctggtgcttgccttttgattcaaatttcaaaccctcagcattgaaccagagattgtgtgaatcacggacagttttagtgtatagttctttttctttctttttttttttttttttttttttttttttgagatggtgtcttgctctgtcgcacaggctggagtgcagtggcgtgatctcggctcactgcaacctccgcctcctgggttcaagtgattctcctgcttcccgagtagctgggattataggctcccaccaccacgccaggctgatttttgtatttttagtagagatagcatttcaccatgttggccatgctggtctctaactcctgacctggtgatccgcctgcctaggcctcccaaagtgctgggattacaggtgtgagccaccatgcccggccccttcttcattttcaagatttaattttttttcatgagaaaacttttctgattaaaagtaaaatgctgatttagaatataggactagtacagctgaggttgagaccaagtggtagtcaaccgcctgtactaagcacccaccataggctgcattgtggctcatctgggaaacaaagataatctcagactcatttcatctaatagtatcaactcttccaataaacggtagagtatacaaagattctttcttcaggatgccatgctaactctgccttctccaccaaagtatagaaacatagaaaaggggtaaaaagaatgctctgttttttcttcaatatgtataatgaggtcttactatacccacagattggtagtgtttttgatcttctcaattaggagtagtcaatttatctgtcactttcaatagaccagattcatgaggtgctgagattcatgaggtgctgagattataaatttatcttaggctcatcctttatttttatattaaggtaatgattagggtttgattggaatcttttgaatgtttcagactacctttttaaaaaatctttaaatgcagacgctgtctttaatattaaacataaagatgtcagatgaagaacggtcaaactttcaaatttgggaaaagaacttaaaattcaggagacttattttctctctgcccttcggttttagagtttttgttatattaataattaaaattttctaaagtgtctctagtggcaagtttacaagataagcaattccttaaaaatagttggatttttgtgtgtatgtgattatgttaaatgtctcttttgctcatgtttagatgtttatttgaccgtaagtgcttttaatttttaaaatttctaaagcagttttatattatactttttcagtgatcctgcagcatatcctgacatggagtctgatatacgttcatgggaattgtttctttctaatgttacaaaagaaattgagaaagcaaaggtaagttgtaaacatcttttaatcccatcaaaatctttatgatagttataattctcgggaggctggtgtcatattgaatctatttcttttttatctattattatcaataattttttttgttgaaagtattatgagcttttcatggaactaatggttttgttttgtttttttgagttggagtttcgctcttgttgcccaggctggagtgcagtggtgcgatcttggctcactgcaacctccgcctcccaggttcaagtgattctcctgcctcagccccccaagtagctgggatcacaggcatgtgccaccatgctcggctaattttgtttttggttttggtttttagtagagatggggtctctccatgttggtcaggctggtgtcgatctcctgacctcaggtgatctgcccgcttcggcctcccaaagtgctgggattgcaggtgtgagccaccgcgcccagccggaagtagtgatattttcttaattaaattaaccatcttgacctctgccttgattggtaagattagaggagttatgtttgaaaaggctttggagcattcggtttaatgaggtcttattttgaatttccttaccaagacagttatgtttcatttataatgtgtaggaagaaacaaagtattaattgacaattgtggttttcccacactttactttctactcacagtctcagtttgaagaacaaattaaggcaattaaaaatggttctcggctcagtgaactttctaaagtgcagatttctgagctttcatttcctgcctgtaacacggtaagtctagcacatcttttttttttttttaaaccataattcatttgttaactggccaaagtagttatttgttgttgtttcctgggagtgaggatgagattggttaataattgccttaatgtttcattattggtgctactgattaaccttttaagctttataacattcttatataaaatagatcagtctttctacatctgtatgagggatggactgagatgaatacaccattgctacatttctatcactctcatgttccttggcctgtcttctatctttgtgtgtgtgtgtgtgtgtgtgtgtgtgtgtgttgtatatgtattcctgactttgaacaaataatccaggagtagcagttgcctgttgcgcactgcttttgtgattcaagcaggccgctatcaccacctcagattatactcttattcctagatatttgggacataagaccaaaatctaaaaattaagaggtttcctcctcaaatacagaataaaagctgctatgcctgaggcatacagggctttgttggtccggcacatcatattttactatttgtttgaggtatttgccgaatcttgttaataacagtgaataatcttgtctttttattttaatatacacagcacagtaaagaaaagcattaattgcattttgtggactttacaacatggctaaacccatatttcttagatttggacatagatagatgcttagtaaatactaaattgaaatgaattaggcccagaggagatcagaccataggaatttaaagttagatcttgagagaaaacttaggtaaaaaagaaaaacaaaattaaaggaggactgtgtgtgagagttgaaagatataagttccagaatgttgtggcaggacagtgaaatcttctggttcctaaagacggaggagactctctcccagcacctgacttccaccctcccactactgccagacctttgcctgggctgttcctagcctggagcactgtccccgctctgcatcctgccttcccctgaaaccccgtcaggggctgccctcttttggcctcccactgtgtcccttctctcatgtgcattagatctcagcctggccttgaatgtctctttctcaccagtaccttgcacagtaaacattcaaacttactgtgaattcatctgaaaaaaaaaaaattaagtgtggaaaaagtgtgaccaccctgaactgagtaaaatattctgttgagatccagttttttctctccattgaatgtgcagttttagttagaattacactaaagggcacttatcatttatcgtttttccaagttcttgtaacagatatgtatagagaaaacgttggctctcaataggatattttactgttagtttgtaatcctagcttatgttattttatcaatactcaaaaggattttcatatcctaaattctgggaactcttagtgtgccaggagcttgagtaataagtgtgcctaaaaattatttgtatctcatttctccctcattcattcattcggtaattagtggtgataaagactgatgtgggctgtgccctcaaagtgcacatggacttggggaaaggcagactttaaacccattgttacctgcagcagagtgaggtttctcatggcagaatgctggagcggcgtggatcaggggccactaacctaatctagaggtgtggcctcagcgggagattcccagttggaagtctcccagagacagagatctgcaataggaacttaccagacaaaggagtgagaggggtgtgtttggacggttagagttccagatggaacacacagtgctcctggagcctagagagacagagaacacactcctttcatactgtaatagaagcccagtatgacgcaggggcaaagccaatggagccttcttctctaagctgtgttacagcagcttagacacttctagcttcattagaccagacaggataggtctcaaataagggaacagcagcagaacaggagtccctccttcttcatggcttcgctttccgtggtttcggttatccgcagtcaaccgcagttagaaaatactcaatggaaaattccagaaatacataattcctaagttttaaattgcacactgttttgagtagcgtgatgaaatctgtattctcacatggtcacattgtgacctcctccctttgtccagtgttttcatgctgttgctgctccctgcccgcgagccacttagaagctgatttggtgaccagatgaacttctcgcgttaccccagtgcctgtgttcaagtcacccctattttactccataatggccccaaagcatgggagtaatgatgctggtcaatcagatatgccatagagaagcaatatattgcttcctttaagtgaaaagctgaaagttctcaacccaataaggaaagagaaaagatcgtatcctgaggttgctaagatctatggtcagaacaaatctacccatgatattgtgaagaaggaaaaagaaattcatgtacagtatatgtagggttcggtactctttgcgacctcaggcattcactggggggtctcagaatgtatccctgaggattacgggaagctactatgctttttgaagatgagcttgccactaatgtgggggaatgttggggaggggcttgagtgatttccatttgttcgattatcagtttattgccatcagcctgtcctggatggggcatggcagtgggggtggagggaagagaacagatgtgagaggtgattgggggtacatttacaggtgccatgctgctcaggagaccaggccccatgtgtccacgtgggagttgagggtgagtcttgggcttccgtccaggagtactaggggaagagcaggactggggaggctgcctgaggctggtttccaaaacactgactttgagttgccttggaatcacccaagtggatttgcagatttggatctcaggaaaatattctagactgcaaacttttaaaaagatttggcctcaggcagctgcatggggaggagtgtcagcactgcaggcgtggacggaggcctgagagctgccaggagagctggcagggaagaggaggcggccccctgggatggagacagctctggggagtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgtccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacatttctttctttttgtaaatatagagataagtattttcaaataaattggtgggttttttctttctttttttttttttttttgagacagagtctcactctgttgcctaggctggagtgctgtggcacagtctcggctccctgcaacctctccctcccgagttcaagcgattctcctgcctcagcctcctgagaagctgggattataggcatgcatgactaagcctggctaatttttgtatttttagtacaggtggggtttcaccatgttggccaggctggtctcgaacttctgacctcaagtgattcacccgccttggcctcccaaagtgctggggttacaggcatgagacgccacacccagcctcaaataaattttttaatgtgcatatgtaaattgaaaacattgagcactgggtaatattcatcagaacccatgacaatttgctaagattttgatgagaccaatagcactgtctaaaactagtgttatagtatcaataaatgaacgcaaaacaataattttgcatcatttggggggacaaaattatatatagcaaagaaggcagcagcaacttaaaccttgttatataagacctctgatttgttagagtgtgaggttgaagactggatggaattccatagtgaatggggcatgtggacatgttaacaaggggtccttgtgaatgtgggaaaaagctgcccttacctgagtgagcaagagctgtaaatagagttgggatgatggcaggctcttcagtagcgtttctgcctccacctctggtttccgctgttcaggttgttacgagggggacagagttgcctcttgtctcagctgtgaaagatgatgaggtagaggcggtgtctctgaagtgcagctcggatcaaaggactctatgctcaggaatgacctttggcatgtgccctattatttcagtttctgagacagtgttaattacaggcttcaaaattgaaatttgtaaacaatggggcagttaaaatatgattagccagcaggcatggtggctcacgccaggccgaggcaggtggatcacctgaggtcaggagttcgggaccagcctgaccaacatggtgaaaccccatctcttcttaaaaaaaaatggcaaaactcgcttgaacctgagaggcagaggttgcagtgagcagggatcgcgccactgccctccagcctgggcaacagagtgagacactgtctcaaaaaaaaaaaaaaagttatgctttttagatagttattgttgttatcagtggtcttcagattaattttatgtgcatttgtctttgtttctttgggttgggctgttggattaatattggcatgtaatatttcttagcagtagagaactttctgttgtcattcatcactcactctccctttcagcactgagcttgctggttttattaaaaaagtgcgaagcaaaaacaagaactcactctcaggattgagtattgatgaaattgtccaaagagtgacagaacacattctagatgaacagaaaaagaaaaaggtattttatctagatgttccagtttatccttatttatttataaaatatgagaattgttaaaaaaaaaaaaaagcttcaaaccaaaacctagagagcaatgtactaaagacagaagatggtcaagttgttggataactggttgcttccctcttgtcccctccccgccacccctgttattttcgcagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgtatgtataactgtatagttttgttttttaatgaaaaacaagaagcaaacaaaatttttaatccatgatttagccccattcatttctagacctaatttatttgatcccaacattagaaactgaatttcaatgtacttgaatgtgtccagttagagcaatcagtgaatggccgaggtcatggtgtctgctgtgatacgtttgggcccagcatggagagaagcccctgcacatgagtgacaagggctctgaccatcgtgggggatctgagccttctctctcttgcccttgttttgctgcagatggtcaagtacatgaactttgtacatccagtgtggtattttgaacagttggggaaatcatttttgaataattttcttctgtgtaaccatggctttggaattacacagatgtgtcaatgtgtcgtgtggccacacccaccccaagatagaccgtgattgcctggagaagagggttctgtttttgcttcatgatggatgtttgtagtaacgaagatataaaagctgacttactgaaacttcaccagattgtatgagaaagaaaaatatgtgttcaaactgggacctaatttgataaccatagtttgttaaaattaaaagtattaattttcaaattacaaagtattacatacaatagaaaatacaaataaaaagggcatttaaaaacccgccctgtaatcagtattaccactttggtatatatttttctaaactcttgaatgcatggatatgtgaattagtcaaaactgaatacgctagtcacactttgtatgttctctgaggggctgaatgttttggttgttttccatttttttttttattgtggttgtcctttttttcttttagttagaaatatactgtgcccatcttttctaggaaatagaaaacggtcaagttaagtgtatatttttttcaaactaaacctggctccgagctttgcactgggcattggagaggccttcaatggctcttccccggtctggcacttcctcttcttccctgaccctcgagtcatgggcagcagtggaggggcatgaaccctccttctgcagcatctgccccatctcctcctgggccgagtcatgccttgggagagacagcaaaaccctgaacagcagttcaaggtcttctcagccttggggtgatgcctccagtgccactccctgaacttgatcccactgccagggctgcctgcattcgcccactccctcagcaggggtttttagagcatgagtttgagctaggttttctgccagctgctaaagacccagatgggactcattttgtgccttcaaggcgctcagagttaagaggcagtgagctagagtagaagttaatggtgcagtaagggtaagtgctgtgagctgcagggagaactgtgcctggagtcccaggcgacactcaggtctgctctcacatcgaaagcactgtctatgctcaccagactgtgagccgctgaggccagagccctccattcatctctgcgtccagcacccgacaccaaccctgcccatggatgtttgccggatgagccatccgtttgttttgttttgatttgcacaagtaatccatgctcatagaaactagaaaatagtaaagaaaaagattaaatctcccttaccctgaggcaaccactgttaactgtttttctaggcatgtatgtatacatgcagcccctttattaaaaagtgagttatatatgatacatgttgtcttgttagctgctttcattcagcaggctgttggggccagctttctatgtcagggattatgggcttccgtcatgattttccttttggctacacaatagcccattgtgtggatgtgttggaatttactaccctcaactgttagatgattaaatgtatgattaattcacaccatgccatgtgattatcccatactgtactttaggtatggtaatcttcacctggggatcttctggtcacataaaacagttttttctctgaggaaattagaactttatacttttctttttgtatttttatattttttcttaagaaatgctattaaaaaataagttgtttcctcagactgtttagctgtaattgtgaataatttgccaccctttgtggcagaagatgtttgaaggccacttgaaggaagaactcgtgtcataaaaacaactgtagttattctttactattcaggtgtgtttgtttccacaggcactgggtgcaagttcctgtgaaatatgccacgaggtgttcaaatcaaaaaacgtgcgtgtgctcaaatgtgggcacaagtatcacaaaggggtaagagctctttttggccatccttacagcatgcattgggaccttcaaatattttcaaaataagaaaggaattgttttctagtcatcagtatttattgtgctttcaaactattttctttgcaaacctcccgtgtcagtgttcagtgcctccctgtcctcacaccagctctgcaggaagggcagctctggagaccgtcctttccatcccttgtggggagaggggaacagcagctccagccactcgttagtgctgagattcaaagcagtattagttccttgaaaggtgatttcttacacacttgactaaatggagaaacagtgaaaccatttttttgacttagtgtagtatatgaagtcagtttaacattttagaggagaaaaactaaacctagctgagtcccttctgcctgacccagggacagtcctgctcgtaccgttctgggatctgtgtgtgaactatcatggtgttctaggtaccgtgagcatttgtgtgcacccctgctgctgggttagaacagatcaggtctctgccatggggatttgctaatcccttggaacgggataaatacagcatgctcactgaaaggaattgagaccacttgccaagtctctggtgtggtgtgcctccttgggtacagggtcttatatttgggctagctgactgtccacagcctctgcagtgtgggcagcagcagcaggagtgtggcgtgcaggctggagggctgttccagagccaagggccaaggccaggccaagggatgggctaagaatgagtgattgggtcatagggccgagaatgccaggctctggaatttggcgcagctgaagtggaagagccgagcctggaaccggggatcagggcaagaccaccccctgaggccaggttggaggcccagagcgctcaggatctgaccctgaggtgggatcgtttgcggctggggctttgtccacactctggcctgagcgggtgttggtgtccctgagtattgggcagctccaggcccaagagaccaagggcaagtgagccacgcctgccaaggagcccagcagcacaggggagctaagcttcctcatggtcctgaaggcatcttctgattttgttttctccttttcagtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttcactgtcactcttgtccattctttcttagagaagtttaaaaatgcattcttctggaaaacttaggacatgtatgtcatgctaacattttaagagtgctttcgtcaggaaagaacagccacgccatgctgtgtctgaggagtctgaccagggatctcagggcgttttagggcctgggtcagaattttcctttgtgcctgcgtaagatcgactataggagttcacacagagatgatagagtttacttcttaaggctaaattaagagatttttcatgtgaatacatataaggatgttgaagataaattgcattccttggtatattttttgaggcatttgtggatttatgggccactgaggctgtcgatggggtttcctctatagaggggcttctgggtatgctgagcactcacagagtgaaagctcatttgaagaaagctcattttcaaaatctgtcttctgttttttcaagtgtattcaaagtattatcagtacgtatttttagtctgatggcatttaatttaatttaaagcaatgactattccttaagaatttaggccggccgcggtggctaacgcctgtaatcccagcactttgggaggccgaggtgggcggatcacgaggtcaggagattgagatcatcctggctaacacagtgaaaccccgtctctactaaatacaaaaaactagccgggcatcgtggtgtgtgcctgtagtcccagctacttgggaagctgaggcaggagaatggcgtgaatccgggaggcggagcttgcagtgagccgagatcgcaccactgcactccagcctgggtgacagagcgagactccgtctcaaaaaaaaaaaaaaaaaaaaaagattttagattagttttccctgctgaactgcttaatctatgttatgaataatggatagcctggtataaaattgaagtggtgccccagcaatgcaaaatgttactacggttttaaggtaatctcaaagactacagaagtgcccccacttattcgtgattttgatttccacagtttgttacccacggtcagccgtggtctgaaaataggcaagtacagtgcagtacaataagatattttaagggggagagaccacactcacataatctttactacagtgtaattgttctattttattactagttctagttgttcatttcttactgtgcctaatttataaattaaacttcatcatagatacatatgtataggagaaaacattgcatatgtggggattggaattttctgtggtttcaggcatccactggaggtcttggaacatatctcccacggataaaggatgtgtgtgtgtgtgtgtgtgtgcagtcgcagcaggtggtcaaagtgctcaacacaccacaaactgaagcagtaaaactattttagagtagttttttagtcagatgactggagaagggaattaaaggaaacagtagaagacacaatagcaaagatggaagttccttctgtcagcctgaggtacttactcaggaggctgaaaaagcagaggccgtaaagtgataggatggttggtcagaatgaggaccaaaaagcatctgcagtatgacctcagaaagaaagaaggtatcagaaggagaagctgggagggtatacagatgagtaaattcctggtgaagtgctcagcacagtgcctgcacacaaactcgtgataaccggagctaacaactaactgtcactaagattaagggcctggaaattgcacaagaaagagtaggatagtacagtaggaaagccgccgttagttaggaagtccacttcctcagtgtggcctggattggaacacgatccagtggtgaaaagagcaagaagaaatcagatcacctcaaagtcgttttggaaaataacagctttgttcctgagatctccctgaattgacttcaggaatattgtgattctatagcaatggatcatttcaccttttggctttcccaaattatcggactgagcagctttgagtcaacctt

SEQ ID NO: 16945 - DNA, 37155 bp, Human
actgaggcacagaaccttcaatagcttcctccaggtcatggagagtgagtggctgagcctgagtttggatctagagtctagtctcagaggtcaggggctgaaccgctgcccagtgctgcctgctgctgtttgagcacctgctttgtgccagcaactgggaaatattcttctgtgggcatgtcacagacagtggacactggtctggccaggtccgaagcccagagcctcctccaggttcttgttccctcattgggaacatggtcttgtggacggataatcttgaaccccgtttcttaaaatattctttggtcatttaaagccaagcgggaaggggtggaaaaaagccctttatttgctcaggaaggtgcatgttaaagaaaaaaaaatcgtccaatgagacttgttaaaatggtgaagcgaactttattcaggaccacggaggcaggtacagggaccacagccagcagattttgcagtgggaagaagagactgggatccgcttgagtacagtatgggcaagtgggagttaatttataaccaaggatcagggtggggttggtgggtggaaaaatcacaaagagaaaacatcaagggtaagggggattctggctaaaccaaccaaacaggattcttgctgaagacaggctgggtgatcagacatcacctgtggcacggtggaggctgaggaacccgatcagatatccagagtgatcagataccgagggtgggaggttctggctaaactgactgagcaaggttttttgctaaaactggattttacaaggaaatgcacagatggcctagaaggttcaggagcttgatataagtttgatcaagcgaagaatctttgtccatggagagtgatgtcagaatgcggctttactatacagcatttcgtgttgacggcatctctagctattattgttaactgttcacaaaggacaacaagcaaaatggcccacagctttcttttcattactgctaatcttagcagtggtcaaaatggttggctctgaatttctttcttttttgggtttggggtagtaaatggagtgactgtggacatgttttatggattattttaagcgtatgtatctattaaaaattgagagggcccacatggcctgctttaaaaagtcaactgtgagctgtatttggtgctgagccctgaaccacccgctgggcagtgggtggctactggcagtgcctgtggacgttctcggggaaagacggtctgattgcacctgctcttcctcagttcctagtactgtgaggcactctttccccactctcccacaaccctcagcttaacacaactgtggtgattgctttgtccgttttcccatgaggaccctgagatttcaacaaggttcagtaactcacacatcgacacttccagggagctgtgttgccaggaactggcccaggtctttccctcctgggcccatcttgtccttaatctctgctgacattgatgggtttagttaccttgtcgtgtttcttcagtgttttatgccatacagtctcccttgagtagatgttctgtataggggatatcacagcttcctggtgagaactgggttaagtccagcaggatgcctgggcttagtggcactggagttgtgggtggccttgagccccaggcagtcccctgagagcccttcccgatggatgtttgagtcactgagtgtgttccttcttctttctggtcaggctgtcctggccgctgcacttacaattgcaccccatcctcctacccactctgatcccagaggagagtgcttctgctgtaacctctaaggcacaagtgggtcccaaagtccttaaatatggagggatgtggggaagcagtggtgaagatgcaggccaaaggtcagcaggcaacactggtctttgttgtaggtaaccttcatctagagattcttctagttctttccagatttatcttctaaaaactaactggtatggaaatattacagtcctgtaattctttcttctaggtcatattgaacattccagatacctatcattactcgatgctgttgataacagcaagatggctttgaactcagtaagtggttaattattaccttcctggccttttctttgttcccttgtcccttctgttattcccaacattgtttggggtcagcaattgcaagggctatttgtagggaacgccgggccacgctgatgctgttcaaggcaccctctagaaagagtgagtcaggtgcgcagccacacagctgcccaggtgagtcgcaagagccatggctgttgggtacacgtgggtgatatgcattctcaccttgacctcatcccttcctgctttgcagggcagggggcagggacaaggagtggggacagatgaggcaggatggcgataacaggggtatgttccagggaagagacccacgtgggatcccatcgatgcccaactgaaggactaggaaaagtcataactgcatgaggcatgggcgggccttccctctccctggagcccactccctttggagacaaatgtggctaatctctgctccccattgtaactggcccgtttgccttatacctaaaataagtgcatttagtaaagagttttaaacacttcctagattctatatctggaaaatagaccttgttttcccctttatttgttactgatattcattttttactgggtctgtgtttaatttcaagtccactgctcaggaattttcagggacaaacctgcttgctagtggatggcaagttcttagatggctgagattgcagcctctgactccctcatttagatgagagattaccttgtgttttccctctgtgtgctgctctggttcagagctgtaatcttcggacttttgaaggacagcattagtgagttattaagtggaggtgaactctgcgggccttgtttggctcattccattgtaatcaacttccctggaggcctcatttaaagttctaagagctatgctgcctctgctcagaacacctgtccattgagtacaaacttgctgtcattctctgaggtcaataagagacaaggggcaggccgggcgtggtggctcatgcctgtcatccagccctttgggaggccgaggcaggcagatcacctgaggttgggagttcgagaccagcctgacaaatatggagaaaccccgtctctactaaaaatacaaaaattagccgggtgtggtggtgcatgcctgtaatcccagctactcgggcagctgaggcagacgaatcacttgaacctgggaggcagaggttgcggtgagccaagatcgcaccactgcactccagcctgggcaacgagagggaaacactgtctcaaaaaaaaaaaaaaaaaaaaaaaaaaaaggagagagagacaagaggcagaaattaatgaataggaaaaagttttgcatgggggcccttagatacagataagaggaaaacgtggcctcccagagtggcccagccaacaggtaaccggggagagctgaaagaaggggaagatgtgggctggtggggcccagagtggcctgtttggggcgagtcttgacagggtaggtctcgggaaggcaatttttaagtaggctgaggaaggggaggtgggcattctaagaagataggcaccagctgaaggatggagctgagaataaaatgctacttctaggcagttcctttcacatttatgtatggccacactctgacccagaaatttcatttaaagggatttagctacacctttctaccctctgcacaaaaatgcatgtaatgtgtcagaatgtttattgcagcagagctgctaacagcccatgttgtgaaccactcaaatttccattaatagcagatggtgagtgaatgacgatacattccttatatgagagaagaggatgtagaagaggtatttgcaggataacacagagactatgctcctttaggaacatttcttcactcagtttttttctctgcaaaatgtttgtattaattcatacctgtgccagtctcgctggcagcgggagggattatggtgagcgctcaaggagattatgagtacaggagcctggcggcagctgagttctccaatgttagctattattcttctcattataattatgatattgctagtttacagttttgtatatcaatattcaaggaaaagactggaggaactaaaagtacaggattttggcttaatggattctaactccaaacctctacacaactttttaaaattattactatattttactaaatcccaatgtctgccacttttttttttttttaattttaaagaatacatagcccattgggcaaacttgggtttgcatgcttggcttttcagcagatgcagaagccctggggtgggtttgccctggcttgtgtggttctcgagtttgagtctgtacgtcttgagtgggtcaggggccccagagctttgctgccattgatttctccccaacagcagacaaagtctcacaatgacctcaattttccctctttctttcttttgaaggacccatttttcatggtacttgtcttgactgttttcatagtggtttttttttttttttgagacgggagtttcgctcttgtcgcccaggctggagtgtagtgacgtgatctccattcactgcaacttccgcctcccgggttcaagcaattctcccgcctcggcctcccaagcagctggaactataggcgtgcaccaccatatccggctaattttttgtatttttagtacagatggggtttcaccatgttggccaggctggtctcaaactcctgacctcaggtgatccacctgctttagccacccaaagtgctgggattacaggagtgacccactgcgcccagccaaatctgtatttttgtatgtagagggaaataattttctcaactgtaatcgtgaataaatattgtattaaattgtcatgaaggaactcctgtttaataaatagacatgtaagaaaaaaagaatgaatagtaaaaccaaaccaaaacaaaaaactttggtaattgaaagttctggttagtttttattctaaataagttcaatgtttgacatagttgtagacacctagggagaatctgtagtacctcttcttttctattactttttttttttttttgagacatagtcttgctctgtcgccaggctggagtacagtggtgagatctcagctcactgcaatctctgcctcccaggttcaagccattctcctgcctcagcctcccgagtacctgggattataggcgcccaccatcatacccagctaatttttgtatttttagtagagacagggatccaccatgttggccacgatggtctcgatctcctgacctcatgatccgcccgcctcggcctcccaaagtgctgggattacaggcatgagccaccgcacccagccttgtagtacctttttaatatcttgtcactttcttattaatctctaactgtacaagttgtatagacaggatgcatatttcacaaaataaaataaaaacattatcaatttaaaagatcattggtatagctgtggtatgatgtgatagtttgtatgtaaccctttagtgcaaataagagttttatattattcatcttcttttcaactgtttaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaagtaggattctctttgtgtttatttcctgtaataaacccggggtcccgggtctacctccccagtgggctctctgctcccaacaccactgtcgccacctctcctggtctgacccttctcctccgtcttccggagccagcctgtcttcatgcctttccactctcttcctgctgggtcaaagctgtcgctgccaggcctagcctcttgcccagggcctgcagatacctccctcttccgttaactctcctgtacagctttgcctgttctactcagcgtaggcttcgagatcaccttctctgggtttcttggctgtgtggtttattggtggctgctcttgaataaatggtaagcttccaagagcagaaatcaactatcttacctttgtcatacagtcccctggatatgacaggtcatgtttaagatgctctctgttactttgtgtttagtagatgacctggctggtgcggttgtcacacagaagtatctgagctgtctcattgggcttcagggtcctgcgggtggccggagcaggccagagcgagcgtgggaggactggaggttaaattttatttgctgtcacttcagtccctcctcttcctcaccctaccattcatctcctttctttgccatttcgtttggtctcatgtctttccagtccgcccctcttgcactgcctcccagctgttaattcaggctagtttcagtgctaagaattgtccaggtggaacccgcacagcagtggctacgccaaagatcttttacattgatcttttaattgatagtgcttttattttattttgtgaaatgtgcatcctgtctctacaacttgtacagttagagattcgtcagaatgtgaatttccatgtgtccacatcacataatcagtcatcaacgtgattaatgccagtgctctgtgaagccctgtctgtccccacctctcccccactcaggacaagtgctgccgctcctgcgtttctacccctcctctcaccccctcacccttcacaaatggctcttccaccctgttcctctccagccacctcctgtctctgagttttctaccccttcatgagccttaattcctttctctcccttctctcattctctctttcccttcttccgatgctccccaccgagcagatacttgtgtttgcactgatgttcttctgggggtggttgggtaggtcaaggccagtggttctcagtcaggacaatttggacccccagagacaattggcagtgtctggagacagtgtgggtggttacaagtggggagggggtgctgctcctaggtaggcaccggggatgctgctcaacctcccgcaaggcacaagacagccccccgacagcaaagaatcctccaggtaaaatatcgcttagtgtggaggttgggaactcctgatctttgtccaccgtggggatggaaggaagccagggtgaaggggataaggaactgtctgtgtgagctacccccctaagaaatggcagtgaaggccctctcctgaagtcagcatctccagacggtggtgttcccaccagtgacggctaaacccaggaaggcagacgaacccctggcccacatgatggacacatttccacgtttcctgggaaagactagatgatgacagagttggacagggatatatcagtcccttatcagttgcttttataagggaagaatatgaacctacatgtatgatttttgcattataaaatttataaactcagaaataatttagtaatttaattgaacttaccctggtactatttttaagaaaacactgttggcatctaatatatagaaatgtatacattttgaaagtgtaatgtttggctttgaaactcttctcccagttattgagtagcaccaattcagaagcacccatcaggagtataaggaatttttctagacttaatgtatttatttgctttagcaacagccgtagaaggttgatgattgagtaggagcgaacacacagcttaaaccttaggctttggagaatcgaaggtccatagtcctccaaatgtgcgtgtgaaacaagcagctaaacgtgagaaaccatgaggctgagttgacaaccttaagttggtcatgattgagggaaatggatagtgggttgtgtgtgcgtgggtttttttttgttgtttgtttgtttgtttgttttttgagacaaagtctcgctctgtcacccaggctggagtgcagtggcacgatctcagctcactgcaacctctgcctctcaggttcaagcgattctcctgcctcagcctcctgagtagctaggactacaggtgcactactgcttctggctaatttttgtatttttagtagagacggggttttgccatgctggccaggctggtctcgaactcctgacatcaggtgatcctcctgccttggcctcccaaagtgctgagatccactcccaaagtgcatgggtggtatgagccactgtgccgggccagtgagttgtaattaaactgtgcaacagcagccgtgacaagccaagacccagtggtgtctgtactgaccacgcgctgactacagatgcctgtccagcaaagtaaacttgagggcttcccgctttacacactctcctggtgagaactgtacagattggcacatgctcagtgtgaggttcaggatacctaactgaatagccctcatctcagcagaccagttattttatcttggataaaatggcactcgggaagccatagacggaggaaagtgtccttggtaatgggccagagagggcatctggaatttctctcatgaactaccttggccccagcttgcctccatcatatataatcattgcagccgagttatgagaacatcgtgtgcctgggcatggccctcagaccagtggtgctggcctcatctgtgagcctgttagaaattcagattcaggtcgggtgcagtggctcacacctgtaatcccagcactttgagaggctgaggcgagtggatcacttgggcccaggagttcgagaccagcctgggaaacatggtgaaacctcatctaccaaaaatgggccaggcatggtggtgcacatctgtggtcccagctacttgagaggttgaagtggaaagatggcttgagcccaggaggtggaggctgcagtgagccatgattgtgccactgcattccagcccgggcaacaagcaagaccctgtctcaaaaaaaaaaaaaaaaaaaaaaaatgcaatgcagattcatgcccgacccccaactgaaacagaatctctggtgatgggaaccaccacattccccaggtaattcttaagcctgtaacagtttgagagtgatggtagaattatcagaatgttgtcacaaagagagaggtatggcatcgagccctcagcagatgggtcagctctgagcttatcgccctggcagacctccggaggcacaggtgtggccaggtggggagttccaggctgccacaccacctctccagcctgggagggtctgttcaaatgccttctcctcccctctcctccacctctgcacctttcttcagggaaagctcctgggagctcctggacctggggctgctgggcatcactggggtgatggggatggatgccctccctcctggcccatgagctggctgagcccagcgtctgactctgccatgcctctctggcacctgtagctgtcttctgaactctgtgtgacttttggcttaccctctgaccaataatgctatgtctcactagagaaaaatcagtgaccttttccaaattcgttttttttctgaaatgtgcctttcctctgagtttggtatttctgcacttggaccaaaaggcctgcactggcgctgtccagcaggacttagggacaccatgggaaggttctacagctgcactgtctgacatggtagccaccagccacatatgatgactgagcacttgaatttacatcattttacttaattccatgggacattaattaaatagccacatgtagctttggtggatgtccgaatgggacagtagcatccattcgctaaatagccttgggtaagacaatttattctgctttgagtaccactaacagagtgatgatagtttttaggacagtattattattttgcttatgcttgtaattaccaagatgaggtcttagttctttttttttttttacattaatcatctgcctattttaagaccctcttttagcatactatctttttttttttttttgacagagtttttgctctgtcgcccaggctggagtgcagtggtgtgatctcggctcactgcaacctctgcctcctgggttcaagtgattctcctgcctcagcctcccaagtagctaggattacaggcacctgccaccacgcccagctaatttttgtatttttagtagagacgaggtttcaccatgttggccaggctggtcttgaactcttgacctcaagtgatccacccacctcagcctctcaaagtgttaggattacctgcatgagccactgcgcccagcgaagcataccatactttttaaaagagcctaacctcggtgtactttgctgaagatcacagcttcctcctgttggtctccaaattgcataaggtttagtgttatggaagaagtaggatcgtccatgatatttcttaaaattaaaagtcacatttttaagtgtatatgaaataattatttcttaatgtggtgtactataaaaataatagataacatttgagagcatgacttctaaacaactctggtctgaacgttgcactctcctccttcttccagagactaagaaagcactgtgcatcaccttgaccctggggaccttcctcgtgggagctgcgctggccgctggcctactctggaagttcagtaagtgcagggagcctcgatcccaccatgtgctcctgcagtccccagtgctctgagccagaccctgctctctgggctattgagacctctggaggccctccgtgaggttcctctcttacataacgaggctgtctctcttcccttctcttgtttagctatgagattgacacatcatggggaaagcatttagaatgtacccagtgctttggggtgcttggtgccacccagcactgtgagcacaggttcttctaccttggggccacacccagttacctgtatctcactgcacagcagtggctgttggggaccaggcccacccctccatgtcccacctcctgcaactgcagcctgagccttcccatcagcctggggtggtgcagacccatgtgccattgtggatccttcaagttacctgtgtggcagagaggacgtgtgagtgccgtccaaacccaaacactgagagggtccttcccattgcccccacggaagtaaggtgccccagtgctaattccacttatacttgctggtggcaaggacacttctcctccttattaaagtgggggattggctgggtgaggtggctcacgcctgttatcccagcactttaagaggccaaggcaggtggaccacctgaggtcaggagtttgagaccacaagcctggccaacatgttgaaactccatctctactaaaaatacaaaaattagtcaggcgtggtggcgtgcacctgtaatcccagctacttaggaggctggggcaggaggatcacttgaacccaggagttggaggttgcagtgagccaagattgtgcccctgcactccagcctgggtgacagaatgagacttcatctcaaaaacaaaacaaaacaaaacacagtggggccaggagttggaggctgcagcgagctacagtaatgccacggtgttcctcactccatgaggctcattgggtttctcagcctgaagggcacctctcttctgttttctctgcaagtgggcagcaagtgctccaactctgggatagagtgcgactcctcaggtacctgcatcaacccctctaactggtgtgatggcgtgtcacactgccccggcggggaggacgagaatcggtgtggtgagtcagccttaaccttgggaagggactcctctgctcaccttggagacagcagccgggtccaggggcctttgggtgactgggcctggcgtgcgtccagtacgctgacacatgatgtcattgaatccctgctccaggctgagccctggggctcagagaggttgtgtttccggcccaacctcacccagcaggtgggagatgacagggccaccgaggactgtgtcattggaaccacacgtgctctgaactgccacaggaagtcagttaagatgagcaaactgtttataaagttggagatgcaggctaggaacggtggctcatgcctgtaatcccagcactttgggaggccgaggcagatggatcacctgaggtcaggagtttgagaccagcctgaccaatatggtgaaaccttatctccactaaaaatacaaaaattagccaagcacggtggcgggtgcctgtaattccagctattcaggaggctgaggcaggagaatcacttgaacctgggaggcggaggttgcagtgagctgagatcacgccactgcattccagcctgggagacagagctggctcaaaaaataaattaattaattaaaaacaaaattggagatgcactatgttattttcaaaacaagctgcctttaaaggtctatctgttgtcacagggtgggctcatctgtttcattttattttctgtggtttatctatttatttattttaatgaactaggaagcattgctcctatttatggcataccacatgatgtttggatacgtgtatgcctgtggcatggctaagtcaagctagaacatgggccttacctcatatacgtgtcttattaagaacacataaaacctactcttgtagtgattttcaaatatgcaacatatagtttattaactgcagtcactatgatgtacaatagattgctcgaacttattcctcctgtctaactaagattttgtgacctctgaccaacatctccccagtgttgtcaccccccgcccccagcctctgatagctgcctttctactctgcttctgtgagtttgatgtttatacattccacatgtaagtggcctcatgcagtgtttgtgtctctgtgtctggcttgttcacttagcgtaatgtcctccagcttcatctatgttgttggaaatgacaggatttccttctttcttgtggctgaatagtattgccttgtgcatatacaccacattttctttatcccttcattcactgatggactgttaggttgatgtcatgtcttggctgttgtgaaaaatgccgcagtgagcgtgggcgtgcaggtccctcttcaacacacggatttcctttcctttggatataaacccagcagtgagattgctggatcacatggcagttctgtttctcaccttttgaggaaactccatactgttttccataatggctgtagcaacttccactcccacccccacggtgcaaagtctccatttctcttctacaacctcaccaactcctgttattttccatctttctgatagtagccatttgaagaggtatgagatgatacctcattgtggttttcatttgcatttttatttgtatttttcatgaatttttgagggtgatttcaagggtagttagtgactcgaacagggaaacgatcctgagtatgagggttgtgctaatcatccccctcctgccagctgcgtacggaatggggctctgcagatggcagggagctggctcgtttctctttaagagctgccttttacttttcttcctcttcctttaaaacttatttcctggccggacgcagtggctcatgcctgtaatcccagcactttgggaggccgaggtgggcggatcacgaggtcaggaattccagaccagcctggccaacatggtgaaaccccgtctctactaaaaatacaaaaattagccagacgtggtggtgcgggcctgtagtcccagctactcgggaggctgaggcaggagaatcacttgaacctgggaggagggggttgcagtgagccgagattgcgccactgcactccagcctgggcgacagagccagactccatctcaaaaaacaaaaaaaagttatttcccaagcacagccatgtattccaggcttgtggatcagcgttggtggtggtgtgtgctctcatatcttagttccagctaagcacactctgacatgtttacactagaaccatttgttttttctagaaatagaaatttcagaattgtagagtcagaggacttaccagaaatctcttaggtagttctcctcccctccctcaagtgcagtcctaacctcctggagttttctgtagaaaccacaagcctcagagctggccgagaattctagccaaagatttttccatgccaaagtaatcccccctctcctaagggccatccttggtggggactggtttcctgttaagccctcgctgtcagtcctggctgtggaatttcctggtgaggagcactggcccgtggagctcggccctcgtgccggccttgagcaggcccaagtgttccgtgttcttgatacctttcctccagcacagtcttgcttcccagaaaaaggtttgcacttgaaaatgatgcatttgctgattaaacatagttcttttgctttatttggtttctaaaataaagtgggagtttttgagattgagtagcgtgaggttaagatagcacgtggaatggctttttcttttctttctattttttttttttttttcctggagacagggtttcactctgttgcccaggctggagtgcagaggcatgaccatggctcactgcaacttcgatgtcctggggttaagcgatcccccagcctcagccccccaagtggctgggactacaggtgctcaccaccacacctggctaatttttgtattttttgtagaaaatgggtttcatcaatgttgtccagactggtctcgaactcctgacctcaagcaattctcccgcctcagcctcccagactgctgggattacaggcgtgaactaccgcgcctggcctggaatggcttttgatgttctcctatgtgcacatgtgggtgaataaacaccaacaaagtccttatgttacctgaagagttgctctcttcttaatatttaagtcgtatttatttaaatactttaatagttgtacactattaaagtattattaggtcaaaatcaaggaagtacaaaagggtatgctgtgaaaaatctcttcttccttgctctgcttacttacctaccccgcatccccccatacaccccagacacacacacacacacacacacacacacacacacgcatcactcccatacatgcccacctgtttaccagccaatcacatttcttggggcaactcgtctgagttgcttctctttccagagagtttttgcataaagaagcacaggtatttctgcgttaccatgaccctatttcccagtggttcctagccagttgactctcctgcactggataccatcctggacagcattccttagggaaatgagccccctgttttttcccaccatggcacagttggtcctttgcatggatgcaccattattgcccctgtctcttcttggtggaccttaaggttttctccatccttttgctgtaacacacactgctccaagtgtgtgagcatatcagtaggaaacgcttccaggagtagaactgctaggtcagagggcgtgtggatctgtaacctgacagacctagaccggcttcagtttggttttatccagtttccatattgattattcatataaaaggaaacagacaaacataacgctgtgcatgtattctctcttagaccagaacaggcatagggtgcacttttaatttgtccatttcgtagagtagaaattgtttttgctgaaatgaacaccttaggatgctgaagaatatgacccgtcccatggaaaacattcaaaaatgtgtgtagcgctttcttcccaagggtgtgtgtgcgcatattttaacactaattcactttctacttccgttgctatcctttctgtgagtctttctcagaatctcagaaaagaaactaaattgttcactctagttatcaatgctgtactctatacctggaatttgctaaaagggcagattttaagtattctcaccacagaaaagagaaaagaaaatggtaattatgtgacgtggtggacatgttaactagctttattacggtgagcatttcacagcggatatccagtcatcacgctgtacacattaaacatgtacaattgggttttgttgagacaaggtctccttctgtcacccagtctggagtgcagtggctcagtcatggctcattgcagcctcgacctcctgggctcaatccatccttccccctcagcctcctgaaaagctggggccacaggcatgtaccatcatgccaggctaatgcatatatatttatattttttggtggagatggggttggtctcgaactctgggctcaagtgatcctcccgccttgcccttccaaagtgctgagattacaggcatgaaccacagcaccaggcctacatgtaaaatttttatttgtcaactatactttgacaaagctgagaaaaaaaatcctaatatttaaaaaaaaaaaaaaaaaggactagcttgagaccttttccagctctctggcttatcagctgccgtctcttccgggtgcagatagctggaagggaaagaaaatccctaaaattacccacaagccaagaatgaagtgtctccctttgagccacagtggcagttttgtttttaatcatagaagtgtattttgagccgggtgtgctggctcacgcctgtaatccccgcactttgggaggccgaggtggggggcggagggggtggggatcgcctgaggtcaggagttcgagaccagcctgaccaacatggagaaaccccgtctctactaaaaatacaaaattagccggcgtggtggtgcatgcctgtaatcccagctactcatgaggctgagtcaggagaatctcttgaacccaggaggtggaggttgcggtgagctgagatcatgccattgcactccagcctgggaacaagaaaaaaaaaaaagaagaagaagaagtgtattcatttcagttacttttaaaaaagtgaacagactttatattttagagcggttttaggtttacagaaaatgaaacagacagggcagcgagctccttgtactcctccccagcacacagttgccctgttatgaacatcccacatcagtgctgtgcgttcattaacaccgatgaacctgatgcatacattatgatgaactgaagtcctggacttcaccctttctcttgtacagttctgtgggatttgacaaatgcataatgctgtacagccacaatgatagtatcgtccagagtagttctcctgccttaaaacctcttttgctgcacctgtttctctctccccactcaccccagctatctgatcttcttagtgcctccgaagttttggtcttttcaggatgttgtagcgttggaatcatggagtatgtagccttcaccacatacaccttccttcactttgttggcttcctttacttagtaatatgcattcaagtttcctccatgccttttcatggcttgatagctcatttctttttagcaccaaataatattccgttgtccagatgtagcacaatgtttatccattcatgtaacctgtgaccgactcacagataggatgtggaatcactcaccacagaggcattagacaataatcagacccaagtcatttcatgggggaacaagcccacaggtaccagactgtccagtgagtcagggccactcgtaggaagtaagaagagaggctagagcatagccaggtcctcactttatactttaagcccatgtgtatttctcccaaaccacacagcattgtttccatgctttcagctttgcatgaataacgtgatacttgaacgcatcatttatcacttgctctctttcccacagcgctgttttcaagcttcttcctgttcatgatgctctgcttaacccttaagctgcatgggattctgttctgtgaatacgcccaccccatgtattatcctgcccagcaaaaagtccccaaaactctggatggtggttacctctagggagggagagaagagattgggaatagggagcgacttcaacggtgtttgtaatgttttgtttctttaaataaaagagctgagatcatttcagcagaatgttgatttagagtctcctggacaatttgttgctcaaagtgctctcttaaagagcactttaaaaaaaaaaaccttttatcttattatttatttatttatttattgagacggagttttgctctgtcacccaggctggagtggagtggtgtgatctcagctcactgcaacctttacctcctgggttcaagcaattcccctgcctcagcctcccaagtaggtgggattacagatgcgtgccaccacacttggctaatttttgcattttagtagagatcggtttctccatgttggccaggctgatctcaaacgcctgacctcaggtgatctgcccgccttggcctcccaaagtgctggtattacaggcgtgagctaccatgcctggcttatcttatatatttttaaaaacagcttattgagatctaatttatgtaccataaaattcaagtatataattcagtgcttttatatataaaacatatatatgaaatagcttattgagatataattttttatataaaacagcttattgatatgtaatgtatgtaccataaaatttaaatatataattcactggcttttatatattcacgaatatgtgcaactatcaccacagtcaattttagcatattttcatcagctcataaagaaaccccaagcccttgaactatcaccccatatccctcctcccagcccgtccctcctactcataagcaaccactaatctacttagtgtctatagatttcctactctaggcattccatgtgagcgggatcatgcaatacgtgggctcacacaatataagtggcattccatgtgagtcggctcatgcagtatgtccggctcctttcactgagcataaggtcttcagcactcatccaggttgcagcctgtgtctgaatttcattccctcttctggctgaatcgtattccattgtgtatcttggacatatcctattctgctcacccagccgttggtgggcgtttggagtgttttcgcctttcagctgttttaagagggttgcagtgaacatttgtacaagttttggacccaatgcctgttttcaattctcttgtgtagagagcactttttagcagaaaaagaatagatttgtggcctccctttgtgtgcggtcagtgccttgagaagagtgaactgtgctgccacctccggagccgtggagagcgcggggcttgggtagcagctaggacgatacaagttgggacaaggccaggtgcaatggctcacgcctgtaattccaacactttgggagaccgaggcagggggatcacctgaggtcaggagttcaagaccagcctggccaacatggtgaaaccccatctctaataaaacagaaaaattaactggacggggtggtggacgcctgtaatcccagctactcgggaggctgaggcaggagaatcacttgaacctgggaggcggaggctgcagtgagtggagatcagaccactgcacttcagcctaggtgacagagcgagactccgtctcaaaaaaaagaaaaaaaaagaaagaaactcatggataatcctccctctcgtgcagttcgcctctacggaccaaacttcatccttcaggtgtactcatctcagaggaagtcctggcaccctgtgtgccaagacgactggaacgagaactacgggcgggcggcctgcagggacatgggctataagtgagtatggggcagcacccgccgagtgacagtaacagacagcagaaacacgagaagaccctctctctgcctccctgtgaaagcaccggcacatgagtgctggggacaattgtcaccttccaaaagctgagccctataaccagcaggtggaatttgtcctgctagggctgtgcccagcacacagaccttggctcactgccaccttgccctgcctcctccttggcctctatagactcctggttgctcgggagtgcccagtgctgtggtcatctggtcagaggggtaggctgagggcgttaggtgcctctttttccaaggtgcctctcagccagggtccattcacctccctgggtagaggttggaccagaacagctggcgaggagggttgggctggggagagcagcagagacaaatcctgtgccagtttcacttcattcgggagccatggaagccttttgagctggggagagaatcaatcaatcagactgatacttaaaaaatgtcattcctgctcgtagctctgagggaaggtgggaaggcttaacagggtgtgtgtcgcctgacagtgattcctaacgggggtggggcggtggttaccatttaccagcactgcctggggagatgcggcagccctcaggcatcgggggagagggtggtaggatgctactgccactttgttttccatgggagggtccccaggtgatttctatgcaactttagggtattcaatatgccagttttcagaatgaattaccactcggtgagaaagttggcatcttagctagtcactgtgacatccctaaacagcaggggtgaattacacagcaaagcccccatcacagtccaggaacctggtggaattgataactggggccatgttaacatctgtaccttttattagattaaatgtgtgtatgattatacaatcctatgtccttctcatagtttcttgatcctaacctggataagaaacacgaccaatgaaggaattttgtctgacactttagggttattgaatcgaaaaatcgttacaatattctagcacttggttagaacgtgtgattttttttcctaaatgctaaggtttttccctcttattctgaatgtcgtatgagcggtattatgacatagtataggatttgtgtttgcttatgccttaaccattatcacaaataaggttttcttttttaggaataatttttactctagccaaggaatagtggatgacagcggatccaccagctttatgaaactgaacacaagtgccggcaatgtcgatatctataaaaaactgtaccacaggtatgcagcaatttcttcttgaaaaattttggaatgaaatcaactaggagacaccatggggaatcgttgtcctgagtctgatttctctgagctgcaatactcggtctggatgggttttgcattgggaggagattagagtctgaccaggcctggttactctaagcagcccttggtttattcataggaagtggctgaggtttctctgctatttcattttcagcctctaccgtctgcccttgttggtagcggctcacacttgcaacatcgacattcaactctatttagttttctttcctcttcagacatttagaggtgtacctattttgtcagggcgtggttctaggaatccaagataatgtctcagtgtcccagccagggtgaccggctcattccagtttgccagggacttcactggcttgagcaagggaagtcctgctccattccaggcagctgggctggctggtcccgttagccccaaccccgggacagcagtgccagagggtgctctgtgagggatgggcagcattctggcggcctgggaatgagttgtggtgtttccagggggtagaagtgggtacaagccacaggtcacatgatgagtggctgacctggctgggagggcagaagaggggatggacttaggctcttccttttgctttgcacatatttaggatgtttgcagacttgctatgattgttgctgttatgtgttttctgatgtgaaagatacacagtgtcctttgcccatgagctctccttgcctcccaggtccccagggcttatgcctggtgtctaggcatcacctccctgcctgccaggtgccaggtgctgcatttcgggggaggatgaactaatcaccccgcgccacctttcctctgagtgggagcctggggcaggtttgcattcctggaggccgctggtggaggggtctgggggcctgacttccactgcagcctgctgtcctggggaatgtggcagggcaagcccagtggggagggctgtgcacggccaggtgcacccatcaaaacagcagggctgcggtttgtccctgtggagaagctaaacacagctgcctgggcactttgtaaatgctgagtggttctttgtctttctgggttacacacggaatcagggagccaagtccagccgggcagggacggggggaggggaggaggtgctgccgtcccttggcaagagccttgggaactcacaaggaggctggagggcttggaagaaagaagagaaggccattgtctggtaggctctattctatctcggtggtggtggtggggggaggcgcacttcttttcctctttctgtgcagcagttgccctttgatgcctgagttcttggcttgttttctgtcgggcttctgtgaataaccacatgtgccctggcgctgtgaccacacagggctatccctaccgaccttaggattcttaggaaatgtcttctcttaaaggggacatgtcttcacttggccgtgtcagtgccccagagccagagtccacctggaatgcacctgtagtcactgagaacccggggggtgtgccttagtaagaaggtgtcaggaaggacctattattgtagggcctgggctcctgcaaggtggtttgggggtggttggaggaagcagagatttgctctggattggatgctgtcaggaagcaggggtaattctgtgaggctgctttattattttttttctaggaggaggttggaatgaggctaggctaaagctgtgattggtaaagaaacgtccgtcgctcaagttagccaggacaggaggagacatcagatcgtgattttgtggttgtgagcacaaggttcctgttctgtctattcagacatcatttcagaggaggctccttgtgtcttgccccatctcaggcatggaggggcctagtccgatattgacgctcagtgaaataattcaggttccgcagagcacacggcccagctgtcggggcgggccagctctgcatgccaggggccgcgtctttccttctcagcatagcctgggaaattcactgcaggacaaaatgcatcagttacttcctcttcatccataacctgggatgtttgactcccaaatgagtaactcttacgtttcttctaatcctagggaaactattggttatattgctttcaacactacaaatttaaagcagttataggagcccagaggtttccaaatggcttccttaaaaattagaagatgattttaaattccaagaggaaaaacaaaactagcattattgtatgcttaccctcacaaccgtcctaggagctggtacaattttaagagaggttaagtaacttgcccaaggtcacactgtggggatgtgagccgcgtaccttggctcagtgtctggtctttgccactgtccctatatggatttacttaccttattggagttgtaactagcagacccttctatgtctcagaagacaggagagggaacatcggaagaaatgactgatttctaagcatgtgagaggcaggtgactccgcactatcgtgaccagaatttcccgttctttttgcagtgatgcctgttcttcaaaagcagtggtttctttacgctgtataggtaagttcatctggagtcccccttttgatacttctaactaggaaaagctctctactttcagaacagtactccctgtgtctctgggggcgtgggagggaagaaggtggggtcacgggttggaatgtgcccagcggcgtctcgctctttccaaggagctcctggtttagatttccatggcctgtagacaccttcagccttgggtccaagggacaccccctgagatcaggcacgctcaagaagctgacaaagccctacactttatgccacccatgagctggaggcccggcaggtctctttctccagaaagcaaaggggggtggcgttagtgagccctggcagccacctaacgtggacttggagcatctgcggggctgtggtccagcaccacggtgtggccaccaggtgctcatcagccagtgggacccgggaggagggacaagaccagagaacaacagtgctcttgcctcttctctcctgaattttggacggtggcttagacttgggtgtccccatctctgtgtttagagtgcttacagtttccaaactgtttgcaaatgtggaagccaccgtccctctcctctgggatggcccagtgctgtcgtggggccgtggtcctgagctcagcttttcatttgaagaggtggaaggagctgacaccgtcccatcccggcagggctggctcaggtcttctttaggtcctgagtgggggtccagcacagccccaagggtgcgtggcacccgccctgccctctgcccatgcactcatctcctggtggagaagacactcacacacaggaagcagggaaggcagcagacctcactcacccctcaccccctcactcaccccctactcaccccctcaacctctcattcaccacccaccccctcgccccctcactcaccccctcactccctcaaccctcactcacctcctcactccctcaaccctcactcacctcctcacctcctcactctccccctcatccctccctcaccccaccccgtcacctcctcactcacctcctcaccccctcactcacccttcaccccctcactcaccacctcacctcctcactcaccccctactcaacccctcattcacccctcaccccctcactcacccctgcaccccctcactcaccccttcatccactcacccacctgctcacctcctcactcaacccctcaccccctcactaatccctcactccctcaccccctcacgccctcactcacaccttcacctcctcactcaccccctcaccccctcaaccccttacttaccccctcactcatcccttcacccctcactcaccccctctctcacccattcaccccctcactcatgccttcaccccctcactcacctcctcactcacaccttcacccctcagtcaccccctcactcaccccttcaccccctcaatcatgccttcactccctcactcaccccttcaccctctgaatcactccctcatcccctcactcaccccctcactcaccccttcaccccctcacccaccacctcacccacccctcacccaccccctcacctccttacccctcacccccctcactcacccctcaccccctcactcaccacctcacccacccctcacccaccccctcactcactccctcatcccctcactcaccccctcaccccctcactcaccccctcactcaccccttcaccccctcactcaccccctcactcaccccttcaccccctcactcaccacctcacccacccctcacccaccccctcactcactccctcaccccctcactcaccccctcaccccctcactcaccccctcacctcctcactcaccccctcacctcctcactcacccgctcacctcctcactcaccccctcgccccctcaccccctcactcatcccctcacctcctcactcaccccctcaccccctcaccccctcactcaccccctcacctcctcactcaccccctcaccccctcaccccctcactcaccccctcacctcctcactcatcccctcacctcctcactcaccccctcaccccctcaccccctcactcaccccctcacctcctcactcaccccctcacctcctcactcaccccctcacctcctcactcacccgctcacctcctcactcaccccctcgccccctcactcacccctcaccccctcaccccctcactcacccctcaccccctcgccccctcactcaccccctcgccccctcactcacccctcaccccctcaccccctcactcatccccttaccccctcactcacgccttcaccccctcaccccctcactcaccccctcacctcctcactcaccccctcacctcctcactcaccccctcacctcctcacccaccccctcactcactccctcaccccctcaccccctcactcaccccctcacctcctcactcaccccctcacctcctcactcaccccctcacctcctcactcatgccctcaccccctcactcaccctttcacctccttgctcatcccctcacttaccccctcacttcgtcaatcacccccccacctcgtcaatcaccccctcaccttttcactcaccccctcactcacccccttacttcctcacttacctcctcaccccccactcaccccctcaccccacactcaccccctcaccccacactcaccccctcaccccccactcaccccctcacccctctcacctcctcactcaccccctcacctcctcacttatcccctcaccccctcaattaccccctcaccccctcaattactccctcatcctttcaattacccactcaccccctcacctcctcactcctcactcactccctcactcaccccttcaccttctcactcacctcctcgtctcctcaccccctcactcacttccagccctgcccctcccatcttccttttctttgtgtgagaatctggggtccctgagtggtgtcagtccctccaagactcaaggagtccccagggccttgttatccagaacacccccacctgggtcccgggagaccccatgggatcacaggagtgttcagggaagtggtgcttcctgggtctgggtgggctggaggggcatcctcccttccccaagaggagacccccaggagccccctaagtccatccccagcagtggtgcccctgccctgtccttgcagcctgggagacccttgggaggggcgggcgctgggtggctgggcggcttctgctggtctcaccccactggcctcctgtttgtcatcctcagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaagtatgccaggggcggcgcgggccgggtgggggctcagggctggcctacagccaccctgtgaccttgagcaggtctcaacccttgcagccccggcatccttgtgtttaaatggggagagtattgcacctgcttcctagggctgtgagacatcaagtgcgctcatgccaggcagtgcatggctgtatgcactgagtgtcccctgcacgcagggcacagggtgcaggtggaacattctccacgatgtcgccgtgaccagcgttccttccagccactgtcctctgagctctgtcctgcccttgagcaaagcccctgccccctgaggtatcctgtctccgggacgctagtcccaggagagggcacactcagacaggcttcaggctgccctgctggaaggtccctggggttaagcgttcttggccacagcattgctcatgcagagggttaggtaggggtgaggctagccgtgacagtattagcatttatggacgctaccaccccctccccttttccttaaacacatagtgcttttggtcacatgctgctttggaggaggcctcacttggcggatgtatttttctgccttagagagaggctgaactgggtttgactgttggcccagccctctcttgctgcgtgcccttagacgattcactcaacgtctctgatccatggcatgtacaactataagatgggcatgcccttctcctctcgggctgttatgaaggtcaaggaagcaagggctgttacccaagggtgctcccttctctccccctcttcacacccccaggtgctctgggccctctaggaactgggtttctctcaagggctgttacccaagggtgctcccttctctccccctcttcacaccactgggtgctctgggcccactaggagctgggattctcttaagagggaaactcttggataaaggaaatggtttgattgatatcggacaagtctgttcattagtatccatttattaagcacctaccatgtgccaggaaatgctttggcgtacaaaggaaaataagggccagtcctgctagaaatggccttgaaaccccagggagggatgtcggcccattgtgggtgctgcagattccttgaaggtgatgcaagagccagaaagaaggatgatgtggggggctgaggcagggagtcggggttgggggagtgtgggggagaaggggagaccgagcccctcttccactatctccctgtgtggtttttggtgaaccatcctgcctctgggtgtcttgcctccagcttctgacgttggaagttcatccaccgagagctctgtgtttatggctctgagatactgagtccttcttctctcccagacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacggtacgtgtggctcaggcttggcaagcaggttggcagaatcttaaagagatgttgattggaaatgacacttgtgctatgccaaatggaagggaggcatttgcgttgagcgagggtagcgtgcagcgggtggccaatgggagaggctcacagaggctaagagcacctgccgcattttgggggaggcagcagccaccacatctgttctgtactgtactgagtggtggtgattcaagccaggcatggaaaaggctagaacagggctttcccactgcagcacccttgacatctgggtggttctctgttgtagggctctcttgtgccttgtaggatgtttaacagcgtccccagcctctacccactggaggccagtagctaccaagctgtgacaaccagtgttgcctgctgacattgccaaacatccgctttgaggcaaagtcacttccagttgagaactactggcctaaaatgtgtaaagatccttgatttttaaagatacattctaaaaccaagttgcttaattcaggacaaacatgctttctcttagcctcttattcggtcccactctggtccatccaagggtctggaatgttctagccccatgtggatacagaagaagcaaaacctcagccctccctacagcatgtctgtattcacattgggaaatggttcacatatagaagagcgaatgcctgagcaatggcgtggtgcctctggggcgaaagctgactccattgactccatcggctttttggctgttgcctcctgtgtgtctttcccgtcttggtcacctggagatatgtaattttggaagcagagctagcaaataattcctcttataagcagagctagcaaataattctacttataagtagcataacttcttgcctgccagaaggagaggtctggcagggggagaaagtgagaatgtgggacttgttgggatgcagggtcctctgggcagggtggccagggtgccaggcccagcagcctgcatgtgggaaggccaggtggagacatagcccgaggccttaggtgatacccgcctggctcactgtgttttctcttcttgaaacagacctagtgaaaccagtgtgtctgcccaacccaggcatgatgctgcagccagaacagctctgctggatttccgggtggggggccaccgaggagaaaggtgaggctgctcctgggcacacaggactgcagggcccacagatggagcattgggttcggaagtgggaggtccaggttttaatcccagttctactactcaatgactggatgactttggttgattcccccagtccttgtgcctcagtttctccatctgctaagtgggagaaatcctgcccagcctacctaatacactgtgttcttatcgtgatcacacagagcagcatgtggaatggcttttgaagtatctgggccatacgagtttagaggtgcaggatctcctgtgttgcactcattgtgagtttagagctgccctggagatcccaccaaggcctgcgtggctgagtgacagggggcttggtgaggacgggcatcctggacccatggtggccacatctaagcctgtcctctgccctgataaccacagagagaggctctctccacccacttcctttgcaatctgcatttctctctgacagtctttcaaatgaagggagcctggctgcttcatttttatggagggttggaagtgcttagtggcaggcacaaaggttcattttacatattgtttatatccttctcaaaagcgtctaggccatacagacaacaaatcctttcaaacaaggggaaaagtacaaaggttgggtgatttctggggagcgtcagggaaggtagtggggggcatcctggctcctcatcagcagaaacttactacagtagagccacaggctgggcaaaagacctcatggaatccaagatgaagggaatatcgacaaatatttgtgcgcacctgcacctagtacaggctgggtgctactcaggtgctgggaatgcagaagtgaacagagtaagacaaatgtctctgctgtcaggagctttacctctcttctggatgtcggtggtggggacggggcaggtgtggtcagacagatgggagacaaacaactgagcgaggtacttccaaacatctgagggtggggatcacaaggtcccggctattttgaaggggtggtcaggaaaggcttctcggaagaggtggcatttgagctgagactcaaatggcaaaaatgtgtacacatcaaaaaggctagtgcatgtatcttcaggtgtggtcaaggggccaaggaggtgggctggggccagattgcataggtccttgtggattatggtgaagacaccagcttctcatctgcttgaggtggggagatcgtgagccggggagtgccatgatctggcagctgcgtggggagtggggatgaatggatggagacgaggatgatggtgacaagtccattgctgtggttccttgagacaggaagccagctcatagcagagtgcgggcgtggatgtgaagagatgagggtacactagggctagagccaccagacttactgatgggttgcatgtctgtgggagagagagtgagaagtcagggacgatggctttccactctgtggctgaagccccagggtggcgggtggtgccatttttcaagccaggaaatattggttggtgagaatttggggtgggagaaggtgtgacggagggttctggttttgcacactaagcccacggtgcccagaagatgcccgaggggaggcagcaaagcgagagtgggaaatgcagaggtggcaagtgcaggccgtgtcttgagaagctctaatgtgcaggggagccgagaagcaggcggcctagggagggtcgcgtgtgctccagaagagtgtgtgcatgccagaggggaaacaggcgcctgtgtgtcctgggtggggttcagtgaggagtgggaaattggttcagcagaaccaagccgttgggtgaataagagggggattccatggcactgatagagccctatagtttcagagctgggaatttctttccctgaagctgaactccagagctgcattcagcacaggcaccgccagttgtaaggagaatccaggtttcccaggagaggggttggtgctgggatgagctgacgggggcagggctggagaatagggctgtgaccatctgtgtagtgcgtgtggaggtctcagggagggaagtgtgctctccctgcgagagctgcaggcaacactgggagctcaacaagtctccctgtccttagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccaggtaattcaacatttttattctacctttggtccttaccagatcctactgaaccccccatgagagagagggcattcttggggtcagcagagcctcctcagtgacacggagccagctcggggcagtcatgggaagtgacggccacaaacagtgcgaacgcttctggtggcagaaggaagtacagtcaacaaatcacacacaccctctgaaaaaccggtatttggtaaaagtgccagtggaacagaaacaagtatttagactattttaaattatgaacggcaatttatttagtaacttttagcttgaacagattaaaattcaggatgggggctatctctttgggggttacatctctgttaccatcaccccttgatggtggagattcgaagcccacacagtcactcgtaactcacactgcgacccccgccccccaactcctctaggcctggtcagtggtgtgcggcagattgtgacttgattttctgctctctgtaccttgctgtgtcccacagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggtaactatcctgtcctccttctgactgtgttctccgattcctcgagccaaagccagacatctgttaggcgtggttctgctgctggaagctgactggtgaccactggtcagcatgaagcaaactctgcttcctccagccacagccccatccccccagtgtccacccattgcccattgcctctcactggcttcacttgcatatttcccctggtgtttggatgaaaagcgctggggctcagcttgtgtgaaattccttggtgctctgccaaccacacttcgttctggctcagctgactcagctgttccacccaggccacctcacatcaaactttttttttttttttttgagatggagtctcactctgtcgcccaggctggagtgcagtggcacaatctcgactcactgcaacctttgcctcctgggttcaagtgattctcctgcctcagcctcccaagtagctgggattacaggcatgcgccaccacgcccagctactttttgtatttttagtagagatggggtttctccatgttggccaggctggtctcgaagccctgacctcaggtgattcacccacctcagcctcccaaagtgctgggattacaagtgtgaaccacggtgcccggcctcacatgaaacttttgatttatagagagcagagggaagagccggctgtgcccatccttttctggggccatcgagtggctcctgggcagcccccaaggttaggaagggcaggagcagccagggttctctgatgccccagactcaagcacgagggaaggtctcaggggttccatgtgagcctcatggatgtctctgcttagcagagccctggctttgggcattgtccagatagggggtgagaaccagatcttctcatctccaggacctcagacgtatagttttctcagatttctgtgctttctggggctgggctactagtggaagaaagcagtctattctgtcttctcccaaatctcccagatgcccagtctgttgaaggaggagcagaaccagggggcctttcccgctgaggcccgacctgtgtctccttcaaatgacacgcgggactcagggccttcccatgaccatggggcccagggggcgtcacctggcccagggcccagtgctagaaacagatgaccccaggaggaggaggcagggcaggagggaagctggcagggctgggatggtcagccaggctgaggggcggactcgcaccaggatggagctaggaaatgatccaggtgtgtttggcggctgcaggtgggtccgcatggctgtgcagggagggaagggctgcgtggcaggagagcagccgggggaggcccagactctgctgaagagatgcctgttgtgccggcctccacatccgctgcccgctccttccggagctcctgccccgccatgctcagcctgactctgaccaacacgttggagagaagaatgatccctttgtgctattaagcttgcttatttggtttctaagtgcttcatgcgaacctagaggaaaaaattattttccacctttgtttgtcttaagaaaataacacacttttttttttcctatttgaacaggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagtaaccactgcatctttgaagttctgcctggtgagtaggaccagcctccatttccttataagggggtgatgttgaggctgctggtcagaggaccaaaggtgaggcaaggccagacttggtgctcctgtggttggtgccctcagttcctgcagcctgtcctgttggagaggtccctcaaatgactccttcttattattctattagtctgtttccatgctcctaataaagacatacccaagactgcaatttacaaaagaaagaagtttattggatttacaattccacatggctggggaggcctcacaatcatggcagaaagcaaggaagagcaaatcacatcttacatggatggcagcaggcagggagagagtttgtgcacagaaactcccattttttaaaccatcagatcttgtgagacccattcactatcacaaaaacagcacaggaaagacccacccccatgattcaattatctcctatcaggtccctcccacaacacatgggaattatgggagctacaagatgagatttgggtggggacacagagccaaaccatatcattctgcccctgcaccccccaaatctcgtatctttacatttcaaaaccaatcaggtcttcccaacagtcccccaaaatcttaactcatttcagcattaagtcaaaagtctacagtccaaagtctcatccaacacaaggcaagttgcttccacctatgagcctgtgaaatcaagagcaagttaattacttcctagatacaacgggggtacaggcattgggtgaatacagccattccaaatgggagaaattggccaaaataaaggggctgcaggccccttaaaagtccaaaatccagcagggcagtcaaatcttaaagcaccaaaatgacctcctttgactccatctgtcatatccaggtcacactgatgcaagaggtgggttcccatggtctggggcagctccacctctgtgacttcgcaaggtatagcctccttcctggctgcatcatgggctggtgttgagggtctgcagcttttccaggcacatggtgcaagctgttggtggatctaccattctggggtctggagaatggtggccctcttctcacagctccactaggcagtgccccagtagggactgtgtaggggctccaaccccacatttcccttctgcactgccctagcagaggttctccataagggccccaccctgcagcaaacttctgcctgggcatctatgcgtttccatacatcttctgaaatctaggcagaagttcccaaatctcaatccttgacttctgtgcactggcaggctcaacatcacatgga

SEQ ID NO: 16946 - DNA, 111677 bp, Human
tgtacaaactttaattagacttgattttttaaaaatttcccttgtggcttttaattattagacagagcaaatgtctctagtattaaacttatatgtcacatagcctctttatcaatggccctaatacatttcatgtgcttttcagaaagattatattcttcccagagctgtctgaatgtctttttgaacccctcaagactggacaccaaggagtataaataatcattttaaaaaaaatcacattccctccacaaccttgaatctgaaacgtgaatatatgaatagaagggctctggaataactatgcagatttatggagaatatcaacttaagttatatcacgggatccagctatgcctttcttcatggagttggggatttgttaaagttgagatatagtttgggggaagtgtgatttatggttaaagtcatctgaaaatcaatacatttgaagatctctgacataaaggtcccttgcagagctagacgtgattctaaaattgggaacacaggaataaaaatcaaatcttgagtagaagtagctgaaaattgcagtgattcggggaagcttggcttctaactccccactgtttgaagatgggcttgtttgttttttaaaacagccaacataattcagctggaggaggtacaaagaattttctattccttgtttctgtagaaatcgatggactttagcttgtctaattgtcccccctgcctttagtatctaaaataaaataaccctcgttgcttgcattactcaacgcatttctgcgtcttggcgtctatggctaaacgagtattaattagacagtccgcagagagctggctggggatagaaggggaggtgggggagaagggcagggatcacagcagggtggactcgtggccctgatttgggatcctgacagcaacttactaggtggcctgagggctgggtgccaggggaggcagcgggttccagtagcatctgacctgcattagggacaggggcgcggcggagggggcgaagggggcgggggtggggggaaggtggctggggtgaagcccagcttcgcagctagctgtgggcaacagagggagtaagggggggcaatgaggctggggccaggcgccagcagcagccacgccccccacctcccccgatttttagggaaaattctccaaagctctcgcatcctcctctgcctccttccaccctccaccctcccagcctccactgagacctctttaaaaccacccaggggccgccgggggatgaggccggggaacgggctggactgagggcgggggctcgggggcagcggacgggaaacgcctcgaaagcagccagacccggcgactgaaatgaggcggaggagcttggcgaggggaggcgcaggctcggaaaggcgcgcgaggctccaggctccttcccgatccaccgctctcctcgctgacctccgagtcacccccggaagctcccgccactgccgggcgaatagacccccgcggacccccaagcgcgcggggccggggccctagttcaggccctcgctgcccctttaagggttctcgaaactttccccccggtatcagatgagcctcgtcacatccgttggccgtggccgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaaggtagggacccccggctgctgccgcgggcttttcgggctcgttggagggagggggctgtccagagacgcctccacgcggcttagcgtcgcccccaaagcagcagctgtccccgcacagaagagcggggaacgcagaggggctcgggtgggccggggagcgggggcgctcgctcttgagtcgcggaggacggcagcccccgcccggggcgcactgaggggtgtgcgcgagtgtttcagaacttgtgagctccccctccgcggggctgggcgggagaggagacctggaacttgccgcctccaataacgtgatttccttcttgcgggcgacacctacttccagcgggagacggagcggtgggccttgggcgacgggctattatggggaaaatcacctcgtgttcataccctccctcccccccgccccccccccaccccaccaccatgctgtctcattgctaaagaggctcgtggccggcttccaaaggcgcagtaccctttaaaaaggatttatgcatgagctcagctaaaagcaacccggttaagaagtggctcgcttgctgctctgaggaaggagcagcgtctcccctgcgcccgctttcctttctcggagttggtttgtcagctgtgtcctcgctcatccggcggccctgcccctctgcacggagcgatgcatctacacgcgggtgtgcagagtgtgaaaagcattccagctaccgggaaaaaaacaggggctgagtgaggtgtccggggaccaagtggtatcccgattacaacacaaaaataaaatcaaacagctttccttttctcttactctgatgttcatttactaacactttttgtagcaagaaacaaatgttcccaagcacagtgatctgaaaaaaaaaaaaaaaaaatcccaattgatctgccccctcctactttcaaactgtctaatccaagtgggatttgaagtcctttgctcaattgaatgcactatttgaagatagtttatttttatttttaacattgtcatttgggttttgattcagctatgattcccccataaatagaacatactcatgacttttgtataattctcattaaattattcaagactttaagaggaaagacatgccatgctaattcttttaaaaaaggaaactgccgaataacttctgtagttgtttaattagtttagggggaaaaaaaaaccttcaaaagcgtatattcaaactttgattctagttgcctttcgtctaagtcatgggaagccacgtgagtgatctttgccatctccaggagtggatggttagagggagggaataggaatccccatcagctgagggagcttaacttggctgtaagatgtggtcttggtgcagccaacacgtgggaacatgtgcctggtgctgagaaccttggaaatatgacaagatattgaggaagaacctcttctgtgacctgcagagaatcttttggaacaggccttgaatgaatccccattggacatgtgtgctttgatgcgagggaattctctctactaaaagtaaatgtgggtggtctgagggctatgataaaagaagccctgaaaccctccctccagagcaaaggggaaagggagaagcctgaagaaggactaaaaaatacttaactttggcaatcaaaaaaaaaaagcttttataaataataacttgcctgttaattaattcaatgacctttattttaaaatgatgaggtttaattaatttaattaacagaaatgtattgagtacctaggctcctgtctttaccgtagccaaggcagtagttggttcaagattacttctcaaccattagcatgtttccagggagcgctgcttctacagagacagatttaatttttacatgtgatggggaatgaaatatcctgtacctccctcctggcttgatttagcgataagctgctttataaccaaatctttccaaatgcctactgtaaagtcaggctttcctgactactgcattaggattcactacctgcctgtgttgccctgaaatgtctctgaccaccagcagggtgtcagcagccggctagagggggcagcagtgaggtgacttctgaacctggagtgagctttcctgctctattaatggccaggagtcatgcatttattctctgctgattctctgaagcctaaaataaaaattgcttaggtggagagaaaaatggaattgtaaattcaagcaataaataaccaagaatttttcaagaattaagtaatagtcatagacaatgtctgaaagctcagtacgtgacaagcactgcgctctgtgctttaggtgtgctttcccaggaatccccacccaccacccaccacccctcgggggtcttatacgcatttgggggtgggaaaactgaagctcggagagactgaatgactttccagggcaacagggcaagaaagagggagggccaaaaatggaagccagggagctgaacttcagaagccaagttctgaaccaccagacagataacgacttccttcccttcatgcctcctgatctctttggttttggcctcaaactaccctttctagccagagaaccctgaacgtacaccccaaggtgttagggacttattgtatgactgcaactggaccctccggaactccgtgctgttcccccatctcctctttccttcagcactgctgaatgagcaacagaatgaagggctggatccaggtgtgcacgggagaggccttgagaggagaggttcaacaggaaccagagccctccagctccccttcttttatgggaaagtcaactgttggaagtgtgcttgttccccgaaggctttaatcaggaactagaggtccattgtttaaagcccagtgactctgtgaggagtcacaggcatgtgcccggaagcccgcctgagagctgcaaggcgtgtgtgctggcaggcagggccacgttggcatggagatgactgccaggtttgcggctgatcccattatgtgggttctttcgaactgtagaacttttgaacagttctttcaaccagcacctgcttgaaccgtgcaatttggtcttattaataataacactcttctaaagtaattataattacagcaatttctattatgaaaaaagagactttcatgttaacacaataactccagctgaagacaggagaaggtgtgcagccatataccttgtagtagcttcaaaaaaagcctttgggattctttttctgaaagattttctgtcatctccactaacataggtaaagcagacagcaaaactattctcatacctgaacacttgaatgtaaagggccacctaattattttggcgaatcctattttaatcatggtgcattcacttgattatcagcctcttagtacacaattatttggaagacttgtattgaaaatatggatccagcatatgcaataagagtttgtgttcttcagaagaagccatccaggctccccaaatgaagctgactgtaggtgaggctgaaaacaagaaggcaatcccagcaagaagaaatctgatggagccacttgaaatggtaaactattaaagacaatgagaaaaaacaattactgaggttgaaagaacaagaaagtcaaagccagtttgccaccagctccttcgagtgagaagtggcagcttctgggctttagagaaagaattcatcaaagactgtattacagaggactgggaaaggtgagccaagaaatcagcttgaaacaacaaggagggacaggagtctgagaaatagtttataagatcaagagctgaccttgatttcttgctgatggagtgttggacactcaaagggcacgtgaagccctgtgcgtggctcacctcattgtatccttgcaacgtcctggaaaatgtgcacaacaatgtgacttaattttcagacagggtaaccgaggcttggagaggcagagtagtttgtccagggccacactagtgaaggcaaagcagggtggagctgtcaatctgggtcagcccagctcagtctttgcacgtcactgccgttcctccttaggtgcagtgttttagttacagtaactttttaagaagaaccatcttcatgcttctggagatgatgtggtttgacaggaagcatcctgatgtgattacaggtcctgagcactgtagtgtcacacctgtgaccaggagcaagtgtgtaacctccctcatcttccctttcctcagctgtggagaatcaaatttctgcattaatgtcctggtctcaaaacaatagaaacttgttctcataattctgcaggccagagttcaaaaagcaaggcgacagcagaaacactgtccctccggaggctctgggggaggatccttccttccctcttcttagtgtctgatggctgctggcatttcttgacccttggccgcatgactccaatctctcccctccatgtaagtttctgtggccaaattcctctcttcttataaggagaccagtcattagattagggcctgccctcctctaacctgacctcatctttacttcatcacatctgcatagacccactttctgaataaggttaagttcacaggtaccggagttacgtcttcagcatatcttttggggaacatgatttaatccacaacaagttcattctaagtttttcattctatggattttttttctttgattctacctcaccttttaattgttaataatttcaatttgggattcaagtgtaattgttatcacaggcaatacacaaatgacgattttagtgctgtattgatatgaagcctgcggcaagagagtgccctggggcttagggtgggagaaggaagagaggagtgtttctgcttcccttctgtacttctgtattgtttttcctgctggagagtaactgcttgaaaatttaaaatgtcaggcggggcgcggtggctcatgcctgtaatcccagcactttgggaggctgaggcgggcgggtcacctgaggtcaggagtttgacctgacccagcctggtcaacatggtgaaaccccatctctactaaaaatatgaaaattagccaggcatggtggcttatgtctgtagtcccagctactcaggaggctgaggcaggagaattgcttgaacctgggaggcaaaggttgcagtgagccgagatcgtgtcactgcactccagcctgggcaacagaacgagactctgtctcgaaaaaaagaatttaaaatgtcccatgtcatgttgcactaattctagaattgctgaaattaatgtataatatgagagaaatccaatgtgtacaagattagatcaatgatatttaaatacctatgagtaataaacacttatgttgggatggatgtagaaagcttcagtatttcatgttttaaagacattataaggcaacccccttatcaatcaggatatatttaatatgaaacaggtgcttccccccatacttcccgccatactcatccctgatctccttgtgtgatctccttgttgtaggtaagttggcttcacctccccttgcctgcccatttttcctttttcctcctggaatgatcccaaaatgataaggatagctgttgtgatcagtggcctttttttttttttttttttttttttaaacagtctcgctctgttgccaggctggagtacagtggcctgatcttggctcactgcaacctccacctcccaggttcaagcgattcttctgcctcagcctcctgagtagctgcgactacaggtgtgtgccacgacaaccagctaatttttgtgcttttagtagagacggggtttcaccatgttgtccaggatggtcttgatctcttgacctagtgatctgcccacctcggcctcccaaagtgctaggattacaggcgtgagccaccgcgcggccaagtggctattcttttgtggtggtggtacgtagctgcattgctcccaggggtggagagggaggaatttaaaggtggtgtttctctccttctccctggtatctgacagcatgccttgggatttatgtaacatctcattcatagactagagcaggtcaagcattggcccctgaattcagggtctacctgtgctggagaagaggtggggggttagtgggcactgactcttgccccaaccccacactgggtacagcaggaacggggtggtggtcctccttgctggtgagtgaggtccctctccaggtgacctgaggctcctatgactgactgtgagcctctgcctgtccttgagtcccttgctgtgtgtcatggatccctcctctgggtcaccctgtttgcccagccttggtgagacactggggttcattgtatgttaaggtaacagatactacccggacaatagggcatacctgtgaggcaggtgggcagcctggcaccccttctgtaatttccctgggtataaacatgtttctggtggaacctgaggaagagagtgtcacctcttctgggtgactttcctggcctggctccccttcatcctctcttggcctagatgtactaatttgatatttgactattgctactcaatacaaaaaaaagtggtcacttttttgctcttagaattctcaaaagaagagagaatactctgggagtgctgacattaaccacataaaggaaatgaaatgagtgtgtttgttttgtgctaatgcttgctgtccagcccaggccccgggtgggatgttttcagatttttattatatggcaatcatatacctgcacctagaaatatacaacctcggcgctgccattgcaggaagacaaagagactgtctagagagtaacgtggcgatgccctgggcagctccatcattccagggtaccataaagggaagtgggaatgcacactccatctgtttcacgctaggctgaaagtggcagggggagaatttacacctggcctgcaaaaggcagccttgtgttcccacttcagagccccaacttctccaaagccagtgcttgggaaatggccttgttggcagcaggcaggagactggtgcagtgtgccagctgtgcaaacccccaccagactggtgcagtgtgccagctgtgcaaacccccaccagcagcacccccaccagcagccaaagaaaacaatttctaaagcagcccccaggatttcatgccacgggggtggtgaggggtaggaggaggtggaaagcattgaatcagaaagtcttccaggtaccagcaatgccagggttaatatggtctggcttgcttttcaggtgagcacctgtagctggcaggaaagtggcttcttggtggaggtgggcatgaattccagaagccttggagagacatccagagcccttcccactacatcgtgctgcctcctggggaaattcctaagctttttttgaatcagaaaagccactgacaagcagacagaattgtgtggcttgcgcagtgattggagagctaggtgctttgggtactagtcccagagctgctacttgtcgaatgttgggtattggagagaagtcatttgagctgtctgagcctctgtttcctcatctgtaaatcagggaatttgaacaagtgacctcagattccttctagaagctctaacagtcaatgatatcatctatttcatttgagagaatctccatagctctaattttttgcccccagaccaatctgcttcagctttgtgtgggtgcaacacctggggtcctgttaaaatgcagaatcggattcagtgaccgagagcagagctgagggtggctgctgccagctcacaggtcacacttggagtcgttgcttctttccccaaaccagctgccgatggttcctggaaagagcaggaataccttgcagaagggcctagaaatagagattcccatatgcagtccagacttattgggtgagcctgtctgcactaggacctgagaatctgcattttattatatcccttgagtcccctttaagcagccacgctggccccagccattggactctatttggaggccactgcagaggccagatgcccctctgctcggcggtttcctgtgcagaaaggctgtgttctttcttcttcctaaatactcttcctaggttaagtgtttccttctctttgcccatctagaaaatctccacctcaagcaggtcgtgttccaaaaactcctcgtgttgggcaagtggaaaacacgcagttttttctaggggtctcattctgaggcggtgctgctgaaaatcttggtgctgaacgtgtgtttttgagatttccagtctatcacagggccacaaggtgtaaatatcaagaaaaatgaattactagaaaggcaaagtgaaaaagacatacaaaatacaagtgtcattctttttattcttagtttggacagatagtccattcttctacactggtcccacggtttctgaagcttcctgtaatgatcagtggttaccttgttgcccaagtaactgcaaatccctcctctacaaagtgtgcttgctccaaggcagtgcaaactagaagttgttacaaatggttccagtaacaaatttgtttggcggccttttcccatgaatgagacagtggttatttttgctaaagcagaaaggaaatgtgatactattgggctgtgttttgccctctggagtaatcctgcttggggaaaatggaggcttgttccagaatgcagaaatccctgttaaattaggcagtcttgggctggaggacgtgtgcctgcctccccagtgcctcacaactcacatctctaaaggccactcaggtgggacaccatcaagacattgaaaatcgacagaaggaaggcaggaaggggagaggatcgaacctgtcaaaatagatattcagaaaatctgtgctctaaaataaggcagcccttccctcacagcacacttattcctaatttcaacaggactcctagtcttgccccacagcgtcacagcctacagcaaattagaaactggggtggggggcggatattattccaccagtaatacccttgggacggggcacacaagatgtttgccctcctacctctctgtcaccttcccaagaaagggtcaagatgaaacagtgtgcgtttatggtattgcgagagttaagtgagctgcggtgtattagaaccttagcctcgcgcagcgtcagccgtgtggtaagtgttccataaatcttcgtttagaaaaagtggcaaattccaggctgctagtaaacaaaggagggaagacagacaaaacggaacagcaacaacagaaaacccaagaactagatgcccaacaatctgggtctgtatcttgaaggaatgtgcatcctgtcctctgactgcaaacccaggccttctgtggccccacgatgctgcctcctagccctcctaaggtgggaatggagctttaccccttggtggcaaacagacctggctccatggatctcaacctggggtgattgtgtccccaccccaggggacatctggcatcctctggggacattttgagttctcacaacttagagggtgctactggcgtcctgtgggtggagactggaagtgctgctcggcattctttgccgtacagggcagcccccacaacaaagaacgatctggtccaaaatggcaaccatgccaagattgagaaatcctggttactcgacacagcaggtcggctggcctaggagttgctgcccagagaggcaaagggagaatgtccagtggaaacagctgccctgagcatacagggcacgctgacacctgctgattcccccatccttaaggtcctgtattgttcctaacaccacgtggatcttcttgccagatgcattaaagtgtgagaagagttaaaaatcacttataactggagtgactgggggttaaagaggagaaaaaatttgaacctgactcaaaggatgagcatgtttttctttctttcttcggcacattggctgggtgtggcggctccatggctataatcccagcactttggaaggccgaggtgggaggattgcttgaggttaggagttcaagatcagcctaggcaacatagcaagtccctatctatataattttttttttaaattagccaagcttggtggtgcatgcctgtagtcccagctactcaggaggctgaggcaggaggatcacttgagctcaggagttcaaggctgcaatgaattacgattgtgccactgcactccagcatgtgcaacagagcaagaccttgcctcaaaacatattaagcacctactgcatgtcagggccttggtctaagccctggtatgcaacagtcaactagacagagagagtcttggcttttacagaacctccccttataaggaagacagattgtcaaggaagtaaacagacttttagaggagtgctgtgagacagtgccatgtgggaaggggtattggtgaaagaatcctgctttataagggcggttatggaagacctctctgaggaggtgcaatttgagatgagattggcttgaggaggactgagccttcagaagttagggaaagcgtgtcccaggctgcagccagggaggtgaagacttgagggtgtcagggtgaggagtgagggtgtcagggtgactgagggtgccagggtgaggagtgagggtgtcagggtgaggagtgagggtgtccagggtgaggagtgagggtgtcagggtgaggagtgagggtgtccaggttgagtgagggtgtccaggatgaggagtgagggtgtccagggtgaggagtgagggagtccagggtgaggagtgagggagtccagggtgaggattgagggtgtcagggtgagtgagagtgtccagggtgaggagtgagggtatccagggtgagtgagggtgtccagggtgaggagtgagggtatccagggtgagtgagggtgtccagggtgagtgagggtgtcagggtgagtgaacgtgtccagggtgagtgagggtgtccagggtgcagagtgaggtgtccagggtgaggagtgacggtgtctggggtgagtgagggtgtccagggtgaggagtgagggtgtcagggtgagtgagggtgtccagggtgagtgcacatgtgtggtgaggaggtgtttgcagtgcttcaggcgcagcaactctttcatctagtttaaaattgtgctctgaggttagattttagtagaacaaaggccttacaaagaatgtgaaaacattgtgcttccctgcttacaggcaattaaaaaggagaatcaagctgagggtgcctggtgtggggtggggtggagaagaccacagagactattgtgtgttttattcaacagtgtcctgggctgctttctccagaaatgtccctgacacatggatgtaagtgtggctagtttactgggagatgatcccagtgatgcaggacaggcgagccctaagattgaagcatagcccgggagggttcttagctttgcccaggaaggaactcaagggcaagccagtggtgttagcaacttttattgaagcggccggctgtgcacagcagcagcagaggcgctgctccttgcaaagcagggctgccctacaggctgtgcgcccacagtagcagctcagaggcagttctgcagtggtatttgtatccacttttaattatatgcaaatgaaggggcagtttatgcagacatttccagggtgagggtggtaacttctgggtgctgccagagccatggtgaactgacttgacacaggtcggtgtgtcctatggaaactagcatctgccctggacctattttagctagtgctcagtttggtctgagtgcctgagccccacttccagagttgagtcccacctcctacctcattcccccttcagagattagatactcctccttaatcttaagggggctgcagaagggcggagatctgttttccgtaactacttcctgctgagtttatggacgtaggccctgcctggcactggaggagtaaaaatctctggatacctgatctaaggagcccagaggcaggacgatttcattctccgtgtcagtggacaggatgggctggaagccttgtgccagcattgtctctggaactgtggtaatctagaatacacaaactttactaagaggttaaagaagcaaggaccaaacatttgtaacaagacagttgtcaaaggtcctagaagaggtgaaaaacaggtgagacttgggaaggcacttttgatggttgaccagatatagttgggggcagtgccctggttatatctatgtaactaggtagcttgctcatagatcttttgaatgttaacctcaacctgtccagagttaatatatgtgcagcaggttttattaataactgcacaagaccccaccttgttcagctagtaaataatccaatgctagtctgttatcaacaactacattttccagagtctggggaactcttgaattctctttaatgcctgatctccgttggtggctaaggattctaggatttgagccaagttctttagcgttaactcatggtaggcaaagccaccccagggtgctgctagtcctattgccaccctgattcctgccagaattagttttattgcttacttatttctgatattcttgggtcctaggcgttatagattgtgacccctggaggggtaagagtggccaacgttcattcatgtcagttccaagttttttagatacaagggaaagctattccttaaagaagaggtgactccttagggagttggagtggttacagggtgtgacttcttcccattcatagtcacaaacaaaaatgaacccaactagggcaccaagagaagccctgcggggtgcgatgtttatacttcattgccaggttgggtctatagagatattttccacctgttctcatggtggtggttgaacaatctttgttttctagaagaaggtagtactgtcaccttcccagatcaggcagttgtttttcctttgtatgttcccatccgggagaaggtaccatatatggtcttttcactcacaaatggaatctcatttacctccccgtggtcttggaaacttggcaactagagttggaccagagcatcgcagggaagcttccacttttgtgtcattaatgcaagagtggatgcaaatgttagagttatgagtgcactggagatatagatgcccaacttcccagattccgataatagtggtcagggcagggggacagcagggtccaggggggatccactaagtggggaagagttccacttcacaataggggtttgggtattttggggtgctatggttagttaggaggtctggggacatggtcctgagattttccagataggtcggaagatgaaactgtctatcctgggggtgttgatgacaaatctggcagccataaagatgattctatgatgctataatttttgaaatatttactgtagaattttgtccaccctccctgtccacatacacactagcttaggttaattagaagagcaaacagaattaacagtggcatcatggtatctggttgggtcttagagtagcttctatacccaacaagcccacaggagatgtttcccaggaggaggtggctggttaaagccatagaaaggaagtactacagtcaggaagaagagcaagatcaatgctcctattcccatctacagcattacattacctcttctggctgagtgttgattattttaaataggtagcagaggtcttccaaagctttactgatattggttgtggttgtagtgcccttcctttgtgcctgtgactcataagaaacaggtttagtcctggatctgtgtgcccaagtaggtgttccctgaagtttaacagcagtgggggtacttaacaatacctgataaggccccttccatttcattgtaattgattcttggggtatccctgtctttaccctgtctttaaggttttagcaagactaagtctcctggttgaaccggggagctattttttcctttgtggggaaggacagtattttatttttatattggagggccttttgaacctgtcctaaattctaaaggggaggggggaaggttcatataggtaattactacaagccaagaccacagcagctcaacacataaaatccatagacaaatcagttttacaaccccatttcctggcttctagttcttggcttccatactgctcaaaaggagttcaagggccaatgagtgcccgcccacctccacactcatgcactgtgcagatgacttacacagaccatctacaacatagctgaatttcctgacatgttctatactacctctttcttaaagttattttactctaggatagggaatttactatacaggattcctccacatataaaattactctttctttatatccttccttgcaaaacaaacaaaaaatacattttctattcataatattctttacatctctcttttctactcactggttcactcatgttttgaacctcccatttagtaacttccggattagacaaaaaattttttctcaataaagaatacatttctttagcacattttatggaaacctaggaaggaagaagtcatgaacttcacactagacattgtcattctatagctgagaaccattctaccattttatgattttaaaccacacattaagcatatcccatttacgtgtatttaattatttcacttttaactttatctagatcaccgagaaccaaggtaccatgcaaagctggtcaccatttaaagccattttaaccattttaaagcctatgaacatcagtgacttacctaggtaaaaatcctaaagttaaattttagaagatacaagattctcttcaaactaataagctttcagtagtcttatttgttgaatgtatgagtgttcttttatctataagccagtttgacagcacgctagatgtaacacacatcacaatacatgtacatatacccaaaaacatattaaataaaatgacctatacaagacaactggattcaagttatttacagaactgggacccatctacctggccaaattttgtttgccccgataggtatggaaaacaggaaaaggcaggacagggaatcccatagcatcaactaaaaaggggaggaagcaaactgcattgctcaaaaggagattctggagtccccacgccactggagagcacactcagtggtggaaataccaaagaaaaatgttcaggcggctgcttatctgccactgtggaaagctgtcctctgggacagtaaacttacttgagctaagcagctcactggggctagtaggagaaggttagctctagtattgatggaagctttttgttgttattgttctctctcaccagagcagttaggacatttgcattgccaggggcccttttgcgtatagtaggcgcagtgattctggcccaggggtcagcaagtcaggcatcaagtcttgtctaggcatcccagatgctaattttgtaacattttctcaagatgagtaatcctgaggggcaaggaggcttaaagtcactgttaacaattgtactttttggctatttctttttactcccctcttttgccctgtccctgttgttgtaaactttaaaggctatgtttaagcgtcgtttcataggacttgaaggtcccattgctgctttttgtagattcctcctaatgtcaggagaagattgaatgagaaaatgtatacccaggagagcttgcccttctggggtgtctgggcctgcattagtatatttcctgagtgcttcaactaaaagaccctgaaacagagcgggattttcatcttttccccgagttacttctttaaccttgtcataattgactggcttaaccacacactttttcctctacttttttttccccacagcacagcaagcggatgacaatatttgtaaatcgtggcaatttgaagaacatagtcaacgtaacaaactcttgtataagcttttctggtttatctgaaaactggccaattctttccttttataaggtctaattagacatggaaagtggcatatgtactctttgagtgttccctcatttccatcaactactttccacagtggacacaggcttgaccttaggggctgatatggagccccactcctggtgtactggttgggctcattttcttgggcagcagagggtataggctagggctagttggataagggggaaaggtgcctgatgatattggggtggaatctcattagggaattggcgagaacccccactcaggactgggggactgaagagactctggggaggcttatgaactttctatggggagcagctaggtggggatcccttatgcatggcattctaatgcctggaagtaacgtgatccagtatagagccataaaagcctgtacataagggatctcttcccattttccttctcttttacaaaataagcctaatcgtaaaatatcactatagtatatagaaccatgtttaggccagatatattcgtcatctaacttgtatttaacccaaatggtgttgcaatacaaaatgagtttctttttctttaagccaaatttgaatttgctccaatagcttaaaagacaccctagcggcgagtcccttgggatactccttgttgtccccatgcctatattaaggatctctctacagagggttttattagcccaagtttagcaaaagcctagttactcttccctcttaaattcccgtgttctttaaaggtgtaaatatagatagcaaggtgttataaaaatggattatgagctacgaatgggcagtcgaatgtggagcctaaattccatagagatctagagttgggtggagagggggctaaacaaatggaggaagggaaaggggtaaacagcgttgcccaaggggagacctcagaggctctgacttgctgaagaacctacccagtagtggagatactgaaaaaaatattgggctggccacttgtctaccactgtaggtggctgactgccaggccaggagcctgggagctcccaattcctttgaccaagagcagcttaggcaagggagttataagacagtacacaggaaggagcttgcaattggctattaggaaaataatactcctaacttcagggtggaaaaagacaagaccaatattcgcctagcgaaaggggtataacccacaatcctagaggaaatgtcagtgctaaaaaccccagagcatctggagggtggcctataataccgatgctgagaacccaaaatgcctgcgtttcagccaacaaggatgccctcgccaaagcagctgtgcacagcagtgccaaaaaccctggggtacccagtgggcggccaaccccgtgaacccaagaccaggttacagaacatagaacaacgtgacaacgtgactctggtatcccagagtcaacacaacaggggacctctcacaaccaagtgtcctgccttaaacaattgcccaaatacaattaacagaaagtcgaaagcaaacataagactccaaacaagacatacatgttaggactgaaaatgaaaccaaagtggagcaataaaatggagtcagaggagaaagaaccaggtgaaggggtggcaagaatgtgcttcaaggcacctaaaccgtggggaactgaccgcttagccaaaggcttttatttcctagcttacctgatattactgggggagggtgcaaaggggactctcacccatccacagaagacaaaatggcaccagccagtcttccacgtgggacccgggtgcaggtctctctaggttccccagcttgggggtgctcagcttctgtgtcgggggctggctcgttagagcagtgggtcccacacgaggcagctgtactatggacacttggctgtccactcagtttcaccacctgccagggaaagatgatggctgtgaaaagaggcactggttagggttagagctcggtagtgttagcagctctttattggtacttcctcagtgttacagatcttacatcctcaatcacagactgcttcaccgtctcttgctgtcttgccaactgctgtctcttgtctctcaccaattgctgcctctctgtctctgctgtcttgcctctctgccaattgccaccatctccgctgtccttgtccctttgctggttgccagatgatgcaggacaggcaagccccaagactggggcttagcctgggagagttcttggatttgcccaaagattcaagggtgagctggtggtgttaggcagcagctttcatggaagcagctgtgcacagcagcgccagagatgccgctccttgcagatcagggctgctccataggctgtgtgccctgagtagcagctcagaggcagttctgcagtcatatttatacctacctttaactatatgcaaattaatgggcggtgtatgcagatacttctaggatgagggtggtaaccttagggccattgggtcattgccatggaaaggggtggtaacttctgggtgttgccatggaaacggtaaaccgacatggcatgctggtgggtgtgtcctatggaaaactgcatctgccctgacctgttttagctagtgctcagtttggtcctatgtccaagccttgcctctggaatcaagtcccgcctcctgcctcaccaggagtcgcaggtaagagtgtgtgtcatggaggaggttataaatgtgggccactgagacccactccccactggggaactctgagaggtgacatcagatagattcagctgtgctgactagggggcaaggcagctgggccttatcactccctcctgccaaccgtgggtggagggcagctcacagggggttcactcttcagcgtttctggctcaatagctggccaaagaagccatctgcagagagtcacaggtgcttgcattagaggctgtagagtcaagtgcccaggaagggtgtggctggcagtttgctgtggctactgtgtgcctagaacaaccactgtgtgctagaaccatggctggcacaagttaggatgatatttgaggaatgaaagatcgaatatgttctaccactgcacgtatttgagagcattattttggcccaggaatcacaaaacagagttttaaaactgttctttaaaatcctaacctgctagcaggctctagactctaactcatgaaagcctctgtgagtttggagtgtgcctgtcattgctgtgtagttccttgaacttttattggaaggtgaagatgtgatgtgtagatactgagcaagagaaaatggttggggggcaaagggtgatcgtgtttgaggttataaacaaccacaaaaccgcctttgagagttgagtgctctgaacgttaagagcttgcaaaccctttagaatggctgggctttgtatggttgactggcagcacaacaaagttgcaagcaagtgttaaattcctgacccactaccacttccatgtaatccatcaggaagtttaccaaagtatagctcccacagcttttgtatatataagaatttactacgtagtagttcctttatattctgtataacgtcagttcttaagtacacacacattttaaaagtacgtaatattgttatcatccttccattagtcaatatacgtacattttggtttaaccctgtagtccaggggcaacttctatgatccctccttcttgctttttgcacccaaataggagagaaggcagtgtcattcagaatggtcgggctgcaggcacctgtgggccgtgtttatagagagtggaatcactctgtgcccagcagaacccacgtcttcccctccatgtcagagctggtgcttcacttggggcctgctcatctctgtatccatggacatatgcctcattgcctgggtttatgaatcatgaggctaagtagagaattgaaaacaactcccaatatttgtgttcaggcctagggagaggcagggtgttccatggttggcaggcctatgcaaaccaccccagagtccaaggaagctgagaggccgaagaagaggctgccaaatccagtttctcagaaagaaatatttaatagggacttatgaatggaagtcatgcctgtgtctagagtggtggcaagacgagatggtggattcctacccatcacccccccagacccagggcttacataccatagggaaggaatgtctagggcagtcgaaaaggcaagaatcctatgtgaatctgcctaagggcaggattgcctgagctaagggcaggatttaccaataagtactttctcttacataaggaacaatagataagagaaaccttagaagccttccaggaactggggtcaatcagaagtcaacatggtggtgggaatccaaggatggagttgctttagcctctccacagggtcctgctcaacttcaaccttaagcctcatgttccaagccagtgtcaacaggattcttcctggggccactgggttttagcacagccaatggcacattggttaccgtggttccttagccctgtaattgcatcagaggcctgcccagaagactgattggaggccagcagtctcgctcctgtggccaggcagcatcttcttgtgtccctcgagagttttgaaggtattttcacattatcttcccgatgctgttgataagtctgatgcaattgtaattcctgattcactgtatatgaactgttttctttccctccagaaacatgtgaagtattcttgacctggtatttggaaatttcttgttgatgtgtcttagtctggatctttaaaaaaaaaaaaaatgctgggcacttggtgaatcttttcagtctagaaactcataacgttcatgtctgagaaattgtctagtaattgcctgttctctcttcttggacctcccattattcagaagttgcaccttctagtctggtctctctgcttcccttgtctgtctttttggttcttctctccattttcatttctgccacccacattttagttttcaggatcactttctttttctctgaatgcttctgtttttgtttgtttttcaccttattcctgtttcaaagttgcacatcttcttatatttctctgagaaaattatgattttgcttaacacttgatttctgcttcctgctttttatctgtctcctccaagttccttgtttcagtgtgtttgtcatggtctttgtgtctcatgctagaggctttcctcactatctcatgattattggctgtctgttcatatttaaaagagaagcattcaaatttgattggaagttaaggactgtatggagacaaggtatagaaaatattttcattgttttattagtcagggttctgtaggggaacagaataggagatagatatagataatagagatagagacatagacatatagataaaggggagtttattaagtattaacttacacaatcacaagatcccacagtaggctgtctgcaagtttgaggggcaaggagagccagtctgagtctcaaaactgaagaatttggagtccagtgttcaagggcaggaagcgtccagtacgggagaaagatgtaggctgggaagctaggccagtctctccttttcacatttttcttctgctttatattcactggcagctgattagatggtgccctccagattaagggtgggtctgccttccccagcccactgcctcaaacgttaatctcttttgacaacaccctcacagacacacccaggatcaatactttgtatccttcaatccaatcaagttgacactcagtatgaaccatcacaagtccacccctcgtcaacttgaacccatacacatctgagatcatacataatcttcaaataaagacaataataaggtcataattatgcctaacatattacaactattctttgtacaacctgaaacacaccagtctccaacccaaatactattacataaagttaacaatacttaaatgctgatttgaagtcagtaaatcttatgtcacatgctaaaggaaaaaggaaataaaatcaagatattttcttagtacaagtataaacatgcacaaacatgtttttaacaaaacaaggaaaaaatactcatgacaattacagtcctcgtttctgcagctggtcacgtggttgtagccggtattgatgactgccttcttctactacccattctgtattccctttgccttcagcaaacaccttggcaggttgtgatttttttttcctggtggagtgacccaaaccttcattcctgaagggtctgggccatttctagtcctgcctggattgggctgttgtagtttcccattgatcttaatcacagggcatggtaatactaagagatgccctaatggatctcctgtattccatgagtactcttccttacctccattgtggagtagtagactgatttcatcttgatagtctgggtcaatcaccccggccaactgtaactcccatcttagcctgttgacttaaaggtaggaggagcccaaagtgtccaggtggcaatctgaacttacagtttaatgggattgttgttgtgtctcctggtggcagtgttcctccctctggaactaagacctctagaccaacagaacttaatgtcatgggaacaggcagcaaaaattttgctacttaatcactaggggtgatggtgagtgatgccacttccacttccaacccttgattcctggacccgtgaatcctggctatgggagaaacagtaccatatatgggacgctgattcagagcatacacggccttctggagaactttgtcccaggcatgcaaagtattgtcacctagttggcattgtaattgtgactttaaaaggccattccaacattctgtcaatccagctgcttcaggatgatggggagaacatggtgagaccagtgcattccatgagaatgagcccactgtcacacttctttagccataaagtgagtgtcttggtcagaggcaatgctgtgtggaataccatgacggtggataatgtattccgtgaacccacggatggtagtcttggcagaagcattgtgtgcaggataggcaaacccatatccagagtaagtgtctattccagtgggaacaaacctctgccctttccatgatggaagagttccaatataatcaacctgctaccaggtagctggctgatcacccctagaaatggtgccatattgaggactcggtgttggtctctgttgctggcaaactgggcactcagcagtggccatagccaggtcagccttggtgagtggaagtccatgttgctgagcccatgtgtaacctccatccctgctaccatggccactttgttcatggacccactgggtgatgacgggggtggctggggaaagaggctgagtggtgtccacagaaagggtcatcctattcacttgattattaaaattctcctctggtgaggtcccccgttggtgagcactcacatgggatacaaatatcttcacaatttttgaccactcagagaggtccatccacatccctcttccccaaatttctttgtcaccaattttccaatcatgcttcttccaattccctgatgatccagccaaaccattggctacggcccatgaatcagtgtataatcacacagctggccatttctccttccatgcaaagtgcacaaccaggtgcactgctcgaagttctgcccactgggaagatttcccttcactgctgtccttcatggatgccctagaaaggggctgtagtgctgcagctgtccactttcgggtggtgcctgcatatcatgcagaaccatctgtgaaccaagtcctagtcttctcttcctctgtcagctgatcatagggaactccccacgaagccatcagtgcaggctaagggagagaaggcagggtggcaggagtggagaccagggcatttgaaccacttcctcatgtaacttacttgtgccttcaggatctgctcgagcccaatcacgtatataccacttccatttgatgatggaatgctgctgtgcatgacccactttatggctagatgggtcagaaagtacccagttcatgatagttcaggtcgcatggtgacttgaaacattcagtttccaccaaagcccagtaacaggccaagagctctctctcagaaggagagtagttatctgaagaagatggcagggccttgctccaatattctagaggcctccactgtgattcacctatggaggcctgccaacagctccaatcagcatccctatctgccactgacacctcaagcaccattggatctgctgggtcgtatggcccaagtggccaagcagcttgcacagcagcctggacctgttgcagagccttctcctgttctggactccactcaaaattggcagcctttcggctcactcgataaatgggctggagtaacacacccaaatgaggaatgtgttccctccgaaatccagataggcattgtgctctttcttggttgtaggagggactaaatgcagcaacttatccttcaccttagaaggaatatcttgacaagccccacaccactggacccctagaaattttactgaggtagaaggtccctgaattttagtcatatttatttcccatctcctggcacataaatgtctcaccaataagtccagtgtgtttgctacttcttgctcactggatccaatcagcataatgtcatcaaactaatggaccagtgtgatatctcgtggaaacgaaaagcgatcaaggtctctccaaataagattatgacataaagccggagagtttactgtcctacccctgaggtaggacagtaaaggtgtattgccggccttgccagcggaaggcaaattgcttctggtgggccttatggacaggaatggggaaaaagtcatttgccaagtcaatggctgcataccaggtaccaggaggtgtgttaatttgctcaagcaatgaaaccacatctggtacagcagctgcaattggagtcaccacttggttaagcttacagtaacccactgtcattctccaagatccgtctgtcttctgcacaggccagatgggagagttgaatggggatgtggtgggaatcaccacccctgcatccttcaagtccttgatggtggcactaatctccacaatcccttcagggatgtgatactgtttttgatttactatttttctaggtagaggcagctctaatggcttccatttggcctttctcaccataatagtccacaccctaccagtcagggagccagtgtgggggttctgcctgctactaagcatatctatgccaattatgcattctggcactgggaaaatgaccacaggatgagtccgaggacccactggacccactgtaagttggacctgagctaaaactcctttaagtacctgacttccgtaagcctctactttactggaggaccacagtgacattttgggtcctctggaattaacgtcagctcagagccagtgtccagtagtccctgaaatgtctgatcatctccctttccccagtgcacagttaccctgataaaaggccagaggtctctttggggaaggatgggagaaagattcactgcatacattgtcggtaatgtagtggggtccttcctcaaggggacccgacctccccttcattcaaggggttctgggtctgtaaactagctcaagtctggaaattgattgaagagccatgattctctgtttttataattcaaattagtgttttggccatttgacctagaagttttctgcttgtataaattaagtaggaatgcagtgggcttcctatcaatttcacttctaggaacaccatgattaattaaccaatgccggagctctacacgagccagactgttctgattgctgctttgcctctgctgtccattagggtagctgtgcccacctgaccttatcatatctagtttttgaaacatggcagggaaaatgattccacgtaacctgaccatatcagctgggtgactgaataaaacaccttctcagctcgctttcctctggcctgaagctttttgctgtagctgcttttgcaacaaaggacacagttgtaggcagtggatcctaaatggaggtttcctgggggactttagggaaagcttatattttcctgataaaactgtcaagtgtggccaagataatacttccccgttttctgactttaatgaaaatacaaggccctcaacagagatagctgacttctgactttgggagagaggtcagggaacagcagtgatgctgtcgctgatgtttttgagctattggtctgatatcactagaggcttcctttacatatttgagccatcctaaatctataattttctgtttacttgtagccaaaaatattctaaatgtttcaccctcatactttttgagaaaaaaaaatagcttaataataataaagtaccttaaggcaatttgccattcttttcctttcttcaaaatcagcaaagcatggcaggacacatctgaaagtctgtttactgttgtttttgttgatgttattggcaggcagggcacttatttccagcagggaagaagcggacccagttaaagggatctagactctggtcgtcaggaacgggtcaaggccttcaccatgagaagagcaccaaagggagttaatatggggttgaccagaggtaggcaaaggaaggcctgtgggccaaatctggccagctacctgtttttataaataaagttttattggaacacaaccatgctggggtttgtttcatatttcctgaggctgttttcacactgcaatggcagaggtgagtggttgacacagatgccgtctcaccaaagcctatgatatttactgtctggccctatacagaaaaagcttgctgacctctgggttagactgtcaggtggtagagactaaggagggagtgataagtccctgttggccacctgaggttttgtctgtgtcaggaagctgcagatgggagatgtccaggcagtggctcagaagaacccatggaggacccattaggggaagggttggtatgtggacaccagccacgcccagggtgaaccagctgtgcagtcaaatacagaacttcccgtcccttacacctccattctctgtgtttcaattttagtgaagtcagccacacccagagtgaaccaaccgtgcagtcaaatacaaaacttcctgcccctcacacctccattctccctgtttcaatcctggtgaggtcagaggcacagtcatgagcaaggtggggaaacagcagtaaatccaaccacaacacctctcctccccgactatagaccgccaagcctaaagcaggcccgtcacgttggatgccagatagaaactttgatatgagataggactggactcaaaatgcctaaaatcaaatgtatgaccacaaagcttttcgaaaaatgtagactttgtccaagatagcattcaagggttgagaagtataacttacatggcttgttagaaagcagttgtatggcaagagagggttctattaaaatgttattccatcatataatttctatggagaggaatttggaaatggctagcaaaattacatacatttatcctttgactcagaaatccacttctgggctgggcacagtggctcatgcctgtaatcccagtactttgggtggctgaggcaggcagatcacttgaggtcaggagtttgagaccagcctggccaacatggtgaaaccccgtctttactaaaaaaaataaaaataaaaataaaaattagccaggcatggtggtccatgcctgtagtcccagctgcttgggaggctgaggcatgagaattgcttgaacctgggaggcagaggtttcagtgagccgagattgcaccaatgcactccagcctgggtgacagaatgagactctatctcaaaacaaaaaacaaaaccaaaaaaaaaaaaagagagagagagagaaatccaattctggaagtctatacaaacattacactggggaaaaatatgaaaagcaattcacaaggctattcaccgtggcacgactgtcatagcaaatgattagaaataacccacgtgtgcctcaaaaggggactggttgattaaactatggtaaatctacaccatcgaacatgatataaatgattgagaatatctttagatactgcaagtgagaatagcaaggtagagaaaagaggatagatgtgtaccactgttcacctaagaaggtagcatatggcacatggaggtgtctttcccaagaaacttcccaggacaaaggtctccaaagttagaggatgcaggaagaaattagaatgtctgaatttgttttgcctaaagcaataaagaatttggctttggtaagttgtgataaacacaggtaacctcgtttggttcacctgccgggtgtcctggtcttcgttgacggtgacacactgcagaggtctggggtctagggatcgctgattctgcagctcagtgagcacaactggtgcttcctcgaatgttcttttgcttgcaccctgctggtggcttcggtttccaggattttgtatggcatcagtctggtttgtcttttattttattttatcttattttttgagacagggtctcactctgtcactcaggctgagtgccatggcacagttactgctcaccgcaggttcagcctctcagacccaaggcatcctcccacctcagcctcccgagtagctgggaccacaggtgcatgccaccacacccaactcgtttttagttttttgtagggatggggtctcactatgttgcccaggctggtctcaaacttcagagcttaaggatcctcccaccttcgcctcccgaagtgctgtgattacagggatgagtcactgcacccagccagccaggttttttttgtttttttttttttttaaagaaatacagtctctaaagatgagttacatgattttatttctcagaaagtcacagttccagatttgctgacatttatggtgttagcaagtgactggcagtggtatggtacttagtagatattgaaaaaaataaacacaaaacaggtccctttaagatgatattttaatgctaagtgagaagcgtaacatctcctgctgtggagaggtcttctgaggatgatagctgtacatgtttacatcattagttgatttctactaccaaaatggagtaagttggctacctataaaacacttttgaacccttaacttggagacagaatttcctacctatgtaaaaatcttccaaataattttgcttgtgttaaaaaaaaaaaatggaaataagccgtaccttccggttagtttgctagttactgattgacattaggaaatatgcaagttgactattcctaatctccattttacaaatgaggaaactgaagcacagatcagctatatggctgaggtaacatcattcatgagggcagagccaggatttgaaagcaggttggctggtcccccactgtgtgccctgaaccagtgtactaagctgcctcttgtgtgttttataaatttcaaaatgtatgtgatgtacaaagggaggatatgcataaggggtagatatatacacacatagaagttaaatactcaaaaatatttatttttatttttatttttgagacagagtcttactctgtggcccaggctggagtgcagtggtgcaatctcggctcactgcagcctctgcctcctgggttcaagcaattctcgtgcctcagccccccaagtagctggaaatacaggcacgccccaccacacccagctgatgtttgtatttttagtagaggagggttttgtcatgttggccaggctggtcttgagctcttggcctcaagtgatctgcccacctcggcctctcaaagtgctgggattacaggtgtaaaccactgtgcccagcccccaaaatatatattttttgatgggctagtttatccccaaattttcaaagtcacttgtcactgagaattctgaagccttgcggggaatgatgggcctcgtctgattcaagagaaattgcctgtttctgagttgagtcgtagtgtatctgggtactcaggctagatcctagaatatcacagatgctcaggagcgatgcattcacctgtctgttcctgccagggctttccagctgccttctttaataagctcctctaccaaagcagttccagatagaattgaacaatctttttaaagcataaatatcagcttccaacaggggtctccatgcagtctctactctacgggtggcgtatttgactcctctttccagctggctggtgtgaacacacccactcgagtttcagcaccactgcccttttttttgttttgttttgttttttgtttttaattttagtatgagtactgctagcaaaaacagactgcttctggagcttcaaccgaataaccatcacccttctaggcaacttgggtgatgtgttggtggatctctgtacgctttttatttatttatttatttatttatttatttatttattatactttaagttctagggtacatgtgtacaatgtgcaggtttgttacatatgtatacatgtgacatgctggtgtgctgcacccattaactcgtcatttacattaggtatatctcctaaagctatccctcccccctccccccaccccacgacaggcccccatgtgtgatgttccccttcctgtgtccaagtgttctcattgctcacttcccacctatgagtgagaacgtgcggtgtttggttttctgtccttgcgacagtttgctcagaatgatggttcaccgccttcttttttaacaggaaccctctcagaggtcaaggtgctgcccagcgtctgctcctctttcccctttcctccttgtggtgccggggaggagctggctgccggagtcccttcctcatcttcctccacctgcgccttcctaccctccctccctgcctccttctggagggagccccagggaggaggggaaggctggcgaggaggaagaactgagctctgctggcagctgctcgggggtctgcaagatgctgaggatgctgcagggggtggcagtggggctctgcccagcacctggacggaagtgtcttgtctgggtgccccggggaaagtagtaccacccagtgtccaaggagtggttggttgcccaaggagtagggcattttcctgagacagcttccttctgtcctgtgctagggaggcgagcttcctagagtggttcaggcttccttttcttaattcagctcagaagggcaagagaaaagccagtgcatggatcccactcacgcttcctacttgttctagccgggcttcgattccctccgcacttctagcttctgaaagcagagcctctcccagccccagctctcactggcaggcaaggtggtgtgtgccctgcccctcaggccaggggcggggatggctgccgttgttgtaggtcccttgtgccccgctcacacctccaaaaatagcccttccatcataacctcttcttcccacctatgagtgagaacatgcggtgtttggttttttgtccttgcgacagtttgctgagaatgatggtttccagttttatccatgtccctacaaaggacatgaacaatgagaacacatgggcacaggaaggggaacatcacacaccagggcctgttgtggggtggggggaggggggaggaatagcattaggagatataactaatgtcaaatgatgagttgatgggtgcagcacaccaacatggcacatgtatacatatgtaacaaacctgcacattgtgcacatgtaccctaaaacttcaagtataattaaaaaaaaaaacaaaaaaaaaacccaaaacctcttcttgggagctctggagtagaattctctttctggctggactctgataaatacagctggtgaccattatttcagaatgaaatttcgtttagtttatgagtctgtccaaatatttcgatcatttaaattcagatgttagtttacctcggtttgtggagaatggactgggctgtagaaacttagaagccaagcgaatgtggactccgctgtcttcattgctgtcttgttactatggatgtcggattaggtgcacccgtgaggtcttggattgtaaccccatgttctgcaggtctcaggacctcttccctgcactgtgctagcccggccccctgtgatggactgaattgtgtccctcaaatttatacgttgaagtccaaacctccagtacttcaaaatatgactatctttggagatggggccttaaaagaggtcatgaagttaaaatgtggccatgagggtgggccctgatccagtctgacaagtgtccttatataggacatgcagagagacaccagggatgtgcgcagagggaccgccatgtgaagaagcagcaagaggagcaagaggacggccatctgcaagccaagggggaagccacctgcccacaccttgatctgagacttccggcctccacaaccgtgagaagatacgtgtccgttgtttaagctgcccagtctgcggtgctttgttctggcagcctgcactgactcacaaacccacttctgacctaggccctgactgggttcaagcatacacagcctggccagctcagccactgtccgcattcacagcctcctgcagcttccactgctcaggcatcctgatcctagccttcttagttggccattgctcaccagaccattttatatgggcaggaatgaggagacaaggaggccctcagggacacagttgcccctctgctgtcttaccctacctgtcttatcctctggaccatgcaaaatgtttatcttacgcagtcttttgttctttggtaaatgcatataacagacacatacttagtatccatgatgtcccagcagccccgcagctctgatcgtagtagaggtggtttaaagagaaatgcattaagtagagttgagtttgtttttcacaaatcaagacacatcccacttggggcaaagtcgtgacattcaggtgaacctgaaagttatagcttcttttatagccagttatccaagggctgaagccatcgagctgcctgccttctgagcacttgaaacaaaaaggattggaatgtttggtacaaaacccagcacttaaaacctatgaggctttcagctgtgactcttactgtctcgcctccatctgggaagttcattgatcttcaaaacctggcaggctcctcaggggagagaaggtttaagatggagcagccagctcaaatccctattaggtccaagagccaagaggcgcaacgcacagctagttgggaacatatgaacaccctcccaaaaagctgcaagactgttgtgcgtgtaaatctaagtgaggaaattatgtggtgaaatgggttttttcaaagtttgcacttaggcccttttccgaagaaaatctgtgttgacagtggagggagataatgtttgagttaattgatgagggttttaagcagtaatcaatatttcccaaactagcaaacccagcatgttttagggtcattttcaatgattaaaattaaaatttggttgtttcaaaactttggttgaatgctaaccactggaggcctggtgttggatgaacagagcatactgggatgctaaaaaatattaagtgcaaatcccatctttgtctgaaattggtttttgtataattcctgttttaggaaattgtgaaatcatgtaagacagttttcactataaattattttcaaaagtctttgtgctaaatgatcaggcatgaccgtagtgagctgtttgttatttgttatggttaatgcttagttgccatgtgcggaaactgacggttagatgtttgattaggggattgttgaaggtggtgtgagggctggatattgaccccagatgagtttttgagatgctaccatgatgaggaaggagcaggaaatcatatcacacgaccaatgcttggaggatttcgagggggtatgcagcccacccacctccaccccagagggatgccatgggtcctaggcaggaaacattctacactcaacaagctgccagccaggtggaagagggcattattgcagaggacaggcttgagtctgctggaaagcagtaggggatgggaagtattcagccaactggacgtttcctggggacaggcaccaagtccctttcactagctgtttatttctggataggccatcgctcctggcactggtcagaccctcaacaaatgctatggaattaaactggaaaagggagaacgtggtgaaaaatatgccctaacattgtaacaagtcataaggtaatgcacttcccatcactgaaaaacccagcagaaacactgtcacctctgcatgctgatagacagcagtgcggtcactgagagacgggaccaatcggtgctccccagacctggctgatcagcagttacatggggacctggttaaacatatggattccaggcaccattctctgggctggagatgtatatattttttaagtgtctgaggtgattccagtgatcaggcaggacaaaatgatgaccccccaagattttcatgtttcttcataaaatctagtgcagtgactgagtctggttattgttttggtggagaagttactgtaatccacatgtgactgcaaacgtttggcaaatcgatatttcatggacacgtgatacttgtctggtcctgtcctaggcactgagcatccagtaggtgcaacagtcaccaaaaatcctgccttcttggagcttactctttcatgaaagggacaggcaggacaacatgttgtaggcatggtgatagagactatgaaaggatggtgacagatgctatgaagaacattaccacacgggcaaaggaatatcagcggtagggaagtgtcacaagttcataattatcatggccagggaaggcatcttcaatgagggagctctggagcagagacctgaaaaaggaggggtgggagagcaaggtgcttggggaagggtgtccaggcagaaggaagagccagtacgacggccttgaggaggagctgtgcttgtgtgctggaggaacccaaggcggcctgtggtggagcctggtaggtgagctgtggggaggaaggcttgaggaaggtgggggagtgctattgttgagagttgcctggctgcgagggtgaatgaggagtgtggttttggaaacgccaaatggagatgccattcctaatacccatggggagagcacctgcagcagctgatcatgcctctgggcccagagacacctgaattttgagagtgtgctacacagaggtagcattcatgtgctcccatggactgagcctggggagaggaggtgaggtcccagcacaggcgctgggacaccccaaaacttagaggtggggaaggtgaggaagggtcagtaaagggccccaaggaggaggagcctggtgaggcaagatacctgaagacggggatgggtcagggaggaaaggagttttgaaagacgtcaaacccctcagcaggtcagccgtggctggagaggacattgctacagagagaagagctgtttttggggggtggtggccccaagcgagaaagggaggagaggacctggagcctgtgagctcactcagctatttcaaggggatttactgtggaggagaacagagagatagggctgtggttggaggacaatgtggggtgaagcccaggctggagtgcagtggtgcagtcttggctcactgtagcctccgcctcccgggttcaagcaattctcctgcttcagcctcccgagtagctggaattacaggcacccaccatcatgcccggctaatttttgtttttgtttttgttttgttttttgtttttttagtagagacagggtttcaacatgttggccaggctagccttgaactcctgacctcaggtgatctggccacctcggccccccaaaatgcagggattacaggcatgagccactgcgcccggccaagagttagcattttctttctcaagatgggagatatgatgtcccatgtataataagcgggagtgatcctgggagagggggaaaaactgatgatgcagaagaaagggaattaggggcatgctgtcctgagtgggcactgagtggggtggtccagtgcccacggagaggggctggagctaggaccatgggtggtacctgtctccactgctgctccagcaaacatatttaacactcacgttcaagggctgtcacacgtatgttgaagactttgccaaggttaatatgttgcaatttttttctccaagtcttcttcatttttcctgtctctagaatgttctgaaagatttctttatgacttttctataccataattaaagcaaacgtctgtattttgctggccatagaagccaaagagggatgcatctgtcatttctcttctgggttagcattctttcaaaatatctggacaccataaaaatgtagaggtcagtcaatagagatttaatgctttcttgtgagaaattcccttggaagggctttaagaaagtctttttagaagagaataatatctttgatcactatatgcctattaaaatactttttttttcttgtgggtttaccatggaaaaaaacatcaaagccttatatgagccacatagaaatagcctgtttcttaaatggctggcctgaaattagcaaagggtagcaaattgaacacaatggtttttctgtgttgcgcattcagtttgggctgatcagatcccatgcaaaaagattactgtaaaacgaagatgaaattttagattttaagaagatttcattgtaaagctaggtcacagcattccacattcaggtgagtactaggatttgtagattatcagtcattatcattaacatactcacatacaattgtcattgttgctaagaagtgtttgcaccttttcaacacttagaaattaagtcacattttctgctttcaaagcccttaaccttaatcaatattttataatgtgttttcatagatgagatacatttgagttaccccagttataagatggttactccttgcaattattctagatatgaagattcatttggctaaaatgtggtaaaattgcaaggccattcagcaggtcagttttaaatacaatatgattattattccgtcatctttgtgcgtgattgaaaataacagattgtgtggttggcaattcgcttccccattagaaaatttaccttcctacttctgttgtgtcttacatagtataattattctgttgccttgaaaaatattataataaacagaagggctaatttttttaagcgtgttgggtggccgaggagaaatgaaattttgagtggaaaacctcacatgaattgtctgtagttgcttgtacttcatccctcaccagtgcaaaagccaattccacaggaattgaaaactgttatgaaagagaagcctggtcttccgtcttaacatcgggtcatgaattcaatggggaacactgtatcttcttcatctctatgactcaggcacatagtagctgctcacttaatatttattagaaataaatatttactgaaaaaatgaatctcccccaaagaactgaaagcagggtcttgaagagatagtcacacacctgtgttcacagcagcatcattcacaatagcaaaaggtggaaacaacacaagtgtctgtggacagttgaatggataaacaaaattctggtctatacttatgttttagtttgggctgccctaacaaagtaccctagactgagtggcttataaataatgtcaatgtatttctcttagttctggagactggaaacccaaggtccaggtgccagcatggtcagggtccaacgagggccaccttctgggctgcagactgcctgctcttcattgcatcttcagatggcagaaagagggtgagagctcctccgtcctttttataagggcactaatcccatccatgaggctccatcctcatgacctaatcacctcccaaaggccctgcctcctaatagcaccaccttggggattaggattgcaacaaaaggcaggggatacaaacaatcaggtcataacagcatataatggaatattattcagccttaaaaaggaagacagttctggcacatgctataacatggatgaaccttgaagaccttatgctatgtgatagaagactgttacaaaaggacaagcactggatgattccatttatgtgaggttcctggagaaggcaaattcatagagacagaaacattaagggtggtgtccgcaggaatggagagtgaggagttgtttaatgggtaacgggtttcagttttgtaaaatgaagtgagttcctcaggtgggtgatgatgatggttacacaacaatgtgaatgtacttaacgccattgaacttcacctttagaaagaactaagatggtaaattttaagttatgtgtatttaccacattttagaaaaaatgaatgttaatatctagaataattgcaaggagtaatcatcttataaattgcagtaacttaaaagtcttgcctgatgctgcagcaggcgtatatgccttatctctttctttttttatgtttatttaaaattgtgacaaaatttgaatgttggtaactagggtaaagttaacgatgttctttttctgtaagttcaggtttggagtgggtcttcaattgctgtcatcaactcttgagcaaaagagaacatttagtgaaactccagaaacatcttgagaactaagacattacacctttgataagaatttattcacacttctttagaaaatgtgcaggaagaactaatttgtaggtaaaatgacatgtcctaaaattttgggaaatgcataatgggttcttaggggttctttcggagtggctttagttgtcgcttgggaaaggaagaagctaattagccctgttaatagaaatgttattctacttatccccctccccaactatcatcaaagtatgaaggtcagagctcttttgtcctttttaatagtttgttttcttaaaagtggttgagtgtgaattttctcttgcatgggaaaaggatcattgttttcactggcatcagtgaatgcgctcacacatgactgtttaaatatgtcttcattcgttagtcagtaggatcgcatcctgctggaagacagattgtgtaacctcagaggcttccagggaaactccagtcccagggagagagtgggacagtggcatgctctatagagaaagcaccccttgttctctctctctgcctccccaaccccgccccactgatctccctcctggtgcaggagggactgttggagcagaagaaaacatccagctcacctgtcactgaatagcccctgttgcaaaggaacacaggctctctggcctccagcccacatctgcggaagcttggttggagtgaggctgcttacggctgctcccctttcagtccatgtttggtttctgcatccaagaggcagagtgagaatcagaccctggtcgggggtgatccctgaaggcaacgcagtcatatgcagtctcttggcaagcagccagtgctctcagctgggacaccctgtcttcaggcatgctgctctgtggccccgcttacaatggtgacgttgcctgattctggccctggttctgcctatcactggccagacagccctaaaccaagctcataccgctagggccttaggaagggagaggaatgcaggcaaaagtcgtctcccatacacagccacctaaggaggaacagagccttaggatgttaagtggaacaaaccaagtcacgacccacatgtaagaatgtgaccaagagcgagaaaacccacagacacacctttctaagggtggtggcctacaggattagcttctctttctcttccaagtgactgctctccccacaccttggcctccaccagaggggaatgtgggcagtgcacgcaggaccgcacggtgtcttctgcaggggtgaaaacagtatttaaagcccctgtgactgcaggtgcctgcaccttctgggggtgggagagggcatgaaatcctatcagcaggaaagtccatccttgctgctctgctccactcgcccaagccgggctgggaagagaggagagaggacttcagaggtacccaggctattcccagggggaggcctgtgtggtccccgtttgttcggagatgataaggagtccattcgagggaggagctgccttctgaacatgggagtggctgacactacctctgagggtttcagtgcctctcccgtgtccagaattcttctgattctgatgcagggggcaggatggcaggggtacagggtaagggtatgagggctcaggggctgctgaggatgggggtgtttgttttgttttagttcctgccaccccaccctgccctctgctccccatctctgcctgggtcacccatcactgaaagatgtcagttgcacaccaaggtggctaccagagggagaaaaacagcccctaggggtagggaaggtgggagttccgtggaggcagcacctggatcaggagagctgggcagccaggggcagaacaaccacctgccagggcgggattaaaaagcaggcatcctcaccatagcctaggatacctttggattggagcattcccagctggaacgttgccctcttgcagccacgtacaggtggtgctgacactcaggccgctcccaaacgttctgtcgtgcggttatgtccaccctgggttgcagcccatgtgcaccctgggaggactgctgaacacaccgccaggccatggagattgtgcacaccactgccggtctgtgtccagactagcagcaataaggattctgattctgattaaagcccctgtgactgcaggtgcctgcgccttctgggggtgggagagggcgtgaaatcctatcagcaggaaagtccatccttgctgctcccctccactcgcccgagccgggctgggaagagagggaacagaggtgcccaggctgttcccagggggaggcctgtgtggtccccgtttgttcggagatgataaggagtccatctgagggaggagctgccttctggacatgggagtgtggctgacactacctctgcgggtttcagtgcagagataaggaatgccagtctggtggataatttgatgcgtgcctttttctgcagagtgatgtatttgagaaacagccctgtaacgagaaaaagccgcactacccctctttaagttcaaacaccactgtgccaggtgcttttatagaggcaggacaaggcacgatgctcagagcaacactctttattagcccagggtacagacaaggaggctgaggctcagagagggtggcaaccctcagattctgcagctaacaagaggttgagctggggttagaatctcggtccagcacaccctgaagtcactatcctttcctgtatggagaagacacaggtgtatcctgggaccatggctaggaaatgaatgtgaaactcgcatcctgtgaatgttatgaaaggacatagttcccaatatgtttaagggcgttggctatgggtttgggatgaaacctctccccgttgtagaaatgtgtcctttctactcttcataagggatgtgtgttatttggaaagtttcaaaactcagtcagggaggtccccctcccccctaaccaacctatcaccccaggaacgaggtttcagctgcagaggtagtgacagctcccaggtccagaagaattaggatttggggacttggatttgagtgatctcttaggttcttaaaacgggcctcctacaccctaaatactgctccctcaacttcaacctccacagttggtatcaacctgctgtcaactaaaagtaagctcctaagccccccaccaactgaacagacccttctttttgccaaggagaccccccaaaaaaaccttaaaaacttagttctcagccatgatgggacaggagatcagacacaccttgttacactttctcccttttatggtttaggcacaacggctgaccagtactaatgttaaaatagagaatagaacagactgtttgtggcaacaagataccaacttataagcagcaacctcaggtcacgccaggcaagggttgagccgcgtactctacacttagagaacggattctgttctcatggcacagcgtcttctttttctccagcagctaaaacactcaccggcccggagatcagccagattcaaatgactgcagctcatccgcccacagacgcggactgaccccgttccacagccatgactgcagctcggattgggcaggagactgacttcaggaacctcctccagataagagacccctgacagtggactggctctggttgctttacagaggctgctcacttgagtgccttcaagtcctgaaaagacctttttgacatttagggcctaactgtgatacacttaaatgttaagactccagcccagagtgaacacaggaggcatgtcgcatggatgttcaatatgcgtgcatcaggaccaccttcatgaatattcatagttcctcctgtaaactgctgaatatgtatgtttagccaacccattcagcgtaaagctccttccccaacccctcctccttcaaagtgcctgtctctgttcttgcacaaaggcacacttcccagactgcaggatggccgccttgcacctttataagaaggtattcttttcaccttcccaagtgtataaatattgtgttgattttttttttaagtgaacactgctaaatgctaagcatttggtggaaaaccaccacattccagaatcaggcagccaagcccatccccattcccccctccccatccctctccccccttcactgccaccgtccacttggcagctgtggttttcccatgaggagcccaggtatccatgtgtctctcaacatgtgtctttctagtaggagcctgtacagcaatagtgaaatggctcacactctcacacatgcacacacagccagaataaattgtataatcaagctcctcttagctaagttctgtaacatctgtttgtgttaagtggtgctctttgaaaatgattcccccctccctttataaaaacaaccttaattttagattgtggagaaatggcgcatgacaattatttttgctttcttcaacaagatgtgtttaagtaaatgagattcatttctagaactgaagcgctgaaagagcctgattaacagaatcagtgcctacaatcatatgtaataactgtgggcaaacagccccgcgtggctgggctgcagaggccactgctgctgtgggttcggcttgccggcagacttcagcagatgggctgctaatataattaggaatcgttgtgttaaatgagccattatttaaattatctgctaattttcctatctattaacctgctgaaatagagagagtaatatctgagaaatctcaggctgctaatcactaactagatgaatcgcccagtttttccctttaatgcaacattttaccttattgcagcaattagcaaatggctttctgtagggttattgcccagtgcatcaaccagagattaagaagggacagtgggagacgtccacagtctgtttaggtttcatccaggtggcagattggtggctagaccatggcttctagccgaggaggctcttagctttctcgaccactgttttcttgtttatttcatagtctctgcattaaaggatatttggccttcagaaagcttctcttagtccatttgggctgctataacaaaataccttagactgggtggcttattgatggcagacatgtatttcttacagttttgggagctggaagtccaagacccaggcactggcagattgaggtctagtgagggctttgtgcttcatagagtcagtgccttctctctgtctccttacatggcaaaagggatgagcgagcgctctcacgtacttttgtaagggcactaatcctatctcttagggccccacactcatgatctaattgcctcccaaaggccttgcctcctaatatcagtacgttgggaataagggttcatcatacaaagttaggggtcagggcacagacattcagagcacagcagagcataaggtgaggactgtgtgagtataacttctctcactctccctaccctgagacactggtagggggcaggaaagtgaggtaggcgggaggaggaggtcaatacagggtgcactcagagtgggctattgcagtgcacatctggggctcaaccccaccaaggacttctgggggatgacacagagaccactccaaactgtttgcctggggagtaagggagcaacggtttggacccaccagctgtttatttttggtcgagggctgctcccaggagcattcactccctggtacgtcagacctgacttggacactagataatctcactcctgaggttacagaagctgaagtgagtgcccaaggaatatgggtaggccaccagcaatctctgctgtcttctcgcttctagctttgcttatacttggacatttaagagacaagtttgtggttatttatatagcagctgggaagttgactaagtttagcctacccttgccatgtctagaaaatctaaattaattctttgcacacatgatttaggagtttggcctgttgaactttctccggctacttccaacttcttggcaggtttgttgacctaattggcattctctctgctcccaggtgggggctcatggacatgcttccccatctgaaggaacaagtgattagtgaattcctattagttgcaggcactgtggggaccatcaaaaagagactaagaaggagagctttgtccttaaggaatttacaagctcattgagaggaaagaaaggaaaccgggaaacattagaggacaataaaagacacgagacaaccctagacaccaaaaatcagggcatgagctgtcagagaggagtaaatcagagctgcagctgggaggccttctggggaacgcaggacttagcatgggtctcaaaggcaacagcctttgtacggtttatcgtttactctcagccagcaggcagaaggggtgagaggtggtttctacttgcatcaaaacaaaataaggaatatcaaaccccacaaatcatgctgttgaaaaaaatgagtaagctggctgggcacggtggctcacgcctgtaatcgcagcactttgggaggccaaggcgggcggatcaccaggtcaggagtttgagaccagcctgaacaacatggtgaaaccccgtctctactaaaatacaaaaaaattagccaggcttggtggtgggtgcctgtagtcccagctactcagaaagctgaggcaggagagtcgcttgaacccgggaggtagaggttgcagtgagccaagatcgcgccactgcatgccagcctgggtgacagagcgatactccgtctcaaaaaaaaaaagagtaagctttgtctgggcagggcccggcatggggagaaagttttgactgtttccaagaacagttctaaaggattcttcctgaaaaatcctttagaatcaaattgctccagaatcagccattttccttgtccagaggttttagtgccatgggatgctgtggactgtgtgtccctggtcaccaggaggcaaactcagtttactcagttttcacaccttgctggctaaaattgcacgtggaaccggcgctagtgtttatttgctcactcaccgtgagccagcaccatgaggagcacgtgtcacagcatttacttctcacaagcaccccatgagaatggtcatcaccccctttcctagaagagggagggtgcagagagatctggggagaggaacccacctcttccaggtgccaggcactggcacatgaatggtggagggagattggaccccaagccctgcgtgcattcagtcattctgctcagtgaagtgtggacagaatttgtttgatgggagggtagaattgttctcaaagggcttgtgacacaggaggaagacgtccacgttcaggacatgtctagttcctacccatccgtgatgtgtgcataatggtcatccctcttttataattattttgtaaaatctgatgatgcggttttgggcagggctgctggaactggggcatattgtcaaggaagtctatgccaaagacgaacagttttcatcgtgggggcatagaattttcacacatcttctggaatagatcatctaaactcttttactctcaggttttctgtataattggtaggtgctcaagagatttgctttagaaatgaacaagccaccttccttttgcctggaatgtgcatttctgccacttgcccttcactgcatgaacgtctctctaaccttgactttcatttattcattcaacaactgtttagtgagcacctactaggctcccaggcactgtctgaggtactggtgacaaagagatgagccacatgtggccctactgtcagctgtcatggagggcgcactgtgctggggacattatctggagaagacaggctcctgtgtgacggtgatgcacccaggacaggggcacagaagccttgggaacaccatgtaaagttagaggaagaggtatggggggagggcagagatcagaaggaaggactgtggggggcaaaccaggagggcgcatttccaaagcttcactgaggcctggtcacttgcggccagcactgcctgcaggctggacaggtcaggggagagctcagagatgaccgtgggcctggagcacgggaggtcactggtgagcttggccggccatggagagctgaggcagaagctccatctctgcaggtggaggagagaaagagagaaaggaattgagacgggaggtggcccactgctggatgcttgaccgcaaagggggaaggaacagtagctggagggagtgtgttttgggttttgccatttttaggaaggcgagaagaaattagccactgagttcctgcagttccacctccttaggtctctggcagcttggatcacagatggttttcaagggcaggtcctggtggacaggccattctccctactagatgctgcactctgcaggggccaggacacaggcaccatcatctttgctgctctcaccccatgccccaggttcagcacagcaaagacccacatctgccctgcaaaggccctcgaggccgctgatgttggcggcagggttggagtagttaaaagccagtgattttcaaggtagaagactccatccagcttctgctggaaaaccggtttttgttagttgtgattgtgttctggaaaaatggaatgtgacttctatgggaggctccctagtatcaggaaggaagcagggaacaggggcggggacgtcgggacctccatgggctgtttcacatctccaaggcgtttctgttttcctcagatgtaaagtggggatctgtctatcgtatgagcttttgagtcattttaagttatgctttgcttggaagttaagaacattccctgaatttgagaatatatattttcaatgaccttttatgtagctggagggacatggcccagggctaggctggtgtgtgtgtgtgtgaatacatgcatacatgcacgtgaggttgaacccaaagaggcaggaaataattttggaaattcctagaataaaggaaggggcagattaaattgctagcatgtggcatgaggtgaggaacctggaaggagcccacagccggggtgtttgagttttccgttgtttgagagcgcgtcgtgtgaaatttatagagcaggtggcattactatttttatctctgtggttgaggctacttgtgaaagtgggtgatggtcctggctagaattcaacacgagaaaggtccatttccagtgtcaccacacagaaaatggtggtggctcctgcgggccgctcagacacatgatgtgatgtacagcccagagcgtttactgtgccctggagactcagcccttgcctgactctgtggctgccttatttatttggggccatttctctcagatcatatgctccaggaacgaccatcgtggtgactggctttgccaagctgtgactctgagttgaaccttcttgaaaactagcttttgctggaactgccacggaagataaggttgtgctgaatgcctgggcaatgagaagaaatcacctgtgtaaaagaatgcagtccacactttggtctgactttctctgcatttgtgttccctgcctctgcggaggagtgacaccccctgagaggcaggaccgggtctgggcgtgtgagaacgagctccggtcatgaggcaatgcagaggctgcggtggagcttcagagggagggaagcagggtgaagcgtctctggagagagtccccctgtcactggggctgctgtgtggagggcaagtcttgttcctgccttggccctgtctagttacgcagtcgcagtcagcgcggacgtgcgttgccagcctgaccggccgggtgtgggatctcctgagctactgagtgcagagttgccagcgagacccagaaatggttgtgaaacagcttccacgatggacagtgggcacagggaggaaggctggtcttgttcagaaatctgtagctgttctttttttgtttttttttctctgagatggagtctcgctctgtcacccaggctggagcgcagtggtgcgatcttggcttactgcaacttctgcctcttgggttcaagcaattctcctgcctcagtctcctgagtagctgggattacaggtgtgtgccaccacgccaggctaatttttgtatttttagtagagacggggtttcaccatgttggtcaggctggtcttgaactctgacctcgtgatctgcccgcctcggcctcccaaagtgccgggattacaggcgtgagccactgcgcccggcccaatctagagctgttcttatctgtgactttcaatggccaagaaaacgtatttcctactgttgtgcaattagttatttttttagggcgattgatgtttcttgcctaacatccacactgtcctcttctcaagccctagtattctctgatttgccttgtaaaggaatttttgtgtgtttgttttctgtctctcctttacctctttacccccctcctttccctctttaccccgttttagccaagcaacttccaaattcatcttgcctccagaaagcatttaaatccccaacacagagacagtggtgaacactcagggccctgtgccttccctgtggcagctcatggcagctttggcgaggtatctgctggttgagcctcggtgctttccagcctgggtgctggacacgttgtactttggagccccctcccagtgatggtttaggtcccggcccttgctcttttcacatcagccatagaagtggcttttgctcttgtgataatcctaagctggatgcaaagaaggtgtcacagagccagctcggcaggcagcaaggaggcctggaggccggcaagccttgaagatggacggagcaagtaaaggcggcggccagcagcaagtgagtgggaggcctggggacacgcctccatgacacagcctgagggctgccagcccctaccagaaactgggagagacaagaagggccctcccctggagcttctgtgggaagcgcagccccgcccacacctagattttggacttctgacctccagaactgccagaaaataaatgtatattatctcatgccaaccagtttgtggctgtttgttaaggcagccataagaaattaatgtaaaaagtgagtcccgttttccaggaaacttgaatcagaccaaccaatgttaagatatgtcagtaaaactacagaacgatggttctaatataaacaatacaactatagaactttgtggctatggaaagaattcttcagtaaccaaggagaaaaagtcacgtgtaatgaggaaaaataagacatgctttagatttctccacaaatactcactgttgaaatacactggagaaacatatatataaagtgttaagaaaaaaaatatgacccaaatgcacaaaacccaggcagatcattcttcaagtgtaaaggccatggataggtgctcgcaagcatgaaagcccttggggaagatggtgtccaactttgggtggggcccgtgggaggctgaacaaaacctagccattggggagctgggtgaagtcagagacaggaggactggtaggaaggagagaacctctttccttatagaatgactaagcaactgtgggaaatatgggtatcaaaaacaaatcttgaaaatatataaacaacagtgtaacctatggagaggttggtgggactcagattcctggtgacataggtacattcaccacctcatcttccttaatggaaggaaattctgacagatgataaataaaaaatattggcaggtaggtaaaaaagaaagatgttcatgcattatgtaaaattacaaaaaggcatatcatgaaagtaaaaataatgttataatccagcacttcttcccatcactccctatcctggagcaccccctgtcccttccaaacatcttgacttttttttttttgtgacagagtctcgctctgtcaccaggctggagtgcagtggtgtgatctcagctcactgcaacctccgcctcccgggttcaagcgattttcctgcctcagcctcccgagtagctgggactacaggtgtgcgccaccacacccggctaatttttgtatttttagtagagacggggtttcactgtgttagccaggatggtctggatctcctaacctcatgatctgcctgcctcggcctcccaaagtgctgggattacaggcgtgagccaccgcgcccagccaattcttgatttttttagaagtgtgcagagtggggatcccaaaaatatcattctaagttgctaaatcaagagaagaggttaagatatatcacataaaattgtaaagaaaatgactagaataatttaaaaatagatgtaaagcttgcagttcaccagaacaattattaaacaccagaaatctgtatagtaaagatgaaaagaataaaagaagaaacattatagcagacagtgtcacataggaagagataggatgaggaaaaatgtgtataattggatgcaaattgataaattcatctcttaaaataattcagtttgggggaatgtttaaaaatggtgcagggattctgatatgcctgccccctttgagaatcaggttgtggtgagttactgataacttagtgtttattatttaagagcagaaaaagagagaaccctgtccttcaggaatatctggttcaaccagactgacctagggacggatctccttcacttactttgacctgttactgactatttgatacatgcaagaattactcagcctccaacaatttctctcctgtgaaatccatgtaaatgcagatttgcttggtgtcctctaagtggaaaaaccacacactgatttccctctgctctcacaccacaacgatcaacacagaagacttccgggaccaaatgtgcggggatttctcctcaccaacaaacaatcgatcggttctgcgacagacaccagctgcgtatcctctaatttagttcagttcctacactgtctgcctggggatggcgtgggaccccagagtgagggcccagtcccccaagactgcccccagcttccatgccagttgcgagctccgggtcattgcctgtgcttctgatcgatcggctacaaatggaagatttccaggatcctatccttggtttgattaatttgctagatttactcacagaactcaggaagacatgtacactggtttattataaagggcgttacagaagatacagatgaagagatgtgtaggttgaggtatagggggacaggtacagaacttccgtgccccccctgtacacgccaccctccgggaacctcagctgtctggaaatttaatgaaccctgttcttttggggttttgtggaagcttcgttatgtagacatgattgattaagccattggccattggtgatcagcttaaccttcagctcctccccactccccaaggttgggggtggggctgaaagtcccagtcctctaatcccgccttgctctttctggtgaccagcccccatcccgaagctacctaggggctgccagccatcagtcaactcacagcatacaaaaacacatcactttggagattccagagattttaggagttgtatgccaggaaatggggatgaaatcacatacgtatttcacaatctttcatgcccttttgtacgtttatgagaaattaggattaaatctaacccaaactgtggctttgaaacttggggctgttgagcatctaatatttggatgaagaaccagataataaattattatatataatacattatatatatgtaaatatatttttatatatgtgagattacattctatctgaaatcaacccaaacacctctgtaaaggagcaagctcttacacattttctaggagctgtgtatttgtaaatcgaaattaagaatagagcattcatttactaaaacgaagaggtttaaagtaacatttatagtctcattatttagagtgcctttgctggccaggtgtggtgactcatgcctgtaatcccagcactttgggaggctgaggcgggtggatcacttgaagtcaggagttcaagaccagcctgggcaacacagtgagaccccatctcaaaaaaaaagtatattaaaaaaaaaaaaaaaaaacagtagagtgcctttgccattgttttagattcacttcaaaccttcatcccccaaatctgtttccctaccattcctacaaagtttttgtgaacatgatcttcattggtcgggagggaattctctgaagtcacaaagtagcttttcgtttgagaaaacacaggggtgtgaccacaggttacagcactgcccctggcagatgcccaggactgtcgttcattcctctccactatttccatggcctcctgcaggggaaggggcaatggcacttagtacattagggaagtaggagtctgacagtttctgccaacagctcgaaaactgtgtgtgcagaacctacacacagctggtttgtgtgcacagactgcattattcttgcttattattttggaatctgttatctttgtaccaagggcaaaacgagtgtctttgattttacctttgcaaataattttgttgtcgattccacaaatgtgtgagtgtcggccgggcgcggtggctcacgcctgtaatcccagcactttgggaggccgcagagggtggatcacgaggtcaggagatcgagaccatcctggctaacacggtgaaaccccgtctctactaaaaaaatacaaaaaaattagctgggcgtggtggcgggagcctgtagtcccagctactcgggaggctgaggcaggagaatggcgtgagcccaggaggaggagcttgcagtgagctgagatagagccactgcactccagcctgggtgactgagcgagactctgtctcaaaaaaaaaaaaaaaaaaaaaaaagtgtcagtgtctactgtgtgcctggccctgttacaggcatgcacggcagacagagcagcaaacagcaaaaatccctgtcagagggaggcttcacgctggtggggcggaggcagcaggagctgtcgggaccccgtgaatggcatgattgcgcacggggcccaggcagtggctgagttggttacaagaatgcgctcggagtctgactctgggttccagcctcagctctgccacttacccttgtagagttgagcaagtcagactctctgcacctcagtgtttgcatctgtgacgtggagtgaggactgtgctgccctcagagctctgttatgaggttgaaataagctaatggatataggaagcacgtacagcagtgcccagcccactgcaggcggtgttcagtgtctgctgtcactgttatgtgaaaggtgtggtgttatgggagggaaagggatgcacaggccggcaggagactgggaacagcagttctcccaaagggccagccagggtcagcttcgtggagaaggtggcgttgaaggaagcctggaagggagcgatgggccgtgccacatggacctggacctgggtatcctggggaagagcccccaccccagcaaggtggccaggggaaaggccctgccactgggggatgtctggggctttcacggagtggcctggtggtcagcgtggctgggaggagtgatgtcagggcatggcgagtgactcagcaggccatgtgaggacttcgccagttactctgggtgacgtgagagccatgggaggtggagggctgactccctctgacttaactgtaataggactgtggtggctgctggttggaagtaggcctaggaaggaagcagggacaccagtgaggacgaggaggggatgacagtggtgtggacccccacagactccttggaggaggtgaggggtgggccggtgtgggccagaacctgaaggtggagccctcgggacctcctggtggctggatgtgggccatgaggggaaggaagccctagggatcacctccggcatggcctggcctgacctgatggagctgctgtcgaccgagatggtcaagtccaccaggagagcaggggtgggggcagctggagctcaattcgggacacgccaggcgtgagatgatgtcccatctcaagatgtttcctggacctgctgtaactaagtacacaaactgagagctgaaaacaacaggaatgggccaggtgcagtggctcatgcctgtaatcccagcactttaggaggccaagacgagaggatcacttgagcccgggagttcaagaccagcctgggcaacatagtgagaccccatctctacaaaaaataaaaataaattagccaggcatggtggtgcacgcctgtggtcccagctactttggaggctgaggtgagaggatcccttgagcccaggagtttgaggctacagcaagtgatgattgtgctgctgtactccagcctgggtgacagagtgagacactgtcaaaaaaaaaaaaaaccccaggaatgtattctttcacagttctagaggcaagaagtctgaaatcaaggtgttggtggggccatgcatcctctgagactccaggtggagccgtcctttcctcttccagcccctggccatggttgtcagtcctttggcattcttgtgactccgtcactcccatccctgtctctgctgttacttggcaccccccgtgtgtctgctttccgtgcattttcgtctccctggaaggacgcctgtgatactggattagagctcacctctgtggtcctcaccttcacttgattatctctgtaaagaccttttttccaaataagggcacattcacaggtgcaggggttaggaacttcagcatctctttttggaaaacacatctcaacccataaaagatgactattagccagccagggaaaggtgttgaataggtagagcccagagtgcatgcgcagcccggggccgagaggtacacttggggttcgtcaacatgcggatggcatttaaagccttgagactcagtggggaccccaagggtgtgagtggatggatcccagaagtgattcctgagctgagccccgggaaagttcagcagggtggggagatgagaagcacctgtccgtgagactaaagtgaggagtcagagaaggaggaaatcaggaaagtgtggggccccgggatccagagtgaagaatatttccaggaagagggagcgagactgagtcagatcctgctgatgggtcagctcagagacaaacactggtcccagctaaactgaggtccttggcaaaattattttataattgttggtaagataatcctaggcaaaaacttgcctattttgatttttttttttttttttttttttgagatggagtatcgttctgtcacccaggctggaatgcagtggtgcgatctcggctcactgcaacctctgcctcctgggttcaagcaattctcctgcctcagcctcccaagtagctgggactgcaggcgtgtgccaccacgtccggctaattttttgtatttttagtagagatggggtttcaccgtgttagccaggatccactcacctcggcctcccaaagtgctgggattacaggcgtgagccactgtgcccatccgattttgatttctttagtctatagctttttaaacctgtttttcaaccttttgggctatatctacgtggtctgtgtttatttctaaaagaagtgttcattctgtaaacaactgggcatgtgtctggacttgggatagatgctgggcataaaatgataagtaacatacacacctgccctgagacatcgttcactggggaagatgagtgaaacagtgggatacagggcaacagcccaatagcattggtccctaggggactgcagattaaaaccacagtgaaataccgttccacacccgttagcatggttcacattgaaaagaccaacaccaccaaatttgggggaggatacagagcacataaaccaaatggcccatggacccattgctcatgggaatataacttggtggacccacatagcagacgtgttcagcaattttctttaaaacagtaaaaatgtatctagtcggctgggtgcggtggctcacgcctgtaatcccagcaccttgggaggccgaggcgggcagatcacgacttcaggagatcaagaccatcctggctaacacggtgaaaccccgtctctactaaaattacaaaaaactatccgggctcggtggcgggcacctgtagtcctagctactgaggaggctgaggcaggagaatgacgtgaacctgggaggcagagtttgcactgagccgagatcgtgccactgcactccagcctgaacgatagagcgagactccatctcaaaaaaaaaaaaaaaatatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccaggtgagcatttaagatcttgcgtttttattatatgcaaattatatctcaaataacctaaaaaacaatgcttgtgacaggtgtgcccaggtgccatgcatggaggtgaggggccaccacatgccaggaggaggctgggaggcatcctggggaggggaggtcacgttggatcggggtttccaggcgagatttggaaaagcaaggggagggtgagcccagtggagggctaaacctggccgaaagcccagagataagaaagagctcagccttggtttcaagcaccaacggcctaaaaaggaaacccagttatttaacagaatccattctcttttaaggctcagtgtgtatctgagacaggaccatttcccctctccagtgcaagcttcttcatggactttgttcagatttcaattttataatagctttttctattctcctcgtcagtatactttttttttgttccaactgataaattattcttgctacttagttttaaaaacattattcaagagtattgccttattaaaataacttgatgctttctattttttttttctccttaaaacataaaagctacagattctcgttgacactggaagcagtaactttgccgtggcaggaaccccgcactcctacatagacacgtactttgacacagagaggtaagcgctggccccttggctggtgtgctgggccggggcactgcatgatcaacatgcttcaaaatgcaccagagcatgacagccagaaagctgtttcattttaagggggataccaatatgtatgtgtatgtatacacacatgtggacatgtgtatgcatatgtacatgttcattccatccacaaatccacagcaggagtctcctcatggccttcacgcatttacatgagattcattttctaaaaatccaagtcaaacacaactcctttagttatcccaagtcgcagggagcttgtggccctttggtgtttattgcagcagctttagttctgcagtggaggtgggctggagcaggggacgaggtcttgggagtctgtgaggccactctggccgagggtgtgggtttgcttcctcagctgaagggatacatggaaacccacctttgcatagttcagtaggggttacggtgtggttcatggaagccatttctgtgggttggtttgcaacactcatttggaagagtgagttttgtgagcacaaagtattaagggccaagactggggctgcacatgagcaattatggggtggagttgagaaaaaaaagtgtagcctgatggaggtctctggaatagaacaagccttgcccatgcaggcttccgagcagccctgggtggggttgtggggaggcccccagcggcttgtggcagccttcagctctgcaggagcccgtggggtctagagtcaccgccctctgtgaactggaagctgctctaatgctgtgcacgttttgatgtcacaactatttttacgattctgaaatttaaattcaacagacagccaggtaaatttaaattcaacggacagaacaggtaaatttaaattcaacggacagaacaggtaagctgacatgctggtttgttttttagggtcatgaaccttctagaggctcggaactgtcacattaggtttccctactgtaaattcttttcctgacttccctttctcgctttccttatcctcagtgttttgttccgggaaataaaggccagctctagttggggacaaaaggagggggaaagaataactgaagtcttctgaaaatgccaggcaatttaataaagccagatgatttgctgtgtatgaaagaaagcatagaggaaaccctgtatatctatgctacctacaccacatcctgggctccactttggtgccataaatgatggggcctcctgcacgtatggctgcaggtgcttgctggggagagggctgtggtggccagtgctctatgaggcttcagaaaaatatggctggcccctccctcaaggaacctatagcttggtttatggcttcatgtgttggtaagctttcttcattgatattcccggatacaactcctgcctatgatcactatgtgcccagctgttgctataaccacaaacgtgtgtagaagtcgtggtggtgtttctctctgtgtgtgcagcagaggtttggtttacgatggcttatgctgccccgtcccactcagatctgtgattcatccaagtcctcagtccccaaacagccctcacctccaactgttcactctggactgctcatcatggaacaggacttggagttggtccaaacccctcattttgattcctgcggcacaggagttcagagagacaggggacttgcccaagttcaagctttgaggccagcagtccccaaaccttcagccaacacctgctttttataacaagtgctttgtcattccctgaagtaaatgcaaaggtcatatgacttatctacatacacagctcaaagtgccctgacgtcatatggggggaatacaagggaagtaatgtataaccggctaatcagtacctcagtacgtgaacactctggctccgtggtgctggtagaccacgcagtaggcagatgctggaggtgagttaacatcaccatggacatgtacacccagtgtagactgatcaaggcaagctgacttacactcacacaccccaagcagctcagcttgctgtcttagactgttgtgctgctataagagaatacccaaggctggggagtttataaagaaaagaggtttatttggctcatggttctgcaggctgtacaagaagcatggtgccaggctctcaggctgcttccagtcatggtggaaggtgaagcagagccagtgtgcagagatcacatgggagagaggaagcaagggtaggggaaggacgtgccagactttttttcaacaatcgatcagccctccctggagctaacagagtgagatctcagtcattattatgggcaaggcacaaagccattcttgagagatccgacctcactacgcaaacactttccaccaggccccacttcctacactggggatcaaatttcaacatgagaattggaggggacagatatccaaactctatcagttgctgatgtgattttccagaatggacaagaatcttaggaaagttccaagaaaaacagaaagagaatcagcttccctggatttccatagtagcgaatatgcaatgtatactaaacctgtgtagaaaagatggtatgcatatgtgaatgggaggtgcattctgtgctcatatgatccagcagatttcacccatgttgatgcccagagcgactttggaaagtggtgtgggatgggaacaatacttcattttgcatgactgcccttcacattccaggataaccagcatgcttatcaaacacacccccaaagtttccaaaacttcccctaggggacaggaccttccccattgagaaccgcttatctgaatagtccctgatagtcccagccctgtgttgtttccactgctgggctctagtctgtacgacacgttttccacgtttccccctcactggggctcagcacacaggggcagaaccaacacacgtggagcttgcatttcctcgtttagcaattctttcccacttagaataggtttttctctcatcatctgtagatgcaagatacaacagaaagaagcagtaaagcacagtaaagtcaaggttagggtgatgtggatggtgactttccagatttaaagggaaccatgcaagtcaagccctgtggatggctacttttttcatggcagataaatagcagttctgtggcagccgctcatcgccagagtccatcaaggtcaaagtatgcttctcaatccacacatcctttcgctatgcagaggcaattgttgaaaccttcaagggtaaataatactctgcattatcaagactatgtgcaatatttcatcaaccgtagacaacccaccgcatctttctcagctcccttcaactgtgttcagtgtttggttgagctgtggttctctttcaggctaccgtgggacacatctctcttacttacctgctagccctgttttgcattcaagtggcagatggttcctgttttccatcctttgggcttctctagtccatatgcatttgatgaatatgaaaactgggatcatccagaactcatttgatgactaagccttccctcctgctaatctcacaagataattcaggatttcttgccaccattctgaccactcaaggttctgatctgtttcttcttttgtgggtaaataaaaagagaaagaacacaccagtgtctggggaaagcccctcaatggttggtttcaccccattgccacttccaccattcaaattcagtgtaccttccttatttgcgagtactgcagagactgacttattacatataacacatcacgcaccttttgggtgtctaccctggtaccgcctttcttttcaagagaccattcttcaacagaactgtaaggtttcttcttggctgaatcagatgtgacgcatcccacttctgcgtttgaggcgagttctattccttcagctgcatccctgctaccatgcttgctttgcagattaaattcttagattgatattaacttgtttccttttatctgctttttacatgctttattatggttgatatgctttatgattgaaagatatgaatattttctttcaatgtcaattatgtataattaatttgtctaatgctttcgtgtaactttagagctggcctaagttatactttcaaccattgtatttgatgggagccaagagactgtccttttgccttctcaatttttgacaaaggtttcttttctgagctgcagctctctgccctgtgatgtgtctgtatttgcttgtgcttctgatctctcttagttataataaggttctggttgggtttgtccgcctctgattcacgtcctcagtctttggatattcaggtctaatgcttcctgaaacatgttacagtaattggagatttggcgtggggttctttgacaagatctctttgatttatggaatgagatgtcaggctaccattagtcatttgtgagctcgtctttatcagaatccatcttttcatggtggtgaatgttccaatgagttactatagagcaaaaaaagaaaaaaagaaaagaaaagatcatgtattttttaaatgtacatcttttttagccaataaaatctcacctccagctagttggcttgaagagagatccagtatactcatcccttgaccctccacgaatctattcaggagattaagtatatttccattaaaatgtctccttacttctgtactatatccgggttgaagctcacagagcaagagaccaatttattttcctcaactaatgtttgtaagggacttctttaaggaggctaaactggatacagatcaaatggctttccattcaatgaggacagatatttttacctgattattgagatcatttctcaagcatgtccatcatttgcctagtagaaggggacttgctgttttggagcctgtgagcatttaacgttattgaggatgttgatgaaccgccaggctgggcaggctgagctgaccctgaacctcagggggtctcatgcattcaggtctggtgacttcgagaatcacagaagattaagaggggcatccggtcacctgggccaggacagtaagcccacgggtagatttcagaccctgagagccccagggaagtcctgagcagaattctttaggagactcagcattccctgggtcgaatggcttaggagaaccagagctgacccaaggattgaactctagaattctgcacatccaccttctcttttcgtgttctctgcaaccaacagcaggtttcttttgaaataataaaacgttctgtagctcttttcccctcagttcaattgatttcactttttaatcctgcattccctgagcactcttatcagaggcagaacatcttctgaatttggttcaaagtgtttttattactgtgagcaggctttttcctggccacccacatccctgattgattgctgtttctgagcacccagaatggacattgccaaggagaagcccatccaggtttcttgctccatgtatttaattattgtgcagagcaattgagagccaaagcattttagtcgcaagaggtgggacgttagaaaatgaagatgaaggcatgtttttcatttaaagtgctggaaactctacgctaataataacccctagagtcacttatgaatgattcttctctggggttttactcagaggtttagttcaaggaacccagagaatatgaatatgaactgagaattacctttttttttttttttttaacattatctaggactgtgctttctacaaggctagccacaagtcacatgtggctatttaaatttaaatgaatgttaaatagaagttcggtctttcagttgcactataatcgcatttcaagtgttcattagtcacaagcggccagcgtattgggcaggatatttctgtcgtcacaggaggttctgttggacagcgctggtgcagggcagagaggaactctgccgtttagacaccggttgcacaagagcttgaagcgtcaccacctcgccttgacctccttagctgagacaccccacacacacttgctcctttcatggggtggttggactttagaatgagacagctttagattcagtaagagtagctctataggagcattttccagaaaacaaacaaacaaacaaaaacatcctgatgatatgctttgggtgcaaatctcatgttgaaatgtgattcccagtgttggacctggggcctcagtggaggcatttgggtcatggggacagatccctcatgaatggcttgttgctctcatcaaggtgatgagtgagttcttgctccgttagttcacatgagagctggttgtttaaaggagccaggcacctcctcctctctctcttgccccagctctcaccatgtaatgtactgtgtcccccttcgccctccaccttgagtggaagcttcctgaggcctcaccagaagcagatgccagcaacatgcttcatgcacagcctacagaaccatgagccaaaatcatacctcttttccttatgaattattcacccttgggtattcctttatagcaatgcaaacatggcctaacagacttgaattttttttttttttttttgagacagagtctcgctctgttgcccaggctggagtgcagtggcacgatatcggctcactgcaagctccacctcccgggttcatgccattctcctgcctcagcctcccgagtagctgggactacaggcgcccgccaccacacttggctaattttttgtattttcagtagagacggggtttcaccgtgttagccaggatagtctcgatctcctgacctcatgatccacctgcctcgcctcccaaagtgctgggattaccagacttgaattttctaataataactcatagcctgaaaaaaggcagcaaatgattaattataataatagcagctattttgtggcatatctcctgtgttccaagcttttgttctacatgctttacaatattaactcttttaatctgcataattaacttcacgagggatggtattatattatcaccattttttagttgaggaaaccgaggcatagagaaataaataacttggccctgggtcacacagctaataagggattgaactcatatttgaacccaggcagtataactccagctgcctctgctgtctctggaaatgacaccaaaatatccagagtgctccctctgtaaggagaccagcaacctgagcaggaaactagagaagacatgctaaatagatatgcaggctggttcaggttcttactaacactacaaattctacagagttttctatagcctggacagagtgaaactaaacttttcaaaaggaagtcatagcattttagactgtttaggaaagatacaattactctaccagggctgggcaaggtggctcacgcctgtaatcccagcactttgggaggctgaagcaggtggatcacctgagttcaggagtttgagaccagcctgaccaacatagtgaaaccccatctctactaaaaatacaaaaattagctgggcatggtggcatgcgcctgtaatcccagctattagggaggctgaggcagcagaatcgcttgaacccaggaggcggaggttgcagtgagctgagatggcagcattgcactccagccttggtgacatagcgagactccatctcagcaacaacaaacgattactctaccagaccaggtagtatggtttggctgtgaccccactcaaatctcatcttgaattgtagctcccataattaccatgtattgtgggagggacccagtgggagataattgaatcaagggggcggtttttccccatacactgtcttcgtggcagtgaataagttttacgagatctgatggttttataaggggaaatccctttcactggctttcatttctctcttcccttccccatgtaagacatgcctttcaccttccaccatgattgtgaggcctccccagccacgtagaattgtgagcccattaaacttctttctctttataaattacccagtcttaggtatgcctttatcacagtgtaaaaacagactaatacaccaggagttggcaaactctagcccatgagccaaatctgacctgctgcctgttttagtaaataaagttctatcagaacacagccatgcagctatgcaagtttacttacacattgtctgtggctgcttccacattacgtttgagagctgagtagttatcacagagatcccatggcctacaaacctaaaacgtctattatttgtttctttatggaaagaaattgccaacctctgttctagatcgtattctccaagcatttcaagataattagtctttgtatatttctgaacttgaggaatgaacccaaattgtcaaaatggactgaataattcagtatttttattgctattcaacataagcgtgttcatctcctcccatgtggcaggcacatctgaatttatattggcactaacacttggcattccgccaatcttcaaataccccatttcaaagacctgactgcatgttacctgggcaatttctggtggatcccttagtgctctaaggaccctctgtggtcacttttctgtttttgtacctgcccattgtcgggagatctgcgcacagaaaacattcactgaatgcctctcttactttatgatcacggtggagtgaaccaagatagtaggcaaatattaaaagccaaccatctttatattctgtaccccattatgaagttagaatcagctgtttcccccaaatccgtttgccagaccttcgtaaaataacatatttctcctgattataaaaataatgcatgcaaacatggagggacctaaccacaagaataggagtcctcccacctccaatcctgccaccccagctggccactgttaatatttgagtgtaataaatagttttgaaggagagtctgtctcattgacgtatttttcttttaactttttctctgcatcatttaaaatttcttagaaaaagaaacatttttcccttggcacataatagcgcatcatatggatatgctgtaatttactgaactgtttccttgttactgagcatttggatggtttccagctgtttgctgttatacataaaacatcacgaccatcctggcacatgaacctctgtctgcttcctggtgtctccttagggtcagattctcagaagtgcagttactgaattaaagatagttaacatttttgatgcttatgagatataccaagaatgagttaatgaataaaaggccagatagggtggctcatgcctgtaatcccagcattttgggaggctaaggtaggaggattacttgagcccaggagtttgagactagctcgggcaatataatgagaccctgtctcggcaaaaaaagaaagaaaaatattagttgggcttgatggtgtgcacctgtagtcccagttactcagtaggcagaggtgggaggatctcctgagcccaggagttcaagctactgtgagccatgattgcgctatggcactccagcctggatgacagagcaagaccttttctttaaaagaaataataaatgaatgaatgaatgaatgaatgaatgaacaaatgatcatgtcatctccaaacttctttactgaccttaagcaagactgcactagttcatgtaatcccacaacaaagacttattaacacgtgttaatgttcacagactgattattaaaacagagtgaaatcaagcctgcaggtgagcaggatcgctttagtatgatctactgggtgatttgatatttagcttagaattgtgattattttcttaggaggagcatggtttgagttcatagacatttgcctagagatgtttcttaggttccttcctatattccagcagttttcaaactcaaatgggcataggaatgaccttatagggtgggactccccagggccatgacacctgctgtcctctctccacagtgctctacccctagagagccccaggtctcactgtcttcattcaggtctcatgcagacatggttggatccaagagttctctccaaccactgggtcacttgaggtccccttgcctgctttgttccctgggtggctctcgtcccgtaaccaccattcccgcattcattatctctcctcactgcagcataaactgagggggcaggactttcgtctgatcttgtgaatgtcgttctgcgtcagtagctcttacctccagggccacgtgagtgtcaggctctcggtcatgtcacagtgattcatgttctggcatgccattagcgtcactgcccatattttggtgagagtataatcacctttggggcattgggggagaaccttgagaaggacctgtgacatgaaggacctgggcttcagcaggtagggcttggtcattatttgtcacatgagttgtatgtgtgaacctgaactccagctgctgcgggcacaggctggtggagcctccctctgggatgccggcacctacccgtgtcacacagcagcagcacagcagccctgcaaagccggagggccaggcaggtgccagattgggttgtgtccttcaaagggtcgtgtcctacggtggccaaacaaagcacctgacttatagggtttaacttgggtatagtgaaaaattaaactccagccacatgtttacaccagtgcgtcccttccacatgacatggaaaacactgttaccaaaacattagcgattatgtttttgggggaagctgtcactttgttaacattgatgctgttcatgataaagaatggcttacaggcttacagtagactttctgtgtttaggatagctgccttggacacggcaaccttatcttcatggttcgggaacatggatacataagagaatgcaaggggcttagccgggcgcagtggctcacgcctgtaatcctagcactttgggaggccgaggcaggcagatcacaaggtcaagagatcgagaccatcctggccaacatggtgaaaccccgtctctactaaaattacaaaaattagctgggcgtggtgatgtgtgcctgtattcccagctactcaggaggctgaggcaggagaatcgcttgaacccgggaggcggaggttgcagtgagccaagatcccgccactgcactccagcctgggtgacagagcaagactccgtctcaaaaataaataaataaaaataaaataaaataaaatgaatacaatatgcttttcttttctttctccaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaaggtaaggctaatccatggatttaaggaaatcaaataacaggatgagattctgaaaatcagtcattaaagggctgacacatgagtcttgggctgttcttggagacagtgagaaccacgtggtggaaacagaccagcattcacacaattatatttccaagcattttttaaattgaaggtaaacagcatgattcttggaaccttcctgtaagacagacaatagcattaactttttgttttattttcgttttatagtttaaaatgttaacagaatttgaatcatgtagattgtggtgtgtgtttaggagtttttactaaggtgggattaaaagaaaacacatttattaaattcatacgtttgcgtgaagatggagcctgcagacggccctggaatgcaggcagggggtggtgccctccgccaggctgggacgtggcctgttttcctggctctgcaggggacacctccgaggagacacccagcatgggaatatgggcagcctgaaggcatgccctggggagagccagcccttcccagtggtggtgagccccagaggaattgtggaaccctgctcttgccatcaccagagcctccccacatggggaaagacagaattggatgttcaccaaatatttgtacttggggcctacccaaaggaaatatgtctgtatgcaggaggagggaggcaggcaggggaatttccacctggaggcattgccaaaggcaggcgggagtagacgctaggggtgtgtgcagggctcctggagtccacatgggtttgtatgtttattgcggcattattcacaatagcaaagacttggaaccaacccaaatgtccaacaatgatagactggattaagaaaatgtggcacctatacaccatggaatactatgcagccataaaaaatgatgagttcatgtcctttgtagggacatggatgaaattggaaatcatcattctcagtaaactatcacaagaacaacaaaccaaacaccgcatattctcactcataggtgggaattgaacaatgagatcacatggacacaggaaggggaatatcacactctggggactgtggtggggtggggggaggggggagggatagccttgggagatatacctaatgctagatgacgagttagtgggcgcagcgcaccagcatggcacatgtatacatatgtaactaacctgcacaatgtgcacatgtaccctaaaacttaaagtataattaaaaaaaaaaaaaaaaaaaaaaaaagaactgcagaaggagaccagctctcctggccctgtacctgggtaccacgccctggcctcaccttgctcagcgttaggcttggaaccagagctatgtgtggaagggaacagaagtgattgctggagcaataggcccccactgtcccatgaggataatcttcccatcgtggaagaacatttgttccagctcaagtttatgagcagatgggggtggggtggggagggcaagaggaagtttacagcccttggcccctccaaggagacagaatcacaattactgagagcctattaggccctaggctgagaagatacaagataagatgtgggtcactcagtgctcaggactcccctgtgaggcatactttgtaaggtcatattctccccattttctttttctttttacttttttatttttttgagagagagtctcactctatttcccaggctggagtgcagcagtgtaatctcagctcactgcaacctctagctcccgggttcaagtgattctcgcacctcagcctcccaagtagctgggaccacaggcacatgccacaacgcctggctaagttttgtagttttggtagagatgaggtttcactatgttggccaggctggtctcaaactcctgagctcaagtgatccattcacatcagcctctcaaagtgttgggattgtggcatgagccaccgtgcctggccttattctccccattttcaagatgtggggattgaggatcagtgagctgttgcccctttgaaatcaggcatggagcttctcactgtctgcagagccagggctggctcatgaaccttttgtcctctgtatcatagataattgcagacgcatgaaaacttccgttcctaaatacattttcaaaatgctttatctgtatgtgactggaaatgaaagatgtatatgactggttttatgcaaattgttccgaagatgatagagtaaacctaaattgcctggaattaataatatgtaaagattctgtgagaacagaccccttcggggtttgctcagacctcctgactctccgtgcgacattttatcttttcatttatgaaattccaagattactgacaattggcttcccatttccagggtttgaggagacagcagtaggactcataggaagcagaatgtggctgggaacagggcctgcagggtgagctgggcagactgcccacaggggtctctgagacaggtgggctgagcgctctgcagtggtcaggttgtgtggtggcccctggtccattccaggggcttcctgtcaaggctgtgtcaggaacacctactgggcttctaacactatagctgcctgggccccactgctgctgaatcaggttctctcagggttggttgtgggcacctggatgcttttaatccctagagggatcccgaggcacagccctagtgaaggacttgacagaatgattgcagctccttcgctgtgtgcgtgtgccaggtactgctccaagtgctttacaggtattggcccatttaagccccagagcggctccaggcagctgcccttatccctgtttcacagggaaggaagcaaaggaacaagtcactcggctggcaagtggcagagcctgtctcccatcgtgtttgctttgctttaccgcctctcaagaaggtgggtagaacaccagctgggggcacccccaggcccaccctataatcccaagaggtgattttgtctcactggttgacccaaacgcccacaagtgttctgacagagattgcatatggaaatcgtgctagattctgcctcggaattctgcagaagctgagatgaaacaagtaggaggtcaaacacaaatggactacaccaatgggaagatctgtatctattccatggtggagttcccctctcactccctctggaatcacagttttagttctcacggatagtaaataatcattcctgtgaatgaccatgggcacccaggggatgcctatagcgtctgtgctactatagttaattacattttcatcaaaaactaacaactcatggtcaccaactccagtgtctcccagttgtcaaagccaaaatctaaactcaggtctatcactgacttcctacatgaccaccggcacccctggcacaccggcacctcacagctgtttacggaccttcccgcttccctttgagtctctctggagaaatgagggcatcctctgtatgtcttgctggatgtgagggagacacagagcacacgagggcttctgaaatctggccttgggggaataagaagccttttatgcttctggagtatagatttgtgcctttcctgcttctttcctgccagagttcatctggcagagctaagcctcaccccaggctctggggtccgggggatactgtcctcccaggtcagccacctctcatttgcatggtggacagctgcggctgacaggcaaacaaagatgtctgcggccatggcagctcctagagaaactcttctctccttactctcaaatgcctaagattaggatccaccacctgccacggtaacctacttccacggcttctcacaccccctcacaaggcagtcatgatgatagatgtgactgcgtcgaatggcttccagaaatatgatcttatttgtacaacagagccgtgcccaaaggaagaatgccaaccagtgggaagctctgctggggctttctgaattcctagacccaatcacaagctggtgtactgttgaaccatgaaaaaattgagtataaacaccaggaatgtctgtggcgcgtggcgtctacactgggtgacccatgtctacactgtgagtcctaagcgggtgcccctctctgtcgccctcccgcagccatcaagttctctggagaccttcttcgactccctggtgacacaagcaaacatccccaacgttttctccatgcagatgtgtggagccggcttgcccgttgctggatctgggaccaacggaggtagtcttgtgggtatcttttagtcttaaaggggcgaaaaatcacagatggatgggctgtttttttctgttttattaaacacctgagcagaaatattaggcatgtaggtgtgcgtaggtactgtaaaactttcatcctccttgtagtagatctttttagaaatggctaaaattaggcaatcctttatgtcatcctgccatctggaaggatgattctcatcgcttctccgaattccattaaaacttttctttaccgcccttggaagggcactgctttctgtgggtgggggagggacaagtgaggagcggtggggggcgtggtgagtggacctgactgtgggtagggggccaaaggagagttcataaatttggcagggaaacaggggcccttgtagatcctttctctctctctctctctcaacacacacaggcacacacgcaccacagcacaagtgtttgctgctgaaacagaatcaaggccgtcagcactacggaggtgctggagcctgagcttccctccaggggccggcacccagacgtcaaaagtagtaggggacaggaagaatgcactagaagggggtgctgccagtccctttgctgtctgactatgagaggcaggatctgcaccccggtcctcagctactttcatttgctaccatttccaggcagaggacagcataggatttatgaggaaatgttttatgattttgcacaatgaagctttgatcagggaagtgcttgatcttctgttctctgacctccaaggaactaaataattgtcagtcagtgtggttaactgttttattgcatttctttgaaggaaaaatctcaatattgtaaagctaaacttgtatgtactttctttggataagagaaacctccaaagcatcttgattagatgagggcctaataccatctgacctttgcagacgtggacccataaaattccttgttttattttattttattttatttcatttattattattttttttagatggagtctcgctctgtcgcccaggctggagtgcagtgacgcgatctcagctcactgcagcctccgcctccctgttcaagcgattctcctgcctcagcctcctgagaagctgggactacaggtgcgcgccaccttgcccggctaatttttgtatttttagtagagatggggtttcaccatgctagccaggccgttctcgaactcctgacttcatgatccgcccacctcagcctcccaaagtgctgggattacaagcgtgagccaccgcgcctggctccttgtttattttttaagcattgatatttgtttcatgacattgtcacgaagtagaagccctgattgcagtgaagtttctctttacaagtgcatgcttctctgtgtaacctgttgatatgtctgtgtattttttctcttatacctgtaaatatttcctgtcccaggtcttgggtggaattgaaccaagtttgtataaaggagacatctggtatacccctattaaggaagagtggtactaccagatagaaattctgaaattggaaattggaggccaaagccttaatctggactgcagagaggtatttatgctatggtctctgttgtgtctttctgtgtatgtctgggtcccttaaatatgccagctggaacccgtagatgccaatagaaggtacattacctcgtaagataaaggctcattacatgaaaagatgcagggccttgctgtacagtaagttgaaatcaattaattgtcctccctccccaccccaaatattgcatcctcccaaccacttatcttcatagggcaaaattaccattaaatggtgagtgaagaggactatctgagctacacctttcaccattcattcatcttggattgatggtccctaagctcagtttaagaggttgaaataaacagatttttaatcagtgtaggacagagaaggacgaaaattaagcaaaatgaaaccgaaaagatcatcagcttttatcctccattcacagctagcctggcccccagagtacccaattctccctaaaaaacggtcatgctgtatagatgtgtgtggcttggtagtgctaaagtggccacatacagagctctgacaccaaacctcaggaccatgttcatgccttctcactgagttctggcttgttcgtgacacattatgacattatgattatgatgacttgtgagagcctcagtcttctatagcacttttagaatgctttataaaaaccatggggatgtcattatattctaacctgttagcacttctgttcgtattacccatcacatcccaacatcaattctcatatatgcaggtacctcttgtcacgcgcgtccatgtaaggagaccacaaaacaggctttgtttgagcaacaaggtttttatttcacctgggtgcaggtgggctgagtctgaaaagagagtcagtgaagggagacaggggtgggtccactttataagatttgggtaggtagtggaaaattacaatcaaagggggttgttctctggctggccagggtgggggtcacaaggtgctcagtgggagagcctttgagccaggatgagccagaaggaatttcacaaggtaatgtcatcagttaaggcagggactggccattttcacttcttttgtggtggaatgtcatcagttaaggcaggaaccggccattttcacttcttttgtgattcttcacttgcttcaggccatctggacgtataggtgcaggtcacagtcacaggggataagatggcaatggcatagcttgggctcagaggcctgacacctctgagaaactaaagattataaaaatgatggtcgcttctattgcaaatctgtgtttattgtcaagaggcacttatttgtcaattaagaacccagtggtagaatcgaatgtccgaatgtaaaacaaaatacaaaacctctgtgtgtgtgtgtgtgtgagtgtgtgtgtatgtgtgtgtgtgtgtattagagaggaaaagcctgtatttggaggtgtgattcttagattctaggttctttcctgcccaccccatatgcacccaccccacaaaagaacaaacaacaaatcccaggacatcttagcgcaacatttcagtttgcatattttacatatttacttttcttacatattaaaaaactgaaaattttatgaacacgctaagttagattttaaattaagtttgtttttacactgaaaataatttaatatttgtgaagaatactaatacattggtatatttcattttcttaaaattctgaacccctcttcccttatttccttttgacccgattggtgtattggtcatgtgactcatggatttgccttaaggcaggaggatcaggtcacccaggactcattccatccctgggtagacttgcctatgcagctgtgcccgtagtggttggggtggctcatctggtgttggccactggtgtccattctcctccctctgccacatgaagaacattgcaggtgaggacagggctggcagcgcctgtgtgtgtctcagtctatgatgcactgtggccctggttctgttcccagtgcaaatatgggatgtctgttgaaaaattgtccatccttctcttcgttagtgaggtcatagagaattgatttgtgtacagtttgtacaaatggcttttaatatatttcagcctcaaaagacaaataggtcttccctctgccctggggcaggagtgcaggtcctcaatgaaggaacttgggcacctctgagtaaggaaagagctgtgccttgggagggctattgatttgctaatttgggccgtgtcccctccctttcctgggtccatttccttgtctctgaagtgagcgtgttgggttggaagacccctggttccccagttctgagaacatgaatgaactacacagtccatgatgactggtgtggctgcctggatttgtgtgtaacagacagatggtgatggcggctagagccacgtggggcggggagcgccactgtcactcacgcacctttccctttctctcccggttcaagtataacgcagacaaggccatcgtggacagtggcaccacgctgctgcgcctgccccagaaggtgtttgatgcggtggtggaagctgtggcccgcgcatctctggtgagtcctcgggacactcacgggtccccgagttgctgagttacagtcacctgctgaggagcagcactgcgtgttctgagcatctctgaactattgcgccatgtatttccaattttcatattgtgtatttgtatattttatatgtaatagtataggtgtaatatgtaaatatattttatatgtatttaaaatctttatattttgaagggttttgtttcaactattacttgttaatttcacagtccctttctttgatgttagcaaatagtaccttcatgaacctcagaggacttggatctgaatgtgcaatgccctctagtatttcaaataatagttcagttggtatagtatttttttaatctgcaaaaaacaatacttgctaatatagctatgttagagtaaacaataaatcgagaataaatttatagcctttgaaacaaaacaaaccaaaaattttactcctttttggctttcatccctgcactggtatcttaacttctgtttgtataaaagaataccattttttcacagaagacaaagaacaatcagccaatctaataattattttatggccatgctctgaaatacaattaaaattatgattgtggacaatatgccttttcgggacctggctgatggtatttctggtgtgaccccaactttccagtcagttcagggcaataaacattggatacaggacagctttggggatgaaatagaattaaatttagtgtagtttttgccacttttagctggatgcctggcgaggggttttgtgccctctgagagcctccgtcttctcaactgaggggtggttgtgagttttgggtcaaatgcttggtgtttagtagatgcttggagcttccatgaaacatgcaaccacggcgttgctgctatttgttcagatgcgagaggaacatgacttttggctgcctgagtgttctcatagcatctgggccttccttgtgagatcgtcagaaagtgtttcctgcacaaagcctgtactgcggccctggcgtggggctgattgtcccgctactctgctgtgatggctgaattcaaagagtggccgataggagcacgtatggtgggtgccttgttaacagctcatagcagaaacgtgacaagcgggagagggctttgggttgtcctgaacttcaaacacctgtaactgctgcgggaagagcggcacgtggatgaaacggacacagagggggaataggcaggaaaggacgcgggctcttttcgaagcagcaggtctcaaggcggccagccactggcgcagctgcagctgaagccacggcagagtctccatccttcccactatctgctgaatcagagaaagtggcaggcaacatttttagtgccttaaatttagaacgcttgctcaaaatcagaccctacttaaaataaggagcgataccctcatttcttaaatagtaaaaatgccctcagcagaattaacgggagtatcttccaacttcatatcctgaatggaaaagtctgtccaccatcccgaggacgtgtttgaagcgcagtgtgaaaatccagcacgtcgtggaccggccagacccctgtgccgtgagaggcggggcggcggggccgtggggcgctcgcactcccgagctcatcgtggcatgcgctgagccgaaaaccacgaggtagagggaatgagatcacaacatttgtttgcgttgtctaaaattatcctctgatttcattcggtgcctgcgtcaggagggagaaacatgggaaggttgtttgtcttgggcagggaaagcatcacaagggcgcgttgtgtgtctggcttaccgtctctggaccaaagctgtgtttgtttttcttatctaccagttccagtaagccaaacctcttggcgtgggtttccttctggttaaggggagggctggcttcagagagtgaaagacaataaaaacgtggagctctgtcccctggcatggattgttcagatgggattctagaaattaagggtttggagttctgtatttagaaatgaacctggagcggggagtgttgtacaaggtgcagcccatgcagaggcaccgagacctgggctcgttccgaccctgccgcagtgcccgcttggctcaggcccagcgcctctctacggaggaaatccagacgcaaaataatacccgcttgaaaatggcttctaactttaacactctgtgatctgagggtcgaaactggctcccaaggacacgtggcttcacccccagggaggctgccagacttttggttaaggaccatggctctggggacagtaagtcccacatccgaatctgaggtgagctccccaggccagtcacttggccccttggaacctccttgtccacctgccgttggagctggtcatggcactatcatctgagctctgtaccccgtgtcccgctgcagacctggccaccgaaactcttccccgaatccagcaaaatgaccatcccacctcttctgagcatgtctgagaaggggctctccctgtgatgcacatcttcagtagacttcgctttttcacaaagcaaagatgcattaatgccagcattagaaatttcacaaatcaatcacaaatggtctgagtggagaacatgggatggatgaaccaaccacagggtgctttctccccagctgcacgccctggtgaggagggcaggtgtctgcagtgcgcgtggttacgtggcacgtaccacccctgatattcagtgcgtggacatcggcagatgcatacaggggcacccgcatgttttttcagttgtggtcttggcagcgttctgtcccattttcctgtcttctgttctaactatccttttggtttctataagactcttctccctcctccttggactctccctgtccctgtgcccctcctcgtggagcctcttcttctggcctgagccacctgttcttgctgcacaccctcctacgtgatcccatccttagcctcatcgatacctcctgctcacctgtcagtgcctctggagtgtgtgtctagcccaggcccatcccctggaactcaggggactcaggactagtgggcatgtacacttggcctcaggggactcaggattagtgagccccacatgtacacttggcctcagtggactcaggactagtgagccccacatgtacacttggcctcaggggactcaggattagtgagcccccacatgtacacttggcctcaggggactcaggattagtgagccccacatgtacacttggcctcaggggactcaggactagtgagccccacatgtacacttggcctcaggggactcagaactagtgagccccacatgtacacttggcttcaggggactcaggattagtgagccccacatgtacacttggacacgtgaaccacatcgatgtgctgcagagctcagccctctgcagatgaaatgtggtcatggcattccttcacagtggcacccctcgttccctccccacctcatctcccattcttgtctgtcttcagcacctgccatgtccagccggcagattccaccgcagcatcttctgcagcacccccgaccacacacctccccagcgcctgcttggccctccagcccagctcccgcctttcttccttggggaagctccctggacagacaccccctcctcccagccatggctttttcctgctctgccccacgcgggaccctgccctggatgtgctacaatagacacatcagatacagtccttcctcagcagccggcagacccagggtggactgctcggggcctgcctgtgaggtcacacaggtgtcgttaacttgccatctcagcaactagtgaatatgggcagatgctaccttccttccggttccctggtgagaggtactggtggatgtcctgtgttgccggccaccttttgtccctggatgccatttatttttttccacaaatatttcccaggtctcttctgtgtgcaaggtattagggctgcagcgggggccaggccacagatctctgtcctgagaagacttggattctagtgcaggagactgaagtgtatcacaccaatcagtgtaaattgttaactgccacaaggagaaaggccaggaaggagtggggcatggtggtgttctagtgttacaagaagaagccagggagggcttcctggatgaagtggcatctgacctgggatctggaggaggagaaaaatgtcccaaaagagcagagagcccaccctaggctctgcaccaggaggcaacttgctgggcttatggaattcagagggcaagtgataagcagaaagtccttgggggccacaattaggatttctgtcttctaaagggcctctgccctctgctgtgtgaccttgggcaagttacttcacctctagtgctttggttgcctcatctgtaaagtggtgaggataatgctatcacactggttgagaattgaagtaattattgctgcaaagggcttataagggtgtctaatactagtactagtaggtacttcatgtgtcttgacaattttaatcattattattttgtcatcaccgtcactcttccaggggactaatgtccctgctgttctgtccaaattaaacattgtttatccctgtgggcatctggcgaggtggctaggaaagcctggagctgtttcctgttgacgtgccagactagtcatggtttctgatgtgatcttgttttgtctagattccagaattctctgatggtttctggactgggtcccagctggcgtgctggacgaattcggaaacaccttggtcttacttccctaaaatctccatctacctgagagacgagaactccagcaggtcattccgtatcacaatcctgcctcaggtatgaacttggatttgtgctttgctctttttatcatgcaaaagagaaagcactccatgcatgacacgtgtattagatgtcacacctgcattagatctctatcaccacaataatgctgcaaaagacagccacacatattactgctcctgagtccaggcagggcggtgtcccttggccgggctcactcacgtgtctctactcagctggtggttggctgggtcccggttggcctccacccaggctggtgtaggatggtctcactcacatatctggtggcgaggtggatggaggaacagagccatgcgtttctctccattcagtgtctgagtcacatgtggtaacagggacctgggagagagaaaagaaccacacaggggctcctgaagtgtcagcccagaactagccactatctcttccatgatgctgcccaaacaagcccaaggctagcccagattccgaggatgagggaaaagatgcccctcgcactgggaggagccatggagccgcattgccaagggtgtggctacaaggaaaagggaagacctggagacatttttgtcacacctaccacatcacccttatacatttttcctgtttacgtataaagaataaaagtgggctgggtgcggtggctcacgcctgtaatcccagcactttgggaggccaaggcaggcaaatcacctgaggtcaggagtttgagaccagcctggccaacatggcaaaaccccgtctctgctaaaaatacaaaaattagccgggcgtgatggtgcatgcctgtaatcccagctaccccggaggctgaggcaggagaattgcttgaacctgggaggcggaggttgcagtgagccgagatcacaccactgcactgcagcctggcgacagagtgagactctgtctcagaaaaaaaacaaaaaacaaaaaagaaaagaaaaagaaagaaaaagaaaaactagattgcccaaggtgaagacatcatttttttcctatactcccagtacccactgactccctctttatcctacacgtctaatgaaatggaccacgtctgtcttcctcagtcccatttctcacctcttcctcctcccctccgttactgagcccttgcgcgtgtggctctcaccagcacttctgtaacctgcagagtgctgctgtgctcctgagcccccaccctctcttctttttgaaactgttgtcagatcagtcttcctaaaccaccactttcacccgagcctcccctgctatgagtaagcagtgcgtccccatgatttaaatgctcagggctcgctcctggcatcgctgtccatggcctcccaccagacccctcctagttcctcagtgttttcactgaaccccaaccctctgctgggtggccactgaccctcaaggcctcttgcctgcaactgtctcctaacctttgttccaccaacccccctgcctgaaatgccctcccttccttactccgcccatatatccagattcttcccatcctttaagactcaactcaaacaacccagcttttgttgaaaccatgccgagcagaataacccatttgtgaggttgcacctcccactcagcacgcatattttctggtctgctcatctggcatggaatcttatctttagggtacgttttatgctgttgcctttttcatttgacttctgttttcttaacttctatttcgttttcaattaattataaattccttgaaggtgagagctgtgggggtaaaagattgtccttccttccccaacgccaccaggccgtggagggaaagtacatcagaactgtttgtggaatggacacatcaatatgtctttgttgcaattgatgaatttgagataaagggaattggactgcagggacaaggaaggaggcgtaatttcaggagaaaaaaagtaaatggtactactgccttttcccattttcatctttacgttgtggggatgtgctttccagaaaaggagagatcttggggaaaggattgaaagctccaggagaaattcaggccgacaggagataccacgctctcaggagaggcttgagtaacacgctcagcactgcccttccctcacaccgtaactttgagcaaagcatttagccctgcctgtgtctctttaactataaaggagaaacaataatacctaccaaagacattttcagaagaatgcagtatccttggatgaatggcactgcactgaatgatattacaatgctatgttttcagcatctttaaatcatctttaaaatcatgtgctcttggccgggcgcagtggctcatgcctgtaatcccagcactttgggaggctgaggagggtgaatcacgaggtcaggagttcgagaccagcctggacaacacagtgaaacccagtctctactaaaaatataaaaatattagctgggcttggtggcgggcacctgtaatcccagctacctgggaggctaaggcaggagagtcgcttgaacctgggaggcagaggttgcagtgagctgagatcgtggcactgcactccagcctggacgacagtgtgagactccatctcaaaaaaaaaaaaaaaaaatcacgtgctcttgatgattacattttggctagtagagcggcaaaatgtggacattatttcatcagtgtggtgtgtaataatgtcaaaacccagcttgaggacccaggtgtgcactgctgaataaatgtcaggcaccaaggactcgtaagaagcaggaggagaaggcaggcattagggggaaacctcagtccaggtgggtcacagccgggaaggcttgcttggcttcctcaatagcttttaggacccagcactgggcaagctcaggagcagaatgagaggggtttgggagcatttcatctcatttgcacatctctgcataagaattcattattgctttcacttataatggtagatattttttggttgtctttgacatgttcagattttttatttttaaaaatccactttgcctgctgttttcctgatttcttactcagcatcacattccacttgctttccattccctttctgggaggggactccagtaggaagctgggaaagatcacctggtgagaccccacacgctccatgtttcccagcagaaaggctctgcccagcagcctttctaacaccaggggaaaccgccagggttcttgtcctcagagttttaggatggggccctacctgggacctctcaaacatgagccctaataagtgggcaaacgattgctcctgcagaaaagagtcaattcgaaagcaattactttaaactttgtctatacccaacactattttccaaaagcccatgggctgaatcctatgtggcctgttaaaaaacagcagctggcagcccacaggggagctctaaggtttcttcacagcttctactttatccctacttgacctgctcttcagtgtggtcacatggcagcccctccctgctggtctcctctcagtcttttctgctccctccaaaatcacccctcacagtccctcaaaccccctacagccagaaggcccaggactctgtgtattcgtgtgtctgcctgtttcatccaagtctttcttcctgtctctgccctttaaggctaatcattactcacaggaaggttcgttttcttactcattttgcactcttgcttttctccaaacaggggcattttgtcatactcagctgctgtactctctaattgcctgcatttgaattatttgctatccaaaagccaagaaattgttactgctggtaggatattgatttgctcactgattgtgttcaggtttgacccatttccccacatactcttggctccagggatatcaatggccgactcatcttcatttaacactgcacagcacctgtgggaactggccctcctgaatagcagaactgctgacccacagatgctgtcttctctctgatgttgattacttcttcctcttttcactgaggaaattgtcctgcctccgtcaggctgcctacttttaaaactctgtctgcccgaggggcgcatgatgagctctgggccagctaggagccattgcagtggatcccaagagacgaggacagtgaggacttggcctgagttgggcgagggagtgatttgattccgcttcggtttcacaggaaggctcacaagggtctggttacagtctccatgcaggctaagagagaaaaggactggcccagcactatagggcctgagtaactgggtgaatcatgaatttactgagacagagaactgtgggagaggtctgatttggggggaacagccagcattcaggttttacaggttacacgggaaatgccgattgagaggtgggcaggcaggcggacacaagcatgtggcaatggtggcccaggtctgggctggagaggaggagttgggagtctcaggctagatcacggggtgacctagggccatggggtggggccagatgggtcacccaaggagggaagattgagaggaggccagagcctgagagtgctccgatgcttgcaggggaggaagatgaaggaaatccaatacagtgcctgagaaggagcagccagggagttagggagaagaatgcagccctcttagagtccaagtgaagaaagcgtccacacggacgaagtgattagtggtcagcagtacccatagagggtgtctgtgggggcacttcccgccctatggttactgcctggttccccctagattggaagcctcgagggagcagggactgtgtgtcattcaccgttgtagtgctggtgcagagagcagcacctgagccatgtgaagtcctcagcagataactgctgggcagatagccagatggacatgaggactaaactctgactttttttttaattctcttgcccaaaattcctacctaaggggcctggggagtccgctctacacaccataaagtttcaccagaagggttttatttaaccttgtataacatggcctgctttccagcctagctctggcataacatcacataacaaataaggaaagaaatcaaaatattttaaccccaaatatatttccttttcatattttgaaattgccctgcagagttgtctcttgtgagaaaaatctacattgtatagagaatccccttttccctttttttattctttccagatctagaagataatcgactaagagtcaggcaaccttttttttttgtttgtttgttttgtttttttttgtttaatacatatatactttaagttctggggtacatgtgcagaatgtgcaggtttgttacatagttatacaggtggcatggtgatttgttgcgcccatcaacccgtcacctgcattaggtatttctcctaatgttatccctcccctagccctctaccccctgacaggtcctggtgtgtgatgttcctctccgtatgtccatgtgttcttattgttcaactcccacttatgagtgagaacatgtggtgtttggttttctgttcttgtgatagtttgctgagaatgatggttttcagctttatccatgtccctgcaaaggacataaactcatccttttttatggctgcatagtattccatggtatatatgaaggcacccttttaaattctgtaagacacatttcacaacctcttttcttcacagcctgctaactaaaagcttcctctgcacaataaaactttggtctcttaatccaaacatttcctttccattgatcccaggttagataaacttaaccaattatcaaccagaaaatttttaatttacctctagcctggaagccccactttgacttgtcctgcctttctgaaccaaaccaatggacatcttaaaagtatttgattgatgtctcatgtctctcaaaattgtataaaaccaggctgtgccctaaccaccttgggcacatgttctccggacctcctgaggctgtctcatgggccatggtcactcatacttggctcagaataaatctcttcaaaatattttacagagtttgactcttttcatcagcaaacagttggacagacgtcttctgggtgtgtgcacctgtgtgtaactccaggtggtgcatgtgggtcacctgtgctgtcactgatcaataatattgatcaccatgcttttgatcttctctcctcctggatggcagggtgagatcatctttcttctcccgtgactccccccagcgcctgggagggtcctgagcatgcgtgtgacctcagcaattttgtgatactgcctgatttgtgctttttcttgtttgtttgctctctcctctccgacaaacagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcaggtgagcgattctggcatcgaacagggatccccgacaagagtcctttatgtaaatgtgctgacttggaagcaattcttgatggcaactcaattaccattgaattgtttcactcattcctatcaccagtgatcaaaatcttctcaataaaatgggtcatggggttgctgagagaattaaatgacatcatccatgtgaaacttcagtgcttggcacatgggaaatgcttactgagtgtgagtcctgatagtcactaggagtaaaaatatgccgtgaaaccttggagttgaattgcaatttttcgacagtttaagcaaaatgagtaaggaagaaatttcacacataagccgtgtacatttatttgtccataaagctgtcctcattttgaaataggaaatgaacacctatcgttgcgatttcttgaaatcctaatataatgagaccaaggagcccctgtttctcgtgggattcctttgaaagatgtgtgagggcagcccgcagcatgactctgcagtctagctggagggttggcaggtcttcagagaaaccaggatagcatgagaaagtcaagaggatagataaaccccataagcttgaaaatgtcttcagacttcacggtttgcttgaaacggagtgctcacaccacacacggcttaatgggaggattaggtatttctgactgagagtccaagcctgcaaggcagaggcaaatcacagaagtgggcatgagattgaattgccggagacaagtggaggaagagcctgaatcagaaaagtggtcaggagaacggcagcctttcaaaacaagatgtcaagagactgaaaaaaaaatggtacattgggtttgaagtcaggagcagaatggaattccaaagttgtgctggtgatatgtgaaaggagagaaaaattaagtgtgaggtcaaaaaagaatcgatgacaatgaggtagaatagaacaaaatttgggaatcgatagggaaatacaagatcaccatgtggttgaaggaaagggggttttgtaggaatttgatggatatgagacgctgttggaggacaggtgagattgctgggccatcctggaagcctcaactcagaccttcactctgatctcaacccaggtgaagagctgccaggatgaggtacacaggcaaaatgccaagtgatcacagctgaattattccaggagggagagatttcagttactattttttaatacctaaaacatggtcttaaaacaggactcctggtaaataaagcagataaaggatgcttcattagctgactttagcagagtggcctttcagaaaagtaaagtaacaatttagagaacagaaatattaaaaggaaagattgcagtggactattaggccaattcatattctgtataaataaaatcatccaacccagtgtatgtatatgacacatcatgacatgtcttcataaatatctgtgccgacgtatttcgctttgcatttgtgagcagacttggaacccttcccattgtcatgttttttatctttgctatgtgtaaatgtttaccttatgtatgtgcaataactcttttagcctgttcagttatcattgagtgagacctttctctgtggcagcaggtgggactgaaatatcactgaatttcctaactgtgactgttttacttctttttaaccaagagaatctaagaacttaggcaattttgtccacaatttctgttctctcattaaatatcattaaagtagaggctactatggcaacagctgttagagggtccacttaatactgcagaatctaataaccatttgttttctcagtgaattactgttggaaatggtgtaatattaggcgtctctaggcagggcaacttttttttccctgaatttcactgtgagttatttgctagatgctcttatatacagcttttgttccttttttaaaaatgtacttgagcttttggtatttaaatgttagattttaccagccatgggaaaatacactgatatatgtcccctcttccatgtggattgtttcgccattaaagtaattactttcctcagggctgcaattaacggcccagacagtgctcgatagaaccctaataaatggaatagctatgctgcctttcttttttttttttaagtatttatttttcattataaaatgtttaagtaacaaaaaaaccttaagttacagaaaatcatatactatgtgtgcatttatggactatctagatttaatattttgtcatattttctttaaaaatttgtcttagaaataaaaaaccaagtatagctaaagtttcaccccaccccctcccccagcactactcattatcctgagattagtgtatattcttatctgaattactatacatttataattttactagatgggcatgtgcaccttctattaattatctattgctatgtaacaacttacccccaaatgtcacaactctctatcaccttctgcagtttctttctttcttttgttttcttttttttctttttttattttattttttatttttagacagggtcttgctctgtcactcaggctagagtagagtgcagtggcatgatcagggctcactttagcccaacctccctggttcaggtgatcctctgacctcaacctcctgagtagctgggactacaggtgtgcaccactgccctagataattttttgtattttctctagagggggttttgccatgttgcccaggctggtctccacctcccaggctcaagtgattgaccccccggccccgccgtggcctcccaaagtgctaggtttacaagcatatgccaccacacccagcctgtctttgttttgttttgtttttaaaagacagggtctcactctcttaccaggcttgagtgcagtggcatgatgttggctcagtgcagccttcacctcccaggctcaagcaatcctcccacctcagcctcccaagtacctgggactatagcatgtgtcaccatgcccagaaaatttttggtattttgtgtagagatggggttttgctgcgttgcccaggctggtcttgaacccctgggctcaagcgatcctcccaccttggtgttccaaagtgctgggattacaggcttgagccaccatgtctggccatcttgtggagtttcttagggccaggagttgatgaggcacttagccgggtgtctctggcccaccattgctcatgaggctgcagctgtctgaagtccattgtaggagctggttccaagctcactgttgtggtggcaggagccctgcttccctcaccatttggacctcactccaggactgcctgatgtcctctggtcagccctgaacatgtgatccgagagagcatgacggggcacccaggatagaaaccccaggttttcatcacctaatcttggaagcagcatgttctcactgctgccccactccgttggtcgcacagaatgaccctgatatgatgtgggaggggacgacgcaggtaaatgccaggagtcatccgcagtcatcttggaaacatcctaccgtatacttatcacaaaacctaggttggttgatttgtttgtttggtttatttttttttatttttaaatttataggaatgctgtggtagtgtgtatcctttgtcaactcgactttattgtttgacattacattttatagattttccatattgatatgagtcctaggttatttgttttgactgcatactatctcactttatgaatgtacccagattacccatttttatcttaattaacatttggattatttctgtattggcaattataaaccgtactgcagtgaacgtctttgtgtagatgaatgagatcacctaggaatggaatttctaaatgatttattatgcaactcttcagtgttattggctacagtcaaatttgtctttaaagtagctgaaacatcagcattatatgagaatttccattccctaaaagcatgactgtatttgttttgtctttgtgttttgctaatccatgtatgtgcaatagtgtcacattttagttgattactttcaagatcatacaactttggatatgtttttgggatgtttgagcttcttctctgagggtgaatttttctactaatatagtgtgcacatttttctacccatactttttactgatagacatgagttccttatatttctgaggtattagtttttctgagttatactatctagtctccctgactttttactttgttttggtgccttatatttatatatatctttaatttagtgaaatcaaatttaccagtatttctctcatgaactatgccctgtgccttatttaagaaatacttctttaatccaagaaaatagggatttttttcttctaaagatactgtatacttttttcttattttcttccaaaatgtgaattaggaaattaatttatataaggacgttccattttctcagcatccttattgaatatataatgttttcccctctgatttttccaatttttttatttaaaaaatttatatacagaaaagactaaaaataataccatgctgttctgcatgtcaaccatctagatttagtaacttttaacattttgccatataccagtatgtgtatataggtgagtatgtagtttttgctgagccatttgcaaataagttgcagatatcatgactttcacccctaaatatttcattatgcattctaaaagtaaggacattctcctatataaccacaataccataatcacacctaaaaaattaataatatttgctaaatatcatgactatgtagaccacatgcatatttccccaggtgtccccagaatgttttcattagctgttttgctttttattttgttttggaaggccagttctcttgtagaatgtatcatattcagttttatctattccctaatgatataccgcattgattttgcatcatatttccttgaacttaagtctagaggcttaattagacttgagttaaatgtttttttgcaaggtatctaatgaattttaatagcatctttgtcatgtaccaagtccccatttatgcctgagcctacttctgagcattctgttccattccactggtcaagttgtctatccctcggctaagctatatagttttatttatttttttttagttataggacaatatctggcagggacttgacccttcttattcttcctcagagttctcttggctacttttgcccttttattcaacttgtcgagatccctgaaaaaccctgttgggatttctattagaactgcattgaacttacagaattaacttgagaagaaaccaaatctttaccatatcaagtttcccctatgaatgtaccagatcttttcatttatttaggtcttcttttatgtcctactccagtattttgtaattttgtccaaaaagattcacacatagacttattcctatgtacctcttagttcttaccacaaatgagattattttacattgcatttcttgtgagttgttgggaatatgggtatgcaatttttatatattatatattaatcttctatccagccacattgctaagttctcctttctagaaatggtttttagagtcgtttgaattttctatcaaaacagccatataatctgcaaatcatatattttaaatcacttgtagttgttatatcttttatttatattttttgtgatgccctctgagacaatattgaatacaaatggtgataatggacttttttgtcttttttcttactttaaagaaaatatttctcatttcgtaccatggagcattatgcataggataggtttgtggaatttccttctcagtcctaaatttagggatttccagtttctgaaaagtattcagtatgaatggaaaagctttttgacaatttccacattaaacatatgcctactctataatcaacattcaacattaagcatatgcctactctagaatccagcagttgtcactcttaggtgtatgcaaaggagaaatgagtatgtaagtgtgctgagacttaaccagaaggttcataacagctttacacataaaataacttaagtaatacatactttagtagttacataaatacataaaaccatcacttttatcaaaatagaaacatcccaaaagtcaaccaaaggaaaacagatgaacaattgttgacttgccattcagtggaacactgccagcaattttctttctgctgaagagtgtgcttttggatgtcttttataaaagactgtgaaaggtaaattttattttgcctcaattccgaatcacaatttagctatacatggaattctagattgcctgtgttcccttagtgttttgaagattcagtttcattgtcctctggctgtgatgattgctgaagaaaagaccctagttggtcttaactgttgtacctttaagggtaatctgttgcttctccttagttaccggtaagactgcttttattttaaatttccagtgttctgaatagtgttctgaagtttcaccatgatgtgtctaggtatagggtattttcccatcgtgctataccctttacactctctgaatctgacaactcatgacttttgtcatcaatcttagagaattcctagctgttaactcttccactattgcctcatgcacattctttctagtctcttcttctggatctctcatttcaagtaatgagatttctcattatttatttcaggtcccttgacccttcatttatgttttcctttctatctttgctgcattctgtgtaatttcttcagatacattttatattggcctaattctctgttcagctatgttcaatctactatttaacatattcattgagtcttttaaaatacttttactttttattatttttattgtttttggattctttaattgtctttggtttgggggtcttttttttttcttttgagtttttcatttcgatgactatatttttcatttctagaaattgtatctcatacttttccaaatataccatagccgggcacagtggctcatacctgtaatcccagaactttaggaggccaaggcaggaggatcgcttgagtccagaagttcaagaccagcctgggcaactgtgttagttcattcccatgctgctataaagacatactgggactgggtaattgattaagaaaagaggtttaattggctcatggttctgcaggttatacagacttctgcttctcgggaggcctcaggaaacttacaattgtggtagaagaagaaagggaagcaggcacagtcttcacgtggccagagcaagggagagagagagagaggggaaggtgctccacactttcagacaaccatatcttgtgagaactctatcatgagacaatactggggggtggtagtaaaccattagaaaccacccccatgatccagtcacctcccaccaggccccatctccaacacttgggatcccaattcaacatgagatttggatggggacacagtgccaaaccatatcaacaacaaagtaataccctgtccacaaaaaatcaaaaggttagccaagcatggtggagcatacctatggttccagctacacaagaggctgaggcaggaagatcacttgaggccaggaggtcaaggctgcagagagccatgatcatgtcactgcactccagcctgggagacagagcaagactctgactctaaataaataaataaatatgccagttaacttttctatagtgttgtgtaaaattttattgtgacttggattttctttatcttctttttagtttttatttaatttaaaaggctaggtaatatttagaaggtacgatatagcacatagtcccactccctcagaggtaatcatactaatgcctaaagtccttccttttttttttttttcaagcctcatagtttattatatgggtgcacctaatttatttaaccagttcattattgataggcatttaggttgttttaagtcttttgttgttacaaataacactgcagtgaacatcatttatatatatcatttgcatatatgaaagtatacatctaggttaaattattagaattgctgagttaaaaggtatacatatttgtaattttaatgaatatcacttcgttaccttccatagagcttatattcatcgatacctggccataccatctcttgtaatgtagatgataacctacttggaaattttggtcatctgacaggtgaaaaatgatgatctcggtgtagttttaatttgtgtcactttctatgagtgagattgagtttcttttcaatgactaaggtcactgtttgtccttttctatgaactacccactcatatctttgcccattgttttctgttggattctttttttgtattaatttgtaggaactctttatgtaatggagtaattaaccatatgcttggaggaaaaagaacctataatttctgtctcaattgtacatttttaaaactttgcttatgacatgttttagtgtaaaaaatgtttactttgtatatttaaatagtttgatattttgctttaagggtcttgggactactgttaccttttaaatggctttcctcactaaaagtgttttgtgacttattcaagtactttcatgtttgatttaacttggcatagaatgtgtggattaaacttctttcctctaggataactacccccattgttataacatttatcaaataacttacttttttttactttaaatcctaaaattactgcataccaaattctagtaaatatttgggagatgtatatctgtttctggattttctgtactattccattgatatatcttatagtattagttccttttcattattcttttttcagaatttccaactcttctttcttaatttttcttttcttttatgaacttttgagccagcttgtttagttttaaaaaaattgtactttaatgggtttttagtcactttaaacacagctatggtataatcttgtgcacgttgttctatttttccatcaccgatggggagttcatcttgtttttgtgtctgctggctgctctctcatagtagacttttttctcgtttgctttgcaattttttgttgtgagcttatatttagagggagcacattttttcttccaagagagtgcagtgtgccttgggctgtaaagtgttgctgtaaagcaattttgcatatgtttctgctgagtgtccgcagaccatgagaatcttgggatttgcataccaggttgtgcgaatttagatgccagccacgtttgaggtggaggtttaggggctccatttctcatgggagagtttcttgccctcctcccccaacctcttagcccctgagctgagccaggcttctgttggcagaatttcccggctcctttcaccaatgggcaaggtttgcacaggcatcttgaccccagtgcctacttccttggtgcccagggtcaagtctctcacccctcctggtcgtgggaaccccagccttagggcccatttctggttgaggaatgtctcttacttctggactcagctatagagttaaaaagttatattttatcctcattcctctttgttgcagcaggaagaggttctaccttcacaccagtcactgtttgaggaccccacatctttggaagctgcccttctctcacagtgtttgtgtgtgtgtgtgtgtgtgtgtgtgtgtgtgtgttcatggtcatttgtgtttgtccgatgacacttagcctaagggttggggtggggggagcagtgagtgggagctccttgattagaatctcctgggacactttttcaaaatacacctggtcaacatcctcacgcccttttccagcgaaggcacagcaggatggcggtgggtgggaaggtgatgggtattttggaaaaagttccccagatgcttctcttatgcttcccctgcctctcctcagcccactcccacccctgctgagaatcattactgcagtcagattggctggaggtcagggtgtgttatggctcgggccagcgtctcatatctgacatggatactagggactggagcactttcaaccacctctgtgttgctgggccaagtgtcctacggctacgaaaataatagagtgttaaaattgacaactctctgttattttagtgtatccaaagcttatgaaataccacccatctctttttatagattgagacatttagcacccaagagctgtatagatctcagcttgtacaacttgaggcacatgatggattatggcagccatttgactgtgaatttttcttgctgcaggttgaaagtggatcatctggtacatgctcatgtttaaaaatagcagagttagctgttaagagaagagtttcagagatactcctctgccatctacttagactacaatcaaaagataccaaagccaggggaccccaaaggtgtagatcaggctgctctgtttcctcattttacagaagagaacactgagggccccagattttccgtagctttcacatggttgcagaaaaaaaatctggctctgggtccagaacccctatcctgaaactccagaatgtttttctaagtaaaccatgcctactcagaaagcatctcagtaccagataatcagtgtggcgggacagttctcattattttgtatgctatagggaaaaagacctgaccattataatttttatccttggtaaaattacagatcttccacaggcactcattatcaaccagatcctgacctttcagagaaaatacacaattaaaattgtaactcgagacattgatgaaagagttaaaagtaacagtttagtaacagcggacacttacgtagcaccgatcttagcccaggactgtactaagtgcttaacatctattaacttgattgttcttacaagactgactggtaggggctgttattaccttcattttatagatgacaaaactggggggcaaagaagttaagtaacttggcccagatcacacagcttgtatgtgggagctaggattggaaccccagaagtctggccccaggttcatgctctcacccactgcatacaatggcctctcataaatcaatccagtataaaacattagaatctgctttaaaaccatagaattagtagcgtaagtaataaatgcagagaccatgcagtgaatggcattcctggaaaaagcccccagaaggaattttaaatcagctttcgtctaatcttgagcagctagttagcaaatatgagaatacagttgttcccagataatgctttatgtctgaccatcttaaactggcgctgtttttcaaaaacttaaaaacaaaatccatgactcttttaattataaaagtgatacatgtctacttgggaggctgaggtggtgggaggatggcttgagtttgaggctgcagtatgctactatcatgcctataaatagccgctgcattccagcttgggcaacatacccaggccctatctcaaaaaaataaaaagtaatacatctacattgaagaaaattaattttattgggtttttttgcatttttattatacacagcacacacagcacatatgaaaaaatgggtatgaactcaggcattcaactggaagaacagtactaaatcaatgtccatgtagtcagcgtgactgaggttggtttgttttttcttttttcttctcttctcttctcttttctttttttttgagacggagctttgctctttttgcccaggcttgattgcaatggcgtgatctcagtttactgcaatctctgcctcccgggttcaagggattctcctgcctcagcctcccaagtagctgggattacaggcgtgtgccaccacgcctggctaattttgtatttttagtagagatggggtttctccatgttggtcaagctggtcttcaactcctgacctcaggttatctacctgcctcggcctcccaaagtgctgggattacaggcatgagccaccgagcctggcctcggtttttcttttctaatctcaatgagattataacagatgtgctattctttgacatgctttgactatcttattcttttgactttttgaaacagctttgttgggatataattggtgtaaaataaacagttcatgttgaaaggatacagtttgataagtgttatatgtgtgcgcaccttgaaaccatcaccacaaacaaggtagtgatcatatgcactgagctgttttccctgcctcccaggtcctgtggaccccatgccattcccaggaaaccactgacgtgccttctgtcactgtagactagtttgtatttgttagaattttatataaatgaaatcatacagtatgtattccattttgtctgactgctttcacacaataaaattattttgaggttcatctataatgtttcatgttcaaaagttcatttttattgcagatcaattaggcattatagtttctttatccccatacacctgttgatgaacttttggattgttgccaagttttgggttttttggcaattataaataaagctgctatcaacaatagcatgcaagtccttggacatatattttgttttttatttctcctggataaacacctaggagtagaatcgttgagttacataacatgtatgttttactacttaaaaagctgccaaactcattttcaaagttggctttatcatgtcacattcctgccaacagtgtatgaaagttccagttgttaaacatcctcaccaacatttggtatggtcagtattttcattttaataggtattaatatttagcggtctcatcgtggctttaatttgcatttccctaatgactaataatcctgaatatcttttcatgtacttttttgccattcatgcatctttttaaatgaaatgtcttttcaaatgttcttgcccatttttgtatagggttgtttgttttctcattgagtcctcagagttatttatatatgaagaatacaagtcctttatcagaaatttggctttcaaatatttttgccaagtctttttagtctgttaatattttctattaaagaggagcagttcttacttaattttgataaaatccattttttttccttttacaaattgtgcttttgggtactatagctaagaaatttttcgcctaaccccaggacacaaagattttatatatatataatggagatggggtcttgctctgtcaccagactagagtacagtagcgtgagcatagttcattgcagcctccatctcctggcctcaagtgatcctcctaccaccgtcgcctaaagtgctgggattataggcatgagccaccaccacacctggccacaaatgtgttatttagtttccaaataattagggatttttccagaagctttctgttattctaatataacctcagtgtgggcagggaatatagtttttatgaattgaatcttttgaaatttattgaaacttatttcattgtccagaatatagtctatcacagtaaatatttcttgtgctcttgaaaacaatgtatattctgctattatgggtggattagtttataatagttagatcaagttagttaatagtgttgtttaggtattctatatcataacttattttctgtctacttgctctattattgagaaacggatattggaatctctgactatatttgtggatttgtctatttctctttgcattttcatcaatcttgttttatgtattttgaaacactgttattaggtaaaaaaacattaggatttttatgtcctatttatgaaggaaacagtttatcattatgaaactactatatttacttctagtaatttttttgatctgtatctattctgtctaataatatagccactctggatttcttttgataagcattaatatgatagtttttttccatctgtttagttttaacattttgagtcttaacattaaaagtgagtttcctgtagggagaatatacttggatcttgctttttatctaatttagcagtctctgttttttagttgtgatgtttaggccagagatccacaaacaacagtctataggctgaatccagcatgtggcttgtttctgtatggcctgtgaggtaagaatagtttttacatttttaaagggttgaaaaaatcagaaagaagctaacctaaaaagcttaacatatttactatctggccctttacggaaaaagtttgccaaatgctggtttagactatttatatttaatgtatgattgatatgtctgtgtttaaccagtaacacaacaaagaaaactatttttctttttgtctcatttgttacattttttcccttttttccttttttgctgccttcttttggattattttctatttctttatatctccttggctagtttattagctataactctatatcgtgaaattttagtggttgctttagaatatgtagtgtaaattttttaactgaccacagtctaccacttcatatagtctaagagccttccaacaatagacttccatttcttgccttcggtcctttgtgctattgtcatccattttacctatgcctatattataagccacccagcacattgttataatttttgatttaattgattatctttgtaaatatttaaaattaaaagtaaagattttataactactatatacttcccgcttctggtgttcatcattcttttgtgtagattcaagtttccttctgatgtcctttttcttctgcttgaagaactttctgtagtgaaaatctgtgatgtgttctctcagcttgtgtatgactgaaaatatttttatttcttcttcatttttaagatatttttgctgggtatagagttctcggttgacagggcttcttctacccccagtactttaaagatgttactctattgtcttctagtttgcattgcttccaacatgaaatcatctgtaatccttattattattcatttgtacataatatttcttttttctctctccttgcttttaggaaattttctctttatcactggttttcagcagtgcgctattataatctatgtcatgtttcttgtgtttggggtcctttgggcttcttgggtctgtgggtttatagtttcataaaatttggaaaatttttggttttttcaaatattttttgcctcacaatcccttcttccttttgagtactctgattacatgatttagcagcttgatattgtccacagtttactgatgttctctctctctcttttttttcagttttttctctgtgcttcatttctattgttttggttttttttaaattcattagtctgtttttctgcagtgtataatctgctcttacaaccatcccgtatatttttcatctcacatattataatttttatcactaaaaatttgatttagatctttaatgtcttccgtgtctctatttaacatgtttaacattttctctggcatcctgagtagaatacagttataataaatatcttgatatcctgcctgctaattctatcatctgtgccatttcttactaagttccaattgattgattttgctccctattatgaactgtgttttcctgcttctttgcataattagtgctgtagaatcaatgtttatgtcctgccaaaattcttatgttgaaacctatcgggggaacctgcccccgataattcaacattatttcacgtaggttcttttctatttccttaagtgtcagccggtctgagaaataaagggaaagagtacaaaagagagaaattttaaagctgggtgtccagggaagacatcacatgtcggcaggttcgtgatgccccctgagctgcaaaaccagcaagtttttattagtgattttcaaaggggagggagtgtacgaatagggtgtgggtcacagagatcacatacttcacaaggtaataaaatattacaaggcaaatggaggcagggcaagatcacaggaccagggcgaaatcaaaattgctaatgaagctttgggcacgcattgtcattgataacatcttatcaggagacagggtttgagagcagacaactggtctgaccaaaatttattaggcggaaatttccttgtcctgataggcctgggagcgctatgggagaccggggcttatttcatcccttatcggcaaccgtaaaagacagacattgccagagcagccatttcagggacctacccctaggaacacattctttttctcagggctgttcctgctgagaaaaataattcagcgatatttctcctatttgcttttgaaagaagagaaatatggctctgttccgcccggctctcaggcagccagacctaatggttatctcctttgttccctgaacattgctgttagcctgttcttttctcaaggtgcccagatttcatattgtttaaacaatttgtgcagttaacacaatcatcacagggtcctgaggtggcatacattctcagcttaggaagatgatgggattaagagattaaagtaaagacagcataggaaatcacaagagtattgattggggaagtgataaatgtccatgaaatcttcacaatttatgttcagagattgcagtaaagacaggcgtaagaaattataaaagtactaatttaaggaactaataaatgtctgaaatcttcacaatttatgttcttctgccatggctttggccagtccctccgttcggggtccctgacttcccgcaacagaaacctaatctccaaggtgatgatatttggagttggggcctttggaaggtgattaggtcacgagggcagagcttttctttgtaaatggaattactgcccattattaaagacagtccaagagagctcccttgtctcttccaccatgtaaagacacagcaagaagatcattatctacaaaccaggaaatgggagtatagattgactgcagggtgcatccctctgttctcggtgttggcaggctcttgttcattgcctttctttttcagtgcacttaggaaagccatattatgacagaatccacattagcaagaaaatgcagtcactttgcaaagtaatcaagcctgttttcctctgattttaaaaccattcttttcaggtcattatcgcattgttattttgactttttctttcctcagtcaaaaagggtattatttggcagctctgaagatcttgaggctttagttacagaaaaatcaaattcttagcagtgttattttctggtgccaaaatattcatttctgtgattaaatataggaaaaatgggtaatgaggcctatttcttttccgtattgcaagtaaagcttaagatcccatattcctgaaaggggcagagaagcctagtgtaggcaaaggaagtctacagataatccacaaaccggctttaagaaatcatctcaacttccttcttggtttgaagttattcaagagtctctagcagaagtcaccgggtgaattttaactgtttctctttgtcaccagtgatgtcatgaattaggtgttgcattcacttactgctcctggctgttgatgagacctaggataagagtggggcagggagggtctctcaagccagcctgacccccggaggtctcacaacccactaagactatgagtcaggttgatatgaggtccctatctgttgtagaatccatggtagggagtgaactcaggttgactccactggggaaaattccccatgacgtaggcaggtccagctgagctttctgcggtaaattctccttctctttctcctcttttttcatctccactgaggaagcacaacccacacagctgtcatgaccaggtgctgacctgcactctcacctgtgtagtaccgcagtgtcgctggcattccatgaagcacagggtgcttccatatgtgccctgctgcagttcccctccacacctaggctcggtacccacacaccttaaaacatgccgtcgttccagtttgcagggactggacccccaaaggcacgctgagccgtgaccccactcagtgcttcctgagctgtctaagccactgggacctcagtggactttaactgtggtttaataaaccaaggggttctgtctgtgtccaatgtgagaggtggaccgctcatttcacagctgtggattttccctttctgtctccccagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattctatttcactagcttagttgtctctttttccaaatcttctctggaagtaggttggctattaccctgttgggaaacagggaaatggcctgatgcccctatttctgaccagctgtcagggaaggaagatgcaagatgtgcagaagacacaaggtaacgtctacttatccccgtgcttcgaaaccgtgtgtttccctttgcagaactggttagcctcaagcatacccatccaatcagcttaaattgttcagcagttgacctctgtgcttcttcctttgggggtgtttaatctttggtaacagttgtgcagtggtagccttatttcggggggcagtccctactttctgtcacttatcgaggcctttgccaaagaaaagtggaagccgtttccttgacatagccttatatgacctgatgtcattaggagaagagttaaaagacagtatcccctctctcctgcttgtgtgccaagttcagtgttccctttgcatttttttggggtgggttggctatattacagaattccaccaaaagtgctaagtgtcccctcctgcagaagtatcgtttgtattcacagtaggctacgtgtggatgtttcagccatctgctctgctccctgggtccccgggtcaccaccatactgagaaatataggactctgccaaagagacgtggaggccacgtcggcttgtcatggtgtcctggaagactctccagcagccagaagaaccttctgtgctgttttcactagagaagatttgagttgcagcctcttggaaagaacatgacggcacggaacgggaggagggggctcttgtatcagggcccgttgtcacatccgctctcagcttgttgaaaactcataatctcagaatgcatttcacacggagagatgtctggaagtccaattctcatcccattggctttttccgtggttgctgttttgtgggccgctttgcacaggagtgaagccaacacccctagattgtgccttcacccttgctgtgaaaaattcaaagccctgaaataagaggagggaatcgcagacatgccctgattagttttcctgcttatttcttcatacaggcatcttctgttccgttgtattgtgttaggtttcagaggcggggagcttcctcctgcagcagatgaacaggcatagttcttaaaatacaggaaagtaacaagtgaggtttccaggtagagtaggtgaatgaagtttgccgtcatgctctgtatttcatatcagatttctttatcttttcatatcgcatg

SEQ ID NO: 16947 - DNA, 31720 bp, Human
ccctaaaatgtatttaaaacgaaactaaattacttttatacttggaaattctaacctcaccagcctgggaccaatgactgttaacataaatagcagctgcgctcccggaatcccagagggtctggaactcgaattcacaattcctggaaaggtgtttgttttcgttttaccagttgtcatgtgaatcggtaaagcacttcaaagtccgcagaggagccggataccaaaccaggttcctgccgccgagcccgtgatctttggacccgatctgctcacagctgggagctggctcttttggtctccagggggctctggtcttcagtcccaggcaccaggcactgagctagcagcagacactccataaatatttgtcaaatgaagcacacagatgattaaataaatgaaattggagcgttttattacttgcgtggtgtgggctcttagtcacccccagctgcggagctgtgtgccggagactgtagatggagaaaggtactttgctagagctgagccccgggaacaggacaggtgactcactttcaagtccattcatttttttcccaccaaaataataactatgtttacttccaaggtatcttcgtagattcaaaactccaattattttttaaaacattagtccaaatgtaagttacatttgtgacaagcttaaaacaactatttgccactccagccttaaggagaccaactttaatttccggagtatgtgggaaaggaagtggctccctggtccccccaggaggccccccgagcaagcatcgtcatgttgggatgtgtgagttccctccaaagagcggccggatgggagtggggaggcagtggggagacgcggctccccgctacaggctatgaaagaaggtccgcgcccgtttggaagggggagcctggagacactaggtctgcggctttcaatgcgctgacttggggcagcctctctctttccgagttactaacacaaaaacacagttaatgtcgttaaaataccctctcctttagctccgccctcctgtcttcattattaatctcctgtggccaaaaataagccttcactcaccgttgcgtctcaggaatgagtgagtgttttctgaggtgtggacgcgtgcgtgatctgtgatgcacttcggcctctaacccaaatatccttccaaggctgggaattttttttccccatatgtgaaaaaaaaatctttccttttcaaaccatctgttctacctgtaaaaagaggctgttatttaggaaaggatgagggaactcttgcatttgaaatggactttagatttgctgttgggtaattttttaaaaaaagttactttctgagaggaaactcgtgtaaaaaagcaagacgtgaacctgcagggaattagactaacgagtgaagaaagccaatttcaaaaaattaggcgctgtatgattcctgtatctaaacataacatttctgaaataaaacaattttagaaatagaggaaagattagtgatgccagggctccggggtgcggctgtaaaatcgccacaggagtggccaggtgggggtggatacgggaaggtacacagatgattacattgtgtaaaactaatacatgcaaaggaagacgagtaaaacggcaaaactgaataagatcggtgactgtatcaaagtcaatatcctggttgtgagattggacttttttttttggcaaagttttgcaaagtggtaacactgggggaaactaggcaaagtgaatgatttcttacaactgcatgtgactccgcaattaaggaaaaaaaaaaagcaaagaaaagcagggcagctgatgcgcacgtcgagacccgtgagaagcgtgagaagctctgctcacccaggggagagcgcagtgacccgcagcgtctattcatccgtccgcagtcaccgggcgctggcagagagggcgcccggggggcgggtaagtgggcggggcctgggggcgggacgacctacggaagtgacgtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacaggtgagcggcccgggcggggcgctggggcggctggggcccgggctggggtcggggtcggggtgctctggtcccggggtcctgcctctctctcccgaactcacccccggagcagcttcgggggggaaaccaattgccggcgaggccgcggggctccgacaatgtccactcggcctgtccgggccggaggggcgcgggggctttggcgagcccgggctcgatcgcgcacgtcggggccgggtcaggcggctcctctggggctcctctggggctcctcgggggccgcgtctgcccggacgtcctaaggcgcccagtcgtgcttcctgacactccccgagtggccctggttttcggggtctccagctcgccttgcgcctcggacccgcgcccttgggaggcgcgtccggcccgcccgggacccaccggggcgctgcggtctgcgcagggcttagaaaaattgccatgtgggcctctgggctttgtgagtggagttagcctccgttcgacttacttagtaatttacgttggaacacaaattggtgtaagactgtaattatttcggtcggaagcttcggcttggctcgggcgaggcttcccgggcgcccggcgcttgcgcggtggagctccggggctcgggcctggcagtggggtccggcacggggcccggggtgttgatccgtccgcccagcgcttcctcgccgcacactctcgttttagctgacttaatttcgagaccgacccgctagggaagggccttgcattcaagttctgtggccgtgccatggggccctcctgcaccccagtttcccagtccaaaagtcagaatggaacctgcctgtacctacctagcaggagtgttcaaggtaacaaagacgaatgggaaggacgcagagccgcccgtgttaaattcggtgggtcggttgtcgtctgtgcataatttgagaggtagggagaatgttcttgaacagtacctctttgttgttgtagatttcactgtttacagttgattttgatggttcatatgtaaggctcaatttagcacgttttaattatttatcctttaatgaagcttaccttctacatggaagctatgcttgtattttacctagagattccttgaacacatacactcagaagcgacacctttttaaaataccatttagcctttgctgcctggcagacctggtttcgaatgctcggctgattgagtgatggggccgctaagccccagcttttctgcagaatcgttgtgatgccggtgtctggggtggcagtgcgtgctgcagccccataccgtgactgtgacgcctctgtggatgagaggcctgtcctctccctttgcattttcgtccttggctaggagactacacagcagagatagtggtggctttttgccgtaaccctcaaatccagtgtttcttggaaacaccagtagagtggtgacgagtgtcatcaaatcaccactagttcaaaggtgagatgctggcccaggctgtgcactttttctcccctgcctcagattctgggaacttctcaggccaggaggggtgctgtggttattttgatgaaatccaaaccactttgaataccagccagtggttaggttctgaaagggaaccctctccataggggcattcgttttatctcttggggatgtgtgtgagctttaatcatcagcgaaaattttcacaccactttcttatattggaagagcaaagtaaacaagcacctacctggactgactcaccagctcacatccttaggatcttctgttatttctagcgaccagtcccttatttcttgggtggcctggttggagggaggctttctccacttaaggtggatcacttaggatattgcatagcttggttgaaaagtgttttgtactttaactggaagcctttcctaccctgcccaaagcagacaggtggtggcatgtcaggtggctaggtcgaggtcagcatcgcctagcaggaagcatttcacctcctgtgctctgctgggcctggtagagtaggttggggctttgccatgtgcagcagtggctgatctttctgagaagttggtcaaaccctggctctttgtgaagctgattcctttaggttaattattgactgtattgagcctgaggttcttgttaggaatgtacatcagtcccactgtgctccaggagctggttgcattgcagtctcacaaggttgtacctaggccttgaagtagtcgctgtgccacttgccctgccacatttctcagtgcttttctgacgagctgcctcccaccccagcccctcatatttgcaagatgttccctgaattggggcataggattctcctagggtctttgtgtgcagcccccggccctgtaccccttctgcctaagtcttgcttctcttctcggagggacagcccctctcacccctgacacacgggtctgggcctcttccaggctgctgggggtcagtgatggtctagtccacttgttacataggagccaccacaggtacaggtgcaggtgaggctgattttcactggccaacgctgcttgcctctcaaggtggtctggggtctcctggctccctgcagctcccctgggccaggccttcagccggcccttggccacagcacctgctcggggcttgtttgatgagcaggctgcgccaggccatgtgagcttgcttttctgtgcaggaaaggttggggggccgcccagcccccagacacttagcgaggctcccagggacaggaagtgcctgccagggggccctcctgggagttcacaggtgacaccccattgatctgagattaccttcatcatggggctcggtgcctcggagggtcctgtggggtggctttggagaggcagctggcctccctggctgaccctcattgtgggggtcacagggcctagggtggggtgtagggatgggtgccgtgaccagtttggagagaataaagtgatcccaaaggccccgttcctcccctaccagcccccagctaaggggatgctcagaagaagccagtgcctgcggggcgccggctgggagacgctcctgccacattcagccctggctggtcggggcgagcctgagcaaaccccaggtttgtaacaacagagctgacgattggacaagcccgtttcttgtcagttttaaaaatagccgtgtgggaacccctccgaggctccctgggaacataattggattggtgtgcagaaggcctcgctgagaggcatcagctaacagatgatgaaacacattttccggctgcgttttcccgaaggtagttgctaggtttctccttcggagctctttgttacctgagcggtctcaccgtctcccccacctccctgcttctcacttttcccttcgtttattgcttctccgcttgcacaagaccatgtcccggggccgttctttccccctttccaggatgcgtgcttgcaggggaaaccgcagctggcctggtccacaggtctttggaatttctgagcctggagaagaaccttgggacttctttagaagttccttttagagatgattggtgtgatgatatttctcgtatttctcgctactccattggcctccctgggagggcgaaatacactttggctagccctaaatgaggagaaaaccgaattcatctaagtgctactcaccgtatctttaaaaagttgaaccccaagttaatcctaattaatgcccagagatttttcatgtggaacccaaaacaggacccaggacacttttgcgggggagggggggcttttcccgttcctgcgtggaagcagaattagcaacgctttcaccagcagcgaaggagaggggaataggatgccaccccctctgaactgtgcctaagcgtagctgcgcttggagcaaggcacagtttttaggttgtgttttaattaacaccgacgagaggggcttctggtcaacccagaaacgttgacttcactgtcaacagtaagaaatgcgatttggagacggtgcgaatgtgactgtgtgatgttctgtgctccctggccgccaccccagcacctaggctggattcggcatctctccacgtgttaaaataatgataatagtaataaatctacagttccttttgtgtggtcatcagaataagccagaatcattaaaataagccagaaacactgcttaggagaaaaaaatgtattaaaaaaaatagtgccattgctcaaaagcaattggtgggttctttctgtgcttcgagtacctgagcacttcttaacctccctgatcagaaaagcctcttcttgcagcttgttgcaaagaggccctttcaggcttattgaattgcaaatgccgccgggcgacacccgaccccagaagggctggagcttcctaaagccgctggagtttcccagatgtgcgcctagggagcacctggagaggggctggaaggcggggtcgtgtgggttttggcccagtggttactggatggtaaacagtgtggaaagtttctgaggacatgctggtgcttctgagcgaaatccaggctggtaggcaagggagccgccccacccccactcctgggcctcagatctcccacagggcggtcccgggacccccttcctcagctggaatcctgtctaccccaagccagtttggatcatgctgtcacaacacttttgtccacggaaacaatgactttttttttccaggacagctgattttcctcgagaaaatgccctcaaatgtgtggcccatggaagggggaagtcgtgccgggctcccttcaggcagttgcgcaaagctggggtggactccgttaggagattctagccgggatccgctttcaggagccaactagcagcagtggcccttttttgtttgtttgttgtttcttttaaagtaaggtaaatggggtctccgttctgcagaaagagcccggggcagggagagtaaagtacttgctgaactcggtgcgctggggaggggtgtgcactgctgccagcccgtagctgttagagtcgccaatgagctcactctgcaatcagaagtcaccggggttttatgtattaagccctttgggcaaataaaagaaaacactatttgtggagtggctcagagcttccacttaataagctactcagccttcctttgattgacattgttctcagaatacgtgtttattatcagtcagctttggcttagagagttcactctcagaatgtctacttaatgtggaaaaatgacccttgcgaatggctggcctctaaacacccgaattgtcatttcctcaaaaccctccggcgaggagggtgtgcctcacacggttgcacagtggatgtgggtctgagtcctacggaaggactttcgccagcgccccggggcagagtgtccggaggagggaggccacactggtaggggaggggcggcaagctggccacatttgagcaatcggaaacagacaaatcataactctgattcttaacaagacataaaagagaagcagcagctggtaccatgtcccagtccgatggtttggaagttagtggcagttgccgggttggaagttgtgctggtattcctttaaataacaaatgagggcctcagccaaccggtgttcccagaggaggagaaaggctgggagctgagaggtgtcattttccttctttggtgaccggtttcattttagctgatgcttgacgttggcatcaggtcctcgtcttccttttttcccaatgctcactgagactggggacagggttgagagtcccacgatctgatctgcaccccccatcccttgatgggtcccagagcctggcccaagcctgtggctgcagggagagggatttcccctggagagggaggaagcagccgatggtatgctggtgatggggcagctttcagctcagcccagggacccccacaggctagcactgcacactggtgggcatcttgttttccattagttggtcatttaaccagagcgctaggaaagcaggccgtgctcccctaagttttgtctcataataatttcacgttcattcctgatacttgcttcacttgttcccaaggccagtgggattctttgctccttgagtgtattcagacacactcgacctgcccaccccccacaccccccagctgctcctcctggggtgctcccgcgtccaccgtagagagctgcctagtgacccctggtgcagctccagagaggtcctgcaagcttctcccctccacatgcagtcaatggacccatcctgcagattcttccaacagagtgtgtgtgctctgctggcttcccctctctgctttgccaagcccaaggggatccacagcgactgctccgctctgctggcctcccgggtgcccctggactctgcgcaggtctcagccttcccgattctctcaggggccctttcctatgctgacttctgactttggatctctcttgattctccatagctccctggaccttcctttcaagaggcttagatttttcaaccacacttctcttttgggggtagttcgccatcttcttccttagagggtacacgtaaacaccatgaagacgggaaagggacctcttgtccttagttctgacatatggtggattcaagcgagcacttgccaatacacagaactgcttaaaatataggtcaggtgagtgctgggagtactgaagtggtgattctggacagtagtagtttattggctgaaaatgcactcacttgatttacatcggggttattcaacttggcaccgttggcatttggggctgagtaattcttagccttggggctgtcttatgcattgtaggatgttcagtagcatcctttagttgtgacaaccagaatctctccagacattgcccagtgtttcttggggggtgaagttgcctctaattgagaaccagtgggctatgtcctgagacgcagagccctagctgcagggcttgcattgttggggggcagacaggctgagatctccgagcctttggtacctgtccgatgtatgggaatttccacagcaagagctaaacagtaggatccaggggttcctgctggcctttcctgcagggaaagtgttttcactatggtaagggaagcctaggaggggctgaactctcgcaggggcggtcagatcattaagaaatggatgcgttctgttggcactgttttggattcaccagcaggcgaggaaatgggagccactgagtgatttcccagcacctgctcccgggtttgtcactgggaggagcaggcctgtgtccgagctccagaagagccccctgctgtggcagcggacactgggttataggcagggacttgggctggacgctggattctgggggaattgtctggaggccaccccagccagctgccttgcgtggcctgtgtgtggacatggagctgctgggtttcctgctataggaggtcggatctctcctagtgtggttctgaacatttcctttagggagcttattatattattagaaagcagattggctgggcacggtgactcatgcctgtaatcctagcactttgggagctgaggcaggcaaatcacttgagcctaggagttcaagaccaccctggcaaacagcaaaatcccatctttactaaaaatacaaaaaattagctgagtgtggcacacctgtaatcccagctaccctggaggctgaggcatgagactcacttgaacctgggaggtagaggttgcagtgagctaggatcatgccactgcactccagcctgggcaacagagcgagactctgtttcaaaaaagaaaaacaaacaaaaaaacagattttccagccccaacctggaatgcattctcaaggagtgaggcctgggaaccagcattccagccagcttcctgggtgctttctaccatgtctgtgtttggggctgctgatctcgatcctgcatggccagcgtgcgtccgtgggattcagcctcttactctgaacgcattctgagacttttgacccatgatgccaatacagaccattgcactgggattctagtctgtgaaaacacaggctgcaccagggaagtgaccttagaccagaggttggtcagctttctccacgaaggcctagagaggcaacattttaggctttgcaggccgcagggcctctgttgcaaggactcctctcccctttgaagtgcaaaagcagccacagccagtgtttaaatgaatgagtgagactttcttccagtaaaagtttatttatacaaacaaggtggtggcacgctgtgggcaaccatttggcagtttctcaaaatgtgacacatagactgtgaccaagcaattctgctcctaggtatgtatcgaaaagaattgaaagccacgactccaggcgtttgtcccccaatgtgtgcagatgtgcagcattatccacgagagccaaaaggtggaaatggcctgcacccacgaacagatgaacaaaacgcagtacattcgtgcagcagaatattattcagccatgaaaaggaagttttgatatatgttacagtgtgaatagaccctgaaaacatgcttaatgaaataagccagacacagaagggcaaattttatatgcttatgcttatatgaatttgcctagaatgtagaaaagaggttactgaggatggggatgagggaaggagttattggttaatgggtgcagaatttttgttgaggatgatggaaaagttttgggtgtagatagtggtgatggttgtaccacattgtgaatgtgggtaatgtcagggaattgtacacctgtgaatggctaaaataataaatactatgttatgtctatttgactacattttctctctctctctctctctctctctctctctctctatatatatatatatatatattttttttttttttttttttttttgttatggagtctctctgtgtcgcccaggctggagtgcaatggcgcgatctcggctcactgtaacctccgcctcccaggttcaagtgattctcctgtttcagcctcctgagtagctgggattacaggcaggcgccaccacgcccagctaatttttgtatttttcgtagagacagggtttcaccatgttgatcaggctggtctcgaactcctgaccttgtgatctgcctgtttcggcctcccaaagtgctgggattacaggcatgagccatcacacccggcctatattttttattttaaaaaatggctggttggatttggctgttggcaaccccatgctttggacctatgctgtttcattagtttgagtgtgaggttggattcaggaataactgggccaactcaggtattgggcttaaacggagaaggtgagttgggttccttgaacataactagttacaactttttttttttttttttgagatggagttttactttgttgcccaggctggagtgcagtggcatgatttcagctcactgcaacctctgcctccctggttcaagtgattttcctgcctcagcctcctgagtagctgggattataagcatctgccaccatgcccggctaatttttgtatttttagtagagacgggggttccactatgttggccaggctggtctcgaactcctgacctcaggtgatccatccgccttggcctgtcaaagtgctgggattacaggcatgagccaccgtgcccggcctagttgcctagttacaaccttgagtggaacgtcaacttctcttccctcctcccaggagaagggattatcggcctgcacctgcagtctctgagacccccaagccttggctcatggctgcctgtggaattattcacacacgtggaccccccacatgtgttatcagtgctacctgtaaaacgattagaatttccctcctcctcacttgtgataaccctgtgatgcataggtacatttcagcagcctcaggactgagactctggaaagccctgcattcgtgatgtgacattgaagtgtgccccatgtgtgtgcacttgaggcatttgctcagccctctggagctggtcgtcttctggccagggtgctgttccatgtttgtggctgagtgaccattgcgtattcttcatgcctttgaactttttcagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcctcggagccattgccatgggatctccggttccgcatcatccacgagacggcggtgggcatgaacttcctgcactgcatggccccgccactcctgcacctggacctcaagcccgcgaacatcctgctggatgcccactaccacgtcaaggtggggggccgcacggtgcccgagagagctgggcagggagggcctgtgtcttggggagcagggtatcaaggggtcaagccctgaggtcaggacaagggcagaagaggaggtggttcttcttggaggaaagagcttgaaaccgaggccttttgcagcatgaggactccaggagcctaagcttgtcctggttggtatgaaaaccacacgccatgtagctggagggtagcttggtgaacatgggggctgttcccccaaatcttggcatatgactcattccggaaaaagattacgggtttgtgggttttggtcttatgaaatcaggttagaattcagcccgtgggccaggtgtgtccttgcgagaccttaggctctgcaacaaagggacgcatttccctcagtgttttcaggagctcggggtggtgggaatgtgggggtcctctgcagtggggtcctcaaagtgctgtggaaagaggcttgtgaggaggggctcgttgcctctgtctgcccctgcgtagagtgcggagtggcagcgtgttgcgttagtgcaacgcctgggagatggagcttgcttttgcttcgctgataggtttttgaaacacagaaaagtaagagagataatgtaactgaaaaccagtgttgcctctgggccttggcaggtgttagcatcatcacctttgcatcagggctgtatttccttgtatctcctttgatggccttcgtggctagggttgtactgtcgttgacatgtggtggttacacctggcgcgttgtagtttttccccacgtggtgatgttcacatgctcttgggaggcccagggtgataggctggtccacatgacactggtgtctgccctgggagtgagaaggagccgagagccatggtccggatccatgtagttcatgcaggggacaagcagaggagtcccctgcctggcttggctgtgctactgttcctggtggcacagcacttccaggcctctctgatggcctgaccattaattaggagagacctgaattcagggcccggccctgcccctgagctcttgggtgggacgggagcggtggctcgtatggcatgcgcacggccgctccctgtgcccagactctgcggacgagtgcatctcgcgtgccttgctcagccagggcggtggtgaggaggtcaatttttcacttcgggcagtaattataagttgtctcttaggtaggtgttgcgcagtaataagatttcagctagaagatgaagcaccgtcctgcgaagtgaagtaggaaattgagataatggagacaaaaatcaaatgacttggcttgaacgggctctctggtggtttcccgcatctgcttatgttctgggacccctgggattcccgtttcctgtgatgggcagggctgggcctcacatgcggaccccccattcccgccaacatttacgggcttgtttctaggtagcacaggctctggggccctaatgactagtaagctctgccgtccaacgtgcactgaataccggaaaggacatgctagaggcttcacctgcgggagctgccctcatcctcagagcagaggtgcagagtggacggtggcctctggttctcgctgagtctctgcttagagtgagtaaattagcagccaggatcgtccagctgtaagtcacggagcagagaccttgatttccacctggcctgccactgtgcttgacatgaaagaaaccaaatgaccactgcacgtagcagtcacttgggggcagggtgtgtggcccgcaggctgggcctagaggcggccctgtgggagggggtgggagtgctcctggggctgggccttcacacagggtggggcttttctgccctcaggagtcggggcaggcagcagcagagcctttaggtgaaggaaacagcccaagagacgcagagagctctgggccttcctgcaggggcagcaggcagcagggcttccctgtctttcaggacagctgcagggggcggatgctgcctggaactgctttctcagggaggctgctgtcgaaggcacgctgggtgctggccaggaagtgacaggacatctctgtgtggtgcccctgggacatcttagggccctgtgtaccctgacaggccgcaggaaagattgcttttgtgtggcgtccttcttaatcaggcatgttagtcaccatcaagaagcccaaaaacaaaccgaaaaatacctttacgtgacatacttattttttctgtgaaatagctactggtgtgcgtagagggcagcagggagtgtgtgtcggggttctgagagtcagcgcctttgttcctgaagacgaagtgtggaagctttgcatggactgaccactgggcttctgggcagtcctcagtagacagttattcaatgcaggaaaactgtaatccagaatcctgcaattagatcctaagttgccattccagtgctgccattcgcctctgagatgggctccctcagtgctcagggctcgattcaaactggaaatatcacagcaactgtctacttcatgaagcagttaaatgtaaatagtatacaaagtaatagtatcaaattaatgcttgatattattcaacattacatatactaaataccaatattaagatactagttggaatcaatttcaacttaaaaatgaaataacttggtttaaaatctcaggctgcatttatatgtccagttagcccaaaacagacgcttttcaaagggtcacacgcgggtcacgttctgctgtgtctttcttttagaggcagcaaaaccccggcaggctgctttcttagtcttgacagctggaccttgaagttgaagggccatgtgcttgggggcagctgtgagccctcagctcttggagatgcagagtcgggtgctgatgagagtgtttgtaactcttgaagcatttgctggtcagagtggatgccacagtagctcgctgttgaggacacggggtgaggggcagcttgggtgggaagatgaggaaaggcggaggggaaatgcagccggccaggagtccgagacatggagggaggagaacatagagggtcagtgaccctcctagaattctcaattccgagcttgcattttgttgccagaggttttacagagaatttctgctcgttttcttttcaccaagtatagtttggagtggctggctctatctgacaaagacaggaggagaaaaggctgcaggcctggggaagcaccaggctgagatctctgcacccctgtcgtttttcttttcttttcttttctttcttaatgatctcagatgtcatttaattttcacaacaaagctacaggatgggtactgctattgcctccttttatgaaaaaaggaaacaggcacagagaggctaatagtccagggccacggagctactaacttgtacaggcaagattagaacagtgagtctgatccttaactaaccgtgggagggagatatttttttcctacattcaaccatacagggggaggaggaattgcctagaaagtatgtgatgctttctttatttttattattattttttattttacttttagttccgggatacatgtgcagaatgtgccagtttgttacataggtttatatgtgccatggtggtttgctgcacccatccaccatctaggttatcacctaggttttaagacccgcatgcattaggtgtttgtcctaatgctctcccttccctcttcccctacgcaccgacagggcccggcgtgtgatgttcccctccctctgtccatgtgttctcattgttcagcccatttctgaatttgaaggctttcaagccactgatgactgttgaactgaaacttcctgtgctctggagctatttggagagttaggacccgttgttgtgtcccagcgtccagcagccgccggggtttgcagggtcgggtgatggcgttcctctggggagctggcgctttccctggagtgcagagtgtggctctcaagggcggtgcaggcctgaaggccctgggagaaatggaagtgggaggacatgagagccgctggagtcgaggccttgtcctggtgctcctggctgcagagaaggagggccggtccctgctcgcaggccttcccccctacctccctgcagatgtgctcaggatccctggaagcccgagtcacaggtcataaattctcccagctgtttggtgctgatgacagcagccctattggctcaccacatgggcatggccagcccagaattaaggcctgactcagcctcatttcctgtcactccatgggtgtgtttgagaggagctcaagagttaatgaaaagggtttttaaaaaaatccatatgccttgaaggaaagttgagagcagcactccccctggatcaagagtcccattaatgctgatgacttgtgtcttcatcccacatacggttttcagcagcttcaaaggggactgagttacactggagagggtaggacactggcaggaaaggggatgcccccgagagaggtcagaccgggggtctgtgaagtctccccagtgagctccaaggtcacctttgcccgaaggagacctgagacctgcctcccctgaatgcggacgttgagggcattcctggaggagctgggtggccggtgctccttggggcccgggcgctgccagcagaggtgtttatcagaccttcactcgaacacatgtgtttgaagcagccagccagtgtctgctgatcacaaaacactccagatggacggggctctgaggcgtgtgttttgtttgctttaaagtttaaagggcttctgaaggtgtgtttctgtgtttccctttaaaggacttgcagccacttgcccgccagcctccccagctggcaggttgcataacctgctccccgacttctctaggagcagacctggtcttcacatgtgtctctctttacctgaaccctcgaaggcttgtttttttccctttatgccggctcagccggctctcaaccaccatggcaaacatgatgctttacagaaggtggattctaattcttctgcagttctgtcccggataactccttccttacagtacgattctttcacctgcccgtcaaatgtgctgctcctaatgcctccaggcttgcttctgccccagaatctgtctccctccctgcctggggcagggctacctggagaggcacagacacggctcttaggggctcctggaaagctctcacccaccctctgagattgcagaagggagcttttgataaagcatcataaaatatcactgttgcaggctaatgagccccgctctgatggctgtgttgcagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacaggtgtgtgacatgccgccccccatcccctgtgggtgccaggggctctcaacctcaatgcttcatgccctgagctgcagctttcagaaaggcctcttgctgccagtcagaaatggggctcgggccaggcgcggtgactcacgcctgtaatcccagcactgcgggaggccgaggcaggaggattacttgagcccaggagtttgagaccagcctgggcaacatggtgaaacctcatctctacaaaaaatacaaaaattagcccagcttggtggcgtgcacctgtagtcccagctactcgggactgaggttgggggattgcttgagcccgggaggtggagattgcagtaagtcatgattgcaccactgcattccagcctgggcaacagagcgcgaccctgtctaaaaaacaaacaaacagaaagggggctaagtccacatagaaggggtgggtgcttgtagagttcagggatttctttgctgtgagtgttgctagccaaggaggaagggtgttcccaggtccacatttgggccaggctgacagccctgccctgtcagagccttggtgatttcatgacccgtgggctttatggcttgtctgttggaagaacctgctgctttcagtggtctgtacgcatgtgtgtttgtactttccgaaattcactctgattttgtgaggcgagcagctcatcttcttcatggcacttaacctttgttggtcagagatcaatccccaagtcacctagtcccttcctttttcaaattgtaaaggtcttaatcacacagacttcttggagaagaaaagtgggtgggagcgtgtgagcaggcactaagcctcccattgtggctgttatccagcagcactgtgactcggaccccgcatgtgagctctgccttttggtcactgccgccgccagcagcccaggctgactggtttgacagtggccattgtgcatgtgcttagctggggctttaagctgagagttgcctggaagtgtcactttggagactagtcacagcttgtagagtttggggagattgagatcctctccatttattttagagtttggagttccagcttttgaacctgccgtttgaactaattttcgatggtgaattcgttgtctataaacagccctcaccaactcagtgctccttggaggctcagttttcggacttctgtttttcttttcttttttttttttttttttttaatcaatttgggcactttttttggtgtatccagagtaatgtacatgaacgtatccctcatattatctatatatttctaagcagcccccgaaaaaggctttggggcgttcagctgtgttgtctcctacgttttctgcgcactttctttaacaaccctctaatgatgaactctcagtgagcctctgttaggaacgctgaaatctcagcaagcctacgttaggaacgctgatcagaaccagaatccgtgttttcagagaatgaaatcattgttgggggagggcatgggagttgcccatcattcattcatccatttcttcagtaaatgcctgcgcaggtgctctgtgcctggtgcttgcgagaagatatcagtgaggcacacaggcgctgttccccaggagctcacgccccgcatagggtggcaccctctttggaagtccctcaagctgcctgaagattgtagcccagttggcgaagttacttgagtctgtctgacatctgagctatcaacatgctgggcttcactatagagaattttctctttttaaaaacaggagaaatatctcggtgtcatggctctgtctttggaaggcttcagaacaggtgtcttcacgcctgttgctgtgcatgagtgcatttggctttgagtctctggctgtcagatgctaacgtgcctggtttctcttccagctttgcgatcgtcatctggggcgtgctcacacagaagaagccgtttgcaggtgagtggacctgtctttgaggtgtaatgtgcttgtctttcctggaataatggggggacaccttgttgtcctttctctatcctaaaacagagcctgtgatccacgctgccataggtgctgctctgtggtgtaatttgcatgcaggaaaagacacagatctgaaggggcctgttcaatggaatgtttttaggtgccagctagtttttttgtggtagtaaaatatatataacataaaattggtcatgttagccatttaaagtgtataattcagtgacattaactacactggcagtgttgaacaagcgttaccactgtctaattccagaacattctcatcatgctagaaggcaaagcccatggccattctgcagtccctcgcccttcctcctgctcaagccccagcaaccactcacctgctttctgtctccaggggtttgcctgtgctggtatttccagctaattcttttttgtttactttttaaaaaaatagtcataaaatacacagaacaaaacttagcatgtcagccgtgtgaagcatacagttcaggagcattacatgtacccgcgtgcttgcgcagccaacctccagagctgctcagtgccatggagttgcttgcaggagtggcacccctgcccagcttgagagctgtggtgtttgcttccccagccaggcagccaccattccgaacaccatcctcaaagttgtcacaccttgacttacttatcataaaaatccaggactttttagctttgttggacagattcccttttcctctaaagacatttctgggctactcatgatattttgtggtgtgaccgaaaatgtctaaaaatgaagatgagagtcaaggcctagccccttgttagtcggggctcagactaggagccgatgtatgggaaagtgctggggtgagaagagatcttccagcatcgcaagatcaagtatcttggcagctttaaaagaatgtcagtagaaagcacagaacgcgtcctgccaggcctctgctggccggtgtccgtctgtgttgtctgaccgcctgtcgcctttcttgccttctgtacgttctcccgcacagtggcctacagcccgaaggcttgtgaaatgaggcagtgtctgatagatgtgacacccgaagctaggcgcaggggacaggtcaaggctcaagcccttgtgctttattgctgaatatgcctagtgttcccttattggaacgctaatcatatgggaattattcgtgtcctactgttcaaggtcatcgccaaggtctgatttttcaaattcaaaaaattgcaacctcaggcaaaaatgggtaggagggggttcaaggtgcaggagaacaaggcctctccccagcttttccagtctgtgcttggcagcaggaaacattccgggcgtttacttcagtttgcttccattttatttagaggagctgttggttttgaagtctgaataatcatggaaatagcctgctaaacacttaacgatatttattgcacaagatttaatgggaaagtggagcaaaacattgtatggaatcctggcagccgtgggtgattctcggctgattttccacacctgctgaggcacatggcctctccaaagagctgccattccatgcgtgggtgtgtttggatctggagggcagagagggctgttgggaacaagaaccttgagggttccaggctaagcagaaaaaagaacttggcccactggatgtcaccctgggcccttcccagtcagggtagaagttgtggcaataataataataagctagagcccatgcatgctagtgaaggcagttggaaaggacaggtgcggccccacatggtgaattgaggggaaagagcccttccacacatcccagccctggtgcaccggcaggggaggccagctggggacctgagcttgggattggagttggaactgaggaagacttcttcgccattgtagagagagttgggtctctgtggatgtaggacgctgtggctcctccatggtgcgtgagcctcattccctttgctggcttgggctgttgatggaatgagcctcataagatattgttctcctttgaacctcatcttcctttggatgggatgcctagaaagatctgctctgtgaccaaacacactgactccttctggtagatcagaacccagggaaagaggtcgatttcaaaaccaggaaactagagagcatggcgcaccatgagggtgagggttacaggaagctctgcctttgaaacggagtgggggagccgtctccctggggtggtgtggggatggccccattgtggcccccggcgagtgtgtcgtttcctcccaagggtgagatgctgccacccagccctgcagagcccctgactcgcatccttcccttggcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaaggtgagcaccccggggtctccccgccacattctgtgggtgtcacaggagacagaggtgacagacaggacagggtgagggaccaggcctgggtgagaaacaaggcgtgtaacaggtgggccgaaatgagccctgcacagataggttggacccagcacctgcctgcggcctctggtactcacggctcggccacggcagctggaactgagttgcctccaaccatccgccccctgctccccaccagggttgggcttgccacccagaggagtctgtatgggagcctgaagttcaggtgcagccatgctcttcccggggacttacctggccggtggccggcggcgtcgcccttctcttgaggagttgacttcctgggacagatgtgtctctggcataggaaagtcaccctgatgagatggaaactgctgcatttaaagcttacggcaggaaacgggctgaatggggagctcatccgccaggtgctggcagctctgctccctgtgactggcaggtggcgctcccccggggaaggcttccgccttgagtctggtgaggccttcaaatgattaccgatgggggggcctgggtttggccagcaaattgtccatgtagggcccctgggcttgcctggtgagctcaggctgggccgaggcgtgtgagaaatcccccagctcgtgggggccctgcgtttatatggaacgcgtgtgtacgcagaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtaacgagtccttcccacaggggtcttttgtctcctcggcttccaggcaggagtttccaaaccactcctctttgcagagtcccccgccgcccggaccactctccctctcttctgagcccatcccgcacccaactccattagaagtgtaggtcccatgggggctcaggtccacctgcccgactgcatccccgccccacctcctgtctgattctgcgtgagtggcggaagggcttccctgacactaaatagccactcattggatgtgtgtggaccacggggatcagaaggcccagccccggccggggagggagagctggtgtctgagtgtctttgcacccctggctcggggatccagttcctttatagctgcccataaatggtctgcactctgatgagtgccacccaggtgatttcagatgtgataagaagctccaagtagcagggctggctaaatgccttttcgggtgatgaggctggagcagacctgtgaggcccagctgataagtgagctttataacgtgttatctggtgttgggcgattaatcccaggctgttggtgtgagctcaggagatcaggaaatatgtatatcaggaatatgcgcccactgcctcaacataaagtgcatgtgtgccagtgagcccgggagcaaaggtgcccgggggttgctagtacagaggcagacctgggccctgataagggaaagaaggcaaccaacatgtaggggtggctcggtacacccagcaacagtgcgggacctcgagccgtcccacaaagggtggggagttggggcaaacaggtgtgcctaagggaagaagcgtgaaatcccgtcagattccacttacccaccagaaacctgctgcccctgcagtccatgaagcgagactctttaaaaggccccatcggtgtatgtcggattggatcacccctcgtccctgtagccgggtccttcccctttccctcgtccccacacagcccccaggccagccccacgtggctccgcggggaggtcgcagttgtggccacgtgtgggggtcctgcccagttcctgtctgtcctctcgtttcctgccaacgctggcctgtgctgggcagctgtgtcccgccatacatgcctcacattctgcagcttgacaccgcctgccttttgtctgggtgacgctctgtgcagtgttactgagcagatggtatccagagctgcatgaggctggattttgcacttttatgaaggctatctttccttaagatgtctccgtgctgggtggggccagcgcaagtctttgtagctccaagtctttgagctccctggcgctgtgcgggtgcagagtctgagcatcccaagtgctgtgcgggtgcagggtctgagctgcccggcactgtgcgggcgcggggtctgagctccgcggcgctgtgtggacatggcgtctgagctccctagtgctgtgccgatgcggggtctgagctcggtgaccaataggttatctgcattgcttccagggtccgtcctttcctcccccatctccctcccgtggcccaccttgctcttctgtgtttgtgtcatgggcgggccatgcgggctatggcagggtcttcacccaccccctcttctgcatcttcgcaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcggtgagtggggacgcctctgtgtcccgagagatgctgggcttggcgggacagtggactggactcagtgagaagctaaacggaatcaaggggacagtttcttgacccagcaagaattcttctttgtgttctctctgtcttaagtaattaattttgtgtgttgggcatttggctccgtcttatgtcacttagcatgtgtggggaacaggccacatcaccagtctgtgcagcagtcttgcctgtgccagtgccatgggtggaggctgacctcaggtctacagattggaaaccccctccagtgcagtgagcctggcgagtagccgagccccactccctggcgggcctcctgtctcgggcgtggcagtcccgcaccctctgctcagacgctgctgggtacacacccacgccttcgcatatgtgggctccccgttcacggtagtccaggcctagtaatgtgttggttatccttggaggttttaccaccaggccacctttgcaaaccacctgatagggaggagcacttctcttttagctaatctcatctttttatgttaattttgatggcttttgtttctggaaggtgctttttttcctatccctgccccagggtgctggacctggtgcttgttctggcctcctttctgccggctgcaggggtaagatgtggtcctgccctgttcctgaaggggctgcagctctgatggaaaatacagggatttacactcagggctacagccacgggggctgagggccaaggctgcaatctcgggggaaggggaagttggcttttcctggtggattggaaacatcctcttggaggcaaagacttttcctggatcttacagacttcccgggatttttagattagaatattgggggcaaaggagggtgtcttgttttaaggcaatgctacatagacacagtggggaagacctggttcgacggcagataagcagtgggtgatgggcttgaggaggagagtcagggcaaagtctaagactgagcagaaagaaataccaccatctcccatggataagtacgttctagaacattctctttgggtctaatactctgaaatgacatcttgtcttcatgctcgagagagaattacttcactggctccacttggagtgccagtgttcagacaccaagcctgactgggagggttccgttttcttaacaccttcccaccgccgacttccaagtccccacgcgtttcacatgagggcggaggagagtctcgttgcagggtttcagcattccaggcactacggtaggatttttgtggtaaatacaacttttcatcctgagtgctggactaacgtcctcctgaaacgagaagctcggtcccttcaggattatcatagaaaacttccgacttaacctccccaggtcaggaggtgccacttcgaggtggggcaagagctggagcagccccttccagctctagtcaccatctctgcaggctgctaggcctggggcgtccgtgggtggcaggtgccaaggcttccaggcgaatgggagctctggcctggtctttttagtctgtgccctttttccttctttctttaatgaagggatgtttgcagtcactgccatctctaagcaccaagggggctcaccaccccgcaggatagggagagcgggttttattttgcaaaccgactaacgagcacctgggagacatttgccagcctgccccggggctcccgctaggactgaccttaatcacgaggcacagacaacgctcaaacacagtcgggtgaccagcgagcagcctggaggccatggcactcctccacctgagcgccacagccaggctcccagagacgccacgtccctggatgtgcagccacgctctgacctttgcctctcctctccctgcagatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctggttgagactgctttttcttatcaacgagctcgagtaatctggtttctgaaaaccaaaggcttgaggcagtgacggaagcttgcagatggccttctggaagggcccctgtgtcctcaattaacccaggccgcgggaccccgagaaagcagagggtggagccgggcgtcgtcctctgcctgggtccctccgcacacgggtgatcaggtgggggagagaagtgtgtcttgatggaagctcccaacactgaagtttttattgaaatgttatagttcttacgttctgtattttgaaataatttcagattacagaaaagtgacaggagtagtacatagaactctggtaacccttcagctagattccctgtttgcttatatttgattgtatttgcctttctcatccacctacctacctgttcgagagtaggttgcagacagtgtgccctgttactcctaaatacttgcctgtacatttcctaaaaacaagagtttctcctgcatcacccacaatttacccatcacattcaggaaattaacattggtaggatattaccatcaaatctgcaaattctcttcaaattttgctgattgtctcaaaactgtcctttatagaagaagaaagttgaaaaacacgcaagcagcacctcttttttttttcactctctggcctgggaccccatggtgttcaatagccatgtggcttccgtttttatcaatcgtcagttcctcagtcttctcttttctgactttgaattaacttatgacatggagctccttcatgggttcattcagaccttttgggaagtatggccagttatttggtggaatgtcctcagtttaggtttatctaattttcctcaagatatggtttaggttacgcatttttggcagaaataccaccgacatgatactgtgtaccaaggagggctttttcccctcccacttttgtttatttacatcaatatgcagtcttggatccctgtttaattgatgggatattctgattattttgatggtcaggttagccctgatttggccggtttgggcacctctacgcaggctcctgtgccccctcacctcccatctttctctgagtgattccttgctttctgacacagttccaggcccaccttgtacttatttccccagccttggaagaagccatttctccaaggaaaccgtttctctgagtggagaatggttcttagacgccaagatgtgggtgctggaggtgctcattgttactgggctgtcattgcttctaggccctcagcagacagacgtaggaagctgcatgcaacctatgtgaatatcacatacacgtttctgtgtcttactagaaactatgatttcacatccatgccttcggttacagcccagcatcccaggggtcactcttgctggtctgtatttgtatctcctttctgtggctgtgggagccattcccatcatcctcaacacacacacgaggtcaatcttggtgtgtgatgatctccctgacaacactggtggccttcttggctgcgccgtgcctagtgaccctgtcagtgggtctccctggccctgcagaatggtgactcacccttaaagatttttatgctaggtagcaatgcctaggaactgtttcttactaagactatcatttagcttaacttattttttttcatttaggaacctacattatttccttgcctgtcttgaaatagtgataatttaacaagcctcccatttttcttcttaatttctcagaaaattcaggcattttccttcccctctgatctctattctgtgttttttcgttcaggagcatcttctggtttgaggattgaatgcatttttatatcctccactttaggaaaagtctgcccctttgttcctgggaggaaacaaaagtgggtcttatgcttcacatgctctgcagttgttctggggccaagggtcttttagtacacccctggctattccctccagaaccccagccctgagcaatgtcagagaga

SEQ ID NO: 16948 - DNA, 28030 bp, Human; identical to SEQ ID NO: 12305

SEQ ID NO: 16949 - DNA, 33272 bp, Human
gtaagaaaagccctttaagtagtcaaaataaattttttttttctttttccttttgctagctgtttttctccccccaccacatcaccttttgtgtgtgtgtgtgtggtggggaggggttgaaacttagccacttcagaggcctcacttctcataatttggaactttcctttggtttcgatcaagtcagatagagttcgtcaaactcaatgcgaaaaagacaaaagaacaaaaaacagaaacaacaacaaaaaaaccagttaagcgaaacgaaggattgggcaatttataaggttactgagcacactaatggtaaggagaaattaagaccagctggttgttaatcttaatagccaagacaaaccccaattcagttacttcctagggatgggtctgaggctgaagattgctctctaccaccctagaagcagaggaagaaaacccctcatctttcctgtgggaagcgagctcaaactccataaacgagttacctgccttccattgtcatggaagcaggaaaaaactactacttccttatgttggaagagagtaaagcacaccccgccccccaacccccgcccaacacacaaaaggagttgtacagcaaaataaactagatcttgactaaatctgggtagatcagggattctctggagggggtgcttccaggcctcagcaaattgtcctattggtttgagccataaagatagctcaagctggtactaaggactgacagatttgtcaaaggtcagtggcacctctactcagaatccctttgtggttaccaaaatgtgaaccttgaatatctgagtcagatctcagtcaacttaggaagtttattttgctgaatttaaggatgcacgcccatgacacggccgtcggaggccctgatgacatgtgcccaaggtggtcagagcacagtttggttttatacgttttagggagacatgagacatcaatcaatatatgtaagatgaacattggtttggtccggaagggcgggacaactcaaagcaaaggcaggagggagcttccaggtcataggtaaatatgagacaaatcattgcattcccttgagtttctggttagcctctccagaggtggcaatcagatacgcatttatctcagtgagctgagagatgactttgaacagaatgggaggcaggtttgccctaagcagttcccaacttgacttttccttttaagcttaatgattttgcggcccccaaatttattttccttccacatttttttttttaaatcagacttaaggtctgccttgatgttaatgctggaggagtgtaaaaaggcatgtccaactcttacttcccttcgaggccagaatagtctctcaggttgaacttcagggtcccctggtaaaggagggagtccagtcagacggctgcgggggagggggggcttcgaattttatgttttacaggcattagcgccacccatttctccttaaccccaaacttcctctccccacaacagaaacgtcatcattctgcttccacttatccagaagaaaggcagagggcgcacactgcgcagcgcggatgggaaagttaactgaattatttgcgggaagacagaggaggtggggggtcccccaagccccagccattttgtggctcgtaggggttgtcgcttcccaagccgtgaatggcccaaacccgccccccgccccaggtcggactcctgccccgcgcccctctgggtcggaccccaagccgagccccccaaccccgcggctgggctgggcgattggggacgagctccacacatggagaacctggcctcgcctcgcaagaccgcgggacgcgcagatgtgaagtgcgcctgcgcggggcgcagccccagctgcagacgatctgtgagcgacgcgccggcgcaagtcgagggcggtggcttggcttccctggaatgggggacgtcttaggactgcgcctgcgcggggcgccgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgaggtaggtgtcctgatgggcagctcagatggctggactgcacgtaaggaaggacaggccaggtgaggcgtcctcgcactgcgtgtgcgtcgctggcggacagaggcctccgcccccttttgggacctccgagcgccttcgcgatctcagccactttccctggcgtccaaacgggagctcggtccccgtcacacccttccctgcgtgccgcaccccttcccggccactcccgccgtccagcgccttctacggccacgcccaccccaccaccatctctgtcacgcccttcgcggccacgcccacctgcctggcggcccctgccccgaagctcgcggcgctgtcccagcctgaccctctcgtgcccctgcgtccacgcgtggccctctcgcttcctgcccccttctcaccccccttcactggccacctgttccaaccctccatgatcctgttcctcccgagggcatcttaggagggcagggtcctgcgcgcactgcggcctccactccgaccccgtcccagtttggacccaggtcttccaatgaaaatataattatgcaaatcagtaagcatttgtaactacgaatatcacaaaaataagcttcaagtctggatttagaagtgaagcatgcattttaaacaaagaattgctatgcaattttaaaaacacattgatcccagagcagtgtgtggattacactatcactggaaaaatacgaattgagaagaaggaaaagactggaagatgcagaccttggttcctgttagtggaaacactgtaaggtcccaggtagggacttttaattggaattaaagctatcacacttctaagaaattaatgaatactgatttattgccttaagtcgacacctgatctaacagaaactaacaggcttcagcaaatgaacaagattaacaccttgcagactagtgaagaaaacacactatttgaagtttatgatttttaaatgcttttgtctctgtaaagtattgtaaattttcatttctacactaatcttcacacatacacattttacttctatttggtagaggacatcatgcacattagaagttaagtgaactcaattattaagcaatgtaacaagtactttgtgtctccttctctttttaaaagtagaaatggaaaagaaaatgaaataaatcagcagttatgaggcagagcctaagagaactatggcaacatcaggtgactgtcccagaagtgaatcgcaggtaatttccgttccacttcctaaaaatctgtgtttaatgaatgtgagcattacagagagctaagcgtcagctcacagatgtgatggagcttggcttgtgccttggaaggtggccaccggcagtagaatgcttaaatgtgaagattgtgaggcagaggaaacgcagtgcctgtaaggtgacatcctgcattgggcaccataacaattctaaggaaatacttagccccaaaacatcagcatcatttagggttccatttttggtacgtgaactggcaaagcaagcatattttctgagctgttcaataaaatttcaggcataataccagcaatatattgaaggcaagttggacacattagaaaagatttatgtattcatactgtttctgcctggggtactcatgtagtttcgttcaagttagcagtaaaaaatacccctcaaattgtaaagactgttgattatgtaaaagtcaccaactgaataatagatactgtttttaaaaatcaagcatttccgtatctgttatgtcaattttaatgttttctttttttctctttcattccaatgagctttcatttggctttttatatataggaattttatttatagtcagaatctttcgttaatttctttaattattcataaaatgttttaattccgtggacatcttatttttcttttgagaaatttaacaaatattaggacatttccagaatgatattgtaaacatcaagtacattaaacagtgtacattaagctatatatatgtgtgtgtatatacatatatgtgtgtgtgtgtgtgtatatatatatgtatatgtaaaaaatactgtcgggtgtgtctgtagttcagctactcaggaggctgaagcaggagaatcacttggggccgggagtttgaggatgtggtgtattatgattgtgcctgtgaatagccactgcattccagcacggccaataaactgagacttcatctcttaaaaaagaaaaagcgacactctagataaagtttgttccccagtctcagtcctattcctcctcttctctctctagaggcaaacactactgtgaatcatgagtctgttttgtgccactgcaccatttttatacctctatggcttatatagatatacttgaatgacatatgatattgtttgtgtgggctttttagagtttccatagtggtgtcatactgtcagtgtcacctgtagcttgcctcttcatataactttacctttggggaagttgtccttgttatgtgtgtaatgctggttcaatcctgccactgtagggtactcctgtagtgtgttccttctctgaaagtgtaaagtatcctatttgtagatatgtgtatgggcctgttgcagtctcactgctacacagtaggcatataccccattttacttattccctttttgttggacacttaaattgtttctagttttttctatttcaaacaatgctgtagtgaccatccgtctccatgcctctgtgctccagtaatggcattgcagggtgcaagggattgcaagtttcagttttactggataatgatcagttgttccccacaatgactttacgagttcacaggtctgtcagtagcccacaatagtgcttactaacacttgacagtatcagacttttaagttttggtcagtctcatgggttagaaatggtattttgttatttcaattttgctgactggtcatggtagtatttcagtaatacttgtgttcatcctgttaataccaccctccattatagaagagatgtcttataatggtaatttgtgttttatctctttttttcacacttgatcaatcttttcttagggttttatcaattttatttttataaagaaccaattttatctgtgttgatttctctgtttttctatttcattgatttctgcttttgtctttatttcattctgttgtatttgggttaatttttataacatctgagagggaagcttagataattgattttaaacctttctttaatagtctttaaagctatgactttcctctaatcactgctgtagctgtacctcacatatttaaatgcattttcattcttcaaaatattttctaatatattcaatggaaattagaagttttctgggctatttgaaagtatgttgaccaatttctaaacatattggaaattttactttttcttatttaattttgctttgattacattggttagagaacataacatcctctataatttcagtcttttgaaatttattcaggcttgctttatgttctaatcatatggaatatgttggtgagtgttccatgagtacttgcaaagactatgtattctgcagttgttgagtgtagcattctataaatgtcatgaagatcaaatgtgttattagtattgttgaaatctctatatcttttctgattttttttgccatcttctatcagttactaaaaattctccactatgattgtagatatatctatttttccttttggttctatcactttttgctttgtatattttgagtccctgttattgggtgtatatatttagtataggttttgttttctagattaattgaccttattttttataaaacatctgtctttttacctgttaataaatacttcttttcttgcgtgtaccttttttttaatgctaatatagctgtaccagctttttttttttatcattagtgcttacataaagtgtgtgtgtgtgtgtgtttgtgtgtgtgtgtgtgtgtattttttttccctcaacttaagtccttatatttaaagcgtttttctcgtaaagagctagttgggtctagctcttaggtctgtttttttgtttctctgttaaacacaatttctgcctcttaattggagtatttagtctattaacacttcatgttatgacgaatgtgatgaagtgtaacattttgctgtttgttttatgtttgtcacatttctttttcctgcatgtctccattcctgccctcttgtggataaataaaggattttctataattccatattacctcctttaatagcttgttagctgtatctttttatattgttttagtgttttcccaagaaattgcagtatgcatcctaattcaatttcagtcttttttttaactacttcataaggtaaagatcttagaagttagtttcatttaccagcgtccatatttttgtactgttgatgtaacattttaattttacatatgttgtaaacgccacaataaattatcattattgctttacgctatcgagtctttttttatgaagtaaaataaatagtcttttttatgtttccccacatattatttgccttttttgaggtctttccctttttcttgcattctgtgttttcatgtaggatcatttcccttcaacctgacaactttatgtttatatttactagtgtgagtctgctgtgtcaaactatgaaatgtgttttgcctacatttttttttttttttttttttgagacggagtctcgctctgtcgcccaggctggagtgcagtgatgcgatctcggctcactgcaagctccgcctcctgggttcacaccattctcctgcctcagcctcccgagtagctgggactacaggtgaccaccaccacgcccggctaattttttgtatttttagtagagacggggtttcaccatcttggccaggctggtctcaaacttctgatctcaggtgatctgcccaccttggccttgatggttttttttttttaattttggaaaaatctccaccattatctcttcatttatttttttctgcctcatcttctgtcttcttttttggggtctccatgtaaacataagttagaatttttgctgctgtttgacatgtctcatgctctattcttattttttttttcattttgtgcttcagtttggaaaatttctgttgacctgactcttgaggcgctgatcataaacaagataactgggaaaacaatatgtttgtaaaacaatttcttgagatgtgaaatagtatctatattgtaccaagagtagtcccagctacttgagaggctgaggtaggaggattgctttagcttgggaggtggaggttgccatgagccaggatcatgccactgcactctagcctgggtgacagagggtgacctcatctcaaaaaaaaaaaaaaaaagcgtattcttcaaccctggcattctatcctgcagaaataaaatgtcatcacataagcttgtctgtgcacagacttcttttattgcagcatcggttatggtggtagaaaactggataccaagacaaagtctatcaaagggggatggctgaagaatcaagcggaattcctgctatggaatatcgtatagccattgaaggtagtaaatcagggttctaacagttggagagtttttccagaaggtattgtgtaagaaaagcaaagtgcaggtcaggcgtggtggcccacgcctgtgatgccagcactttgggaagctcaggtgggcagatcacttgaagtggggagttcgagaccagcctggccaacatgatgaaaccccatccatttctaccaaaaatgcaaaaattagccgggcgtagtgacacacgcctgtagtcccagcctctcgggaggctgaggcatgcgaattgcttgaactggggaggtggaggttgcagtgagccgagattgtgccactgcactccagcctaggcgacagagcgagactccatcctaaaaaaaaagccaaacaaagaaacagcctgtgtgtgtgtgtgtgtgtgtgtgtgtgtatacgtgtacacagggctttgtgtgtgacatgggcatggtggaggtgtggaaggccgcacaccggggggttagtaagggttgcctgggctgggtggatcggggatggggtggagagcaagcagagggcagtgctgccttagagtgagtcatgctcctggcatagggaaaagcacgaagggtacaaatagacagtaaggtaaaaaaagatgccagcaagtattttaaaaacgcctaaccacacaaagagagggaaatggaagtaacaacagtgatttttacccatgaaattgacagagactaaagtgattggtatctattgagtgagagtgtgggaagattggtggttccctctcagcaagcggtccagggaacacctttctggagagcactgggtggtaaaaccaaaagccacatagtctcagtccatcaggttcacattcagagacttaccctaagaagattaaggtacatacagaatgatttatgttgaaagaagttcatcttaacatgatttagaatagtaaaaactgaaaagtctaaatgtacaagactaggaaactggataggtaagtcctgataattcatagactggatattaaatagtgttagaagtatatttaataagaaaaatgttcagagtttataaagtgaaaaccataggccacaggcttattgtgtgaacccagtgaatgctttgtacttatgttacgtgtccacttttttaaaagtctgaaagtataaacaccaatgtgctgtctgttattatctgtgatcagtgagcaaaattacaggaggttttaattttcttctgtgtacttggtgttttcacacattttctaaagtaaacacgaattacttttatgtttaggaaaatgtgtttaaaatgtatgtattgagacaaggttgattcattgaactggagtgtgtgatctgaggttctgccccctgcagtgatgtcttccaggcaagcttattcttatataaagtgaacggccaggcatggtggctcatgcctgtagtcctagcactttgggaggatgaggcaggtggattgcctgagctgaggatttcgaggccaacctgggcaacatggtgaaaccccatctctactaaaaatacaaaaaattagctgggtgtagtggtgcacacctgttgtcccagctacttgggaggctgaggcatcagaatcacttgaacctgggaggcggcagaggttgccctgagccgagatcatgccattgccctccagcctgggcaacagagcaagactctgtctcaaaaaaaatggaggggttgggggaggctccaaggacctgtgtgggtccaagctgggctctgctgcctcgtggaggtttgtgccatgccatcagctctttccacaggcccctggctgtgcctgcctggggcgctgggcccctggctctgtcctcacactggtttctcttcatggggttgatgatcaccttcaggaagcaaagctgatgaaggacaagggctcctcaccaaatagacactagtggtgcctgtttctgacttcttgctttgatgttctcttttagggtccagataatttttttttttagaaaagaaatgtagagtgaaggtgacagcctttgattatagtagtaaagatgatccaaatagtttgtataataaatacttggacacatgaatctgtatttgaaatttgaaaccatcctaataatatagccaaaaaaaaaaaaaaaaagctccagcgtcctctcctcacgctttccttggctttgagcagggagaagagcctgctgagtgcagtgaggcgggtctcctgcaggagggagtacagccagaggagtttgtggccatcgcggactacgctgccaccgatgagacccaggtagccacacgtggtggttaatgctttatggctttcagcatgttcagtgtcaaaaggagataaattttgcagacgtcacaccaaagttaaatgaagaggtattcagatgcgtagggccacacaagacctgtgtgtgaagctcacagcccagccagttctgcctcaagcatgatgtaaagataccaggcatggagtggggaccctcagccaggggcagaagcacctgttctggtttctacttggaatgtagaacccacccagttaatgaaaagtaaggctaccaaatatatcaagctatatctgcttggacatagctttgtttactttgtgacaggaatttcttagagtcagcctccagtaactcagttggcatagttgagttacaatgaagaggctgttgagaaattctctcctaagccatttgaaaatgtttactccttcttttaaaaaatatctgttaagctgtgccctcctttcaggtagatgttccagaggcatcgctaagtcatggtgtcacttgcaaacattctcagttgctgtcattacccactgactcctgtttgaaatctctgtgattttgtcaccattgatgggatttatcactgagccacatttgaaataccaatgactggttttcttattgaattttaacttttttttttccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctggtattgctttctaaattccctgttcagctggccaggcggtgggttctctctagctttagttctactgcaacgttcagagcaggcccatagtcttacaggccagagctcctctgttgtagccactcagctctgacatggttgtgtggaagccactgtggatgacacacaaagtgtgcactgttgtgttccaataaaactttatttatggatcttgaaatttgaatttatactgtacagttttcatgtgtcacaaagtattttcttttgatttaaaaaaatcatttaaaaatgtaaaacccactgttagtttggaggccatccaaaaacaggtggtgggctagatttggcccatggcttagtttgccgacccctggcttagagatatgatttgagcaatgagattatgtgcgtgctccctcagtatttaaaaaaaaagcagtaaattttactttaaaaatgaaattaggctgagtgtggtggctgacacctgtaatccctacactttgggaggccaaggcaagaggacacttggcttgagaccaagtgttcaagaccagcctgacaacatagtgagaaaaaataaaaaatataattcgtctctacaaaaaaaaaattaaaaaaaaatataattagctgggcatggtggtgcacgcctgtagtcccagctactcgagaggctgaagtgggaggattgctcaagccttggaggccaaggctgcagtgagccatgatggcgctgttgcacttcagcctgggctacagagcgagagcctgtctcaaaaaaaaaaaaaatagaaaaaattctataaatctatgaataatactacttaggtcaggtgtggtggctcatgcctgtaatcacaggactttgggaagctgaggtcagagcatcacttgaagccaggagttcaagtctgtggtgagctatgattgcgctactgcactccagcctgggtgattgaaccagactctgtccctaaaaaaataataaaagcccagcttctaaatagcttaccgaaattttttccccaccatggagaaatgcctataacccgatggtccaggcaacaatctctggttacattttaaaactagatgaaaacagttacttgcaggatgaatgttataaaaatgatgttagttgaaagaaggaatagggcaaagaatctataacgtttgactcaattatataaagttaagaggccatattagaaggttttttgtttgtttttgtttttttttttttgagacgtagtcttgctctgtcacccagactggagtgtggtggcaggatcccagttcactgcagcctctgcctcccgggttcaagcaattctcctgccacagcctcctgtgtacctgggactacaggtgcgtgccaccatgcctggctaatttttgtatttttaatgagggggttttgccatgttggccagactggtcttgaactcctggcctcaagtgatcctcctgtctcagcctcccaaagggctgggattacaggcatgaaccattgcgcccggccggaaggtactgtttgtgagtgtgcatgggtgctgagactgactgagggcaggagtggctcccctgttggttgaatggaggttacctgctggtaggggaggctctgggaccagcgtggctgagtcaggagttctgacatgctggcagtgttctggggttggatataggtatagaggtgtttgctatataacaatacttgactaactctgcagatactttttattgcactttttcgcaggtatgccatatttcacaattaaaagtgttaaaaactattcatgtctgtacatggttagtgatttctatccgttaaggaaagatacataatgaaaagccaattccagcctcccacctctgccgcctctcagctcaaagaaccactgcccaccagattcctctgtgcttatgaagtccaagtgacacctaatgtattttacgtttttaatgtatagaaaaggcattgttccaccactcaggtcttcaccttgctcttttcacgtagctgtagtattttgaagatctctcatattggcacctgtcactctttataacagctgcagagcgttgtgttactttaaaagggtcctgttgatatttggacagtggttatttaatagctttttatcatgataaataatgctgtaatggagtcctgtataatcctgttaaatgctgtttagaatttctatagggtaaattcctacggggtgtgtgtgtgtagtgtgtacatgtggtttccttaagtggatcttgccagttcgccctccagaaagatttgctaattatacacttggtctgtttgtgctgctgtaacaaaataccttagactgagtgaattatgaagaacaaagctttgtttctcgcagttctggaggctgggaaggcattggcattggtgtccaagatggcgcctcatggctgtcctcacgtggtgaaggcgggagggctgggagcacctctttcaccacaaaccctttcatagtaacctccaaaggtggcctcttaatgccatcacactgacgattaagtttcagtacatggatttttggagacatttcagaccgtggcatgatggtgtgtgaaagctcatttccctaccacaaatcaaagtgaaaaaggactttgatcttaaaagttaaatatggcatcttttagttttgatttccattttttaagtaagattgattatcttttatgtgtttatgggccttttgtattttttctttttttgtaaactttcatattatttgccccttttgatttttgttgattcgtgtgttaagtaatttagcctgaatttgtgaagttttgtgactttgtgaaattttttcccacgtacaacttttttctttgtatagcctaatatggttttcttttctttgtgacttctttttcttttctttgtgaaaaaccttcctcactataagattataaatacccacacttttgttttcagaactgttatgattctgtgttattttatttttgttttttatgttttttagagatggtgtcacactctgtcgtatgagtggctggagtgcggtggtgcagtcatagtgcactgtatcctcaaactcctgggtttaagggaccttcaccttagcttcccaaagtaccgggattacaggggtgaggcaccctgcctggccttctgattctattttaaacaatgagattttaaataataaaaaatctagaaattatttgttgtaaaaaatataatgtaaaattccgccctaatgtatgcccacaaatctccagcgaccccagcctcagttactggacagttcccttcgcgttgatgtgaaacggtgcgtttgtcctgctctggatttcaggggtctgctgtagaattcctgttgtttcactggtctgtttactgcagttcccagtgcttcgtcatttccatcactgcacctttgtaggatctgcaagagctaggtctccagcagttcttttttttttaaagcattttcctcattagccttgggcacttactgttttgaaactaattttattatcattttgttgtgctttctcctttagtaggtactgcatggaatgtttatgttaattttgggagagctgacatctttataacattgactctcagtctctgattacttaagctttgtttaatatctcttagtattttaagataaggacaatatctctttgtcatacatggttgtgcacctttcttgttaaatttgttcctaggtattttttgtgtattattactgttataagggggtgggtgaagtgttctctaaataccaatgagattaacttggttgacagtgatgtccaggccttccatagtcttccataggggtgttggggtcaggggtcatcagctgtggctctgaccctccatctcagtccagacctcagcatggctctaggtcacaggcagtgattctgaatgtgcatttcttccagaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgagtggggtctcgagcgcatcccgggtgtttgtgccgaggctggtgacgtccgaggtggcctctgagtgtgctgacttgtgaccctgagctgttgggggctcaccggtgactccatggtcttgttgagcaccctgcacgtggggctcagggtcggtaaaatagcagtgcgtggagaccgcgtgctagaggccgtggcgcccgcgtacaatgagtcgcagacagcacagacgggagtagggcagaatagacaatatcccgtgaattgcgtggggcggggtatgttctgtgagacgtttatttcagttgagtagagaaacacgtgcacccacatgtctgtgctgggccttgggtgtggttggtctcatggggttgggagggatgcacacgctgggccccctccccacccctcttaggccgtctatactgtgctgagctgagccgagctgcagccttggagactccttacacagtgggtggggtcgcagcacagtgtccacccaagtccaggctctgcaggacccaggacccagcgcttgggtgcttcccaccagacccttccctgagaacctgggtttgaaattgtctgacaggcctcagatgtggcacagaccagcattgtcacttgggtgctaagaagttgctgtgctggtcatggattaagattgctgtgcgtgtggcagccggctcgggcatgcgagtcttccatccacttgcagccctgcgtctgtgtcttgtccgggaggtgggggcagttgggagggttagaggcggctcctttctgggtgcccctggaggggcaggtgtggccagtcctcgctgcctctgctgtctggaatgctgcttccctcttgtgtcattgaccatttctcgtgatgctggttgtgactcaggagagtagatgacgggccgtgtgccggccggatgtacgctgacggtgcctctgctgctgcaggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctggtgagggcgggcgtgcgggcagctgggggccggagctggggggcttctgagcacgggctcggctgggccaacctcaggatctcaagggtcgtgcgtgattcattttgatgttttccctaatgtgaggtctaattaatttcttgtgtggacattggctcagtgtcttgaattttcacctgatttaaaaaatgcctttatgagaaatttaagtcaaagttcatgtaacattttcatgagtgatttacatgaactgtgttctcctcggggatctgtaaaaatcctgtgcctaacaggtaaggctgtttctttaatgccagtagggccttcgtccctggccagggtctcctcgccttagactggccccagtgatgctgtgaagccacttgggcatctgtagggccagcatatgcctgtcctgtcagggttgctcaccctgagtttcacatgtgggtggaagtggactgttttctggttgcctgtgaatatgccctgcacaaacgctgtctgcttggagggaagttgacgggagtgtggctggatgctgtctgcccgcgctgtcttcctgggctcagcatcctgggacacaggacattgtagtggagcatcccaacctgaaactttgtctcagtgtagagacccagaaagatggggtctgggtgaaggagtgtggagtatggctgctgctttccaggaaacggtttcccctggtaacagatggcattgggcttttagtcctgttgaaattttgttgtcagaagataaatgtaaatagactcaatgtccatgctgtgacttggcttattaataacatctgtggagccataagatgacacacaggagaaacgggctccactcctaccccctgaaggggcatttgcctttgccctgaacagcagcgcccattcaataagtatctgttgacagctggtgccccggccacggggacaaaaagaggacagagcaggagtgaggctgtggtgaggccaaggttgtgtgggcggtgatacggggaagcctggctgctggagtgtccggctgtgccctggattgggtgagagggacacaggagggacgtggggcagagggaggggagaggagtagccactgtgttcaccgtgttgccgtgttccagggctgcccagtggccggattggccagactgtgttgcatcagggaggcagaggccagatgtagggaactgtgtgtctgaggactttgtgccacgtcctggacaccgaagggagtgccactggtgtgtgagtgatggagtaagaggtgggctgtgttttggaggcccctgggtatgtgtggccgggactggaggccagggactggctgtggtccagccccagcatgcagagaggcctgggacattctgtgtgaggggaggcccctctgtgtgggaggtgcacagacttccaggactgaccatggctttattgtcaggatgcaggagccagggcttggcatggggcaggtgtggggatgcagagcagggccagcaggcaggatgtgctgatgggggcctggcgtgagcaggacggtgcctcccagccctgagccgcagggagtgggccaccaggactggctgggggccggggtagggagggccctggggagggtggacatctgtgtgggtcttgaacataggatgcccatccgatgtgcagggccagctattggttgggcagtggggacatggcctggggtctcggtgggcgatggcctggaggggccaccctgagcaggacatttggaggagtgctggggtgagtcagacaggaccatgtggtggttttctccagtgcaggcagtggagggggaaggcggagctttgcaggtgagggcttgaggcagttccgacttcagactcccccccagggagactgagggaccaccaccatcattactcaggccaaggaggcccagaacagggcagacggggctgcaagagttcctatggcgatagttgttggggcacagggttggtcggatttgagggagggagggtatgaatctgggagtcgttggtgcggttgtacccaccttcactttccgtccccaggctgcgcctctcctgagctgccgcattctcccctgcacctgtgcgtctggccctcttcacgtcctcctggcctgctgtctgcctctcccctgcacctgtgcgtctgtccctcttcatgtcctccttgcctgctgtctgcctgttctcagagcccctcagccctcaggccttcatctctcctggcccatcttcctactctgacgctgacatgtagtaaaagtctgaagacagagaagagtgcatgtgcgtttagcataggaggggcagctttcagtcagtgcagcaagggcatgtagttgttcagagatggtgctggaacgactgatttggagaaaagaggcccttcttcacaccatctgctaaaataaacctcagatgggctcaagagttaaatatttaagaaaaggaggaaacaaaaaaattgctacaagtttatttgttgttaggatgggaaaggtttttctaagaaccaagttcataatgaagctgtcaaataaaatacttgacaaaaaattccccttcatacattagcacagctaaaaactattaaatggtaaatgcaactaaagaattgcagctaaagaattgtgtgacgtaaagagttgcaataagaaaagcataagataaaggtaacctcatggaaggtgagcagggactagaaaggcagagaaatgccagaggccaggagcttgaacgttgttcaatgccaccaacaatttgaaagtaactgtaatagttttgacctgggaagttggctgagcaatcctctaatatctgatgctcccgatgctgaggttgtggggaagtgtgcaccgccatgccctttttttggcagtgtaaattggtaaagccttttgaaggaaaatagggcagaataagtcaaagagcattaaaatttttttgtttttccagaagcagcaaagttctgaaggagacgcaagtaaagataccacaggtgtcctagattgtcaacagaccatttaatcatttttgttaacaaagcaggtgacaattgagccctaatttgcgttatcattagttgttacaggatcttgcttgttctcctgaggccacgccacgatttccgagaagcaggttgcacactcagcagtctcccactagccagtggcactgcaggtgcaggggctgcctcctggacctttcaggacgctttgcaaggtcactgaggatctccattgcacatttggtagaattaaaagactgccagactcagtcttactgttgttagtgtattcgtgctgtcaatatgtgatgaggacatattatattccgttattctctttagctcaaggaagaataaagaatttggaccaaaattacaaccacattatgacgaattttctaagcaaaagaaacaaagtaactgctgaggttaacaaagatgtaataattctcttcacacagccttgtactgttttattgactgtattatcacaaatcctgagcttaacgaaagtctttataagtcagctcatgaaaacaggcacgtggccagtaagaatttaatttcataccaataacacttcagacttcggatgtatttaaggctgtttgcacatatttatagaatgtgtggtgtagatgatgggacagctccccctcagcaagactctggcctaaatgtatttgctttatttacacaacaagaggataagcgtaaacacgggcactttcagtttgtggcactgaaggacgatctacacagggcaccctgcagaggccacaaccaaggccgcctggcttcccagtgggacaggcctaagggaggacttctggcccctttgcttgatgttcatgttttatgccttgatatttctttttggttgcattccctggagctcatgtagatcattttacttttcagaggtgctagttctggtgcccacacgcacacacacaaaaccatcaactcttctggattccttggttttaaagcttgcctcatacaaagtacagagacatctttttcaggaaacattgccaccacatgcttgaaggaccgcttatggctacacttagacatctccaaccaaggtctcttcacctccttctacaacaatgcactttgtctgcactgggacaaaaaatgacagccttttttcttttcttgtttttttttttttttggcgtggagcatttccgaactttcacgtcataaaaaatgcagcatagttaatcagcagcttgcacttctgagggcacattcacctcgggggaggaggaaggaggaggagctggtgggtgctgagactgcagtgtcctccttcccagcagctggacccagagaccaggcaccaaatttttttgatgaaattatcctaaggaaataatcaaatttgtacagaaatttatgttaaaaaatgttcatggcagcaccgtttaaaatggggagaaaattggaaacaacagaattgtagcaatacatatgatcattaaaaattatgttttagaaagatttttaacagtctttggaaaaagttggtgacatgttgctagtttttaaaaaaagtacagagtatgtacagtatgattccaattttgtgtttaaaaattagacatagtggtaacctagcttcagttccagataagatggagaaggcatactcctttcatgtctcccactgaatgcagctataaatcctggagagtagacagggagaaactatttgaggactctggaacaaagacatagtagcaatcgactggtgaagaagacaagaatttgaagtacggtcaagtatctgtgggctccacatctgtagatacaacctacatgtattgaaaatatcagaaaataaaaataacaatacaacaataaacatcaatacaaataacacaccaatacagtatagcagctacttacataacactgacattgtattaggtagaagtaatctagagatgatttaaagtctgtcggaggatgtgtgtagcctgtatgtaaaaaccacgttattttatatgggggactttagcatccaaggatttgaatatccacgggggtcctggaacaagttccccatagacaccaagaaacaactgtattcctgaaacagtcttgagttatcattttctttcttctccctctatgtatgtacatagagtgtacatacatagagtgagaagcaaagaaggtccatgaaatggaccaattcttttgaaaactgcaaattaccacagttcatctaacatgaaatagataacctgaatggtccaataactagtaaagatattgaattaatagtttaaaaaccttctgaaaggtaaatctctaccctaaatgatttcactggtgaattctatcaacacatttaatgaagaaaaaactccagttctaaacaactttcagaaaagaagagggaacacttcctcactcattatatgaggtaagcattgccctaataccaaaaccaatgttaacacaaaatatgaaacctacagaccaataaccctcatgaacataaatgtaaaaatcctcaagaaaacattagcaaatttaaaccagcaggatataaaaggaataataatacaccataacaaaaaaagaaactatccttggaatgcaaggctggttcaatatttgaaaatcaatcagtgtaatctaccatattaacagtctgaagaagaaaaatcatgattatatcaatacagaaaaaaattgacaaaattcaacatcagttcatgataaaattctcagcaaactagaaagggaaggaaatttaacatgacataggacatctacaaaaaaacctacagaaaatcctaaggagtctatgagaaaatttcctaaaactagtgagtgagtttaacaagatcacagagtgcaaggtcatcatacagaagtcatttttatatcttagcaatgtacaattagaaattaaagaatatcacagtagcttcaaaaatatgaaaggcttagaaatctaacaaaatgtgatctggatgctgaaaatgatgagatgataatgaaagaaaccccagaaaacctaaataaatggagagataagaaggctcaacctagtaaagacgtatgttctttttaaattgatctgtagacttaataaaattccaattagaatccaagcaggatttgttcttatagataagctcattatgaaatgtatatggaatgtaaaggaactagtgctatggtttgtccccaccaaatctcatgttgaaatttgatcctcagtgtggtggtgttgggaggtggggcctagtgggaggtgtttgggtcatgggtgtggatccctcatgaatagatgaatgcccttcctcgtgggtagataagtgagttctagctctttcaggtcccaacaagagctggttgtgaaaaagagcctggcacgcccacttgcctctgctcccaccctgtggtctctgcacgtgccagctcccctttgctttccaccgtgaggggaaatagcctgaagccctcactggatgcccaatcctgaactttcccaaccagcagaaccatgagccaaataaacctcatttctttataaattacccagcctcagatattcctttttggcaacacaaaaatggactaagagaactagagtagctgatagaattttttaaaagaagggtaaagttggaggaactatactacttgattttgaagctacagtaatcaggacaatgtggtgaagggacagacacgtaagtcaatggaatggagacgagagatttctacaaatatggtcaatgggttttttttaacaaaggtacaaaaatcaatttaatggagaaaagacagtcttttcagcaaatgttactggaatagttgtcatccatatctaaaaaacaacacctcaacctcacatctcatacacagctgaacttaaaattgatcatagatctaagtgtgtgaaatgtaaaactataaacctccttgaaaaaatcatagaaaatcttcatcacctggacttgggcaaagactttttactctaaaagcgtgatccatagcagaaaatgttgataaattgaatttcatcaaaactaaaaatgactgctctgcaaaaggatgatgctaagagaataaaaaagacaagctaagattaggagaaaatattgcaaagaacatatccagtgtgtgttctgaatatacagagaaatctcaaaactcaacaggaagaaaacaagccaattgaaaatgggcaaaatacttgaacagacactttaccaaagtggatatacagatatcaaatacacacatgaaaagatgttcagcatagccatcagggaaatgcacattaaagccacagtgagatatcacttacacccattgaaaaatgactacaataaaaaaaaaatctgatagtaataccaactgtcatcgaggatgaggaacagctgaaagtcatgcattgctggagggaacatgccactgtggaaacaggtgggtgctttcttatagacttgtatgtgcactcaccttatgcccaggagtccctctcctgtgtgttcaacccagagatatgcaagctgtgttcacacaaaaacctgtatgtgaatgattatactagctctctttataattgcaaaaaaaaaaaaaacaaaacctggaaacaacccaagtgtccttcatctggataatccttaaggataaactggtgcgtccacacagtggaataccactgagcagtgaagaggagccagttattgaaacaggtaatttggaggaaccccagaaacggtacagtgagtgaaagaaacttgtcttgaaaggttatgtactgtttggttccatttgtatgatattctcaaaaagacacaagaccatggggatggagaccagatcggtggctggagaggctggggtcggggagggcatgaccaccagagaaaagggtgaagagtgttttgggtggcagagctgtgtgtatgctggctgtggttgtgaggacaaaatccacacaagcgctcaagttcgtaggctgtacgccagaaaagctgtttcactacataactgaaaaaataagattgaaaaataagatgtatatattttttgtgtgcgtgtgtagaaaaatacttgaaggtaaactgcagagtgataacagtggttccttctaggtactgggttaatatgtgatttttatgtttgtttgagcttttctaagttttctacattttccgtacaaaacatgtattacttctgtaataaaagcagcttgagattatttaaggaagcaaaacacttctgttgtttctcatcaactacaggatgaagtgcaggctccctgggtggtttgcaggggccacaggccttggccccacctcgctggtgctccctctactcctttctgtgtttgaagcaagttctggttcagacagaaagcctggcctttgagggcgttgggtccccacttcctcagtcatagatgtgatgtgcttcccttgacttgggaccttctgagggatgcaaggtggaccaaaggacccgtgaatggccagggcatgcctgcgtggctttcggtttcttaagcagtgatttcagtccacttaaagggtgtgaaaattctgagaatgctacggaccaaatatattttatgtaacagttgggacccggcaacacttcagggctctttcaaaatctggtagctacgagctcttccgtgactgagatgggacaagagtgaagatttgtccttgcttttagctctgctccagttcatagttctaatgggaaattatgtgacttaaacccaggctgtgagatgcatcagtgacgtgtgggcataaaataaaccctcgagatgttctcttgcatggtacactggcctaggcaggaatattcttgaggctaaaactgtagaactgtcagactagtgttacgaatgtggtggtgagaggcctgtgcagccgcggggcctgtgatgtgtctcctgtgtgtctttcactcctatgcagtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaagtaagtgtccacagctgggactggcaccgtcttgtggggcctcctggtccacagtctgcaggtgggccaaggccctgggagatcccatacgacggttggataaatgagggtacctgtgcacccagataggacaatctgttgtagcattggagtaattaaagcagtatggtgctataacaagacagatgggcagagcagggtagaatgcaaggaacaaaaattttcgtatgtgaaaaaggtggcattacgattaggagggagtgagggccaagtcagcaaattattctggagcagttgattagcccttgttctctcacgccatacgtgaaaacttaattctgcatggaatcagcgtcagcgacagacatccatgggggcctgtgtgcaccatcttaggtggagaaatgagcagcaacaatggatggaatggaccctgggctagatagaatctggcagtctatgtggcagaaatcagcaaaaacacgattgtaaaagcaaacaagtaattagagaaatcacgtgctgtcaggtcttggaatcaattagaaagagatgactagccagatggaattgcagcccaatcatgtgaacaggcaaaccgcaaaaaataaataaaattaccaataaatacatgaaaaattataatgttgttagtagttaaaatgcgaattaaaatacatgctgttttccctaccagacaagcaaagagtaaattaaaatagtagcccaggcttgcctggcagtggcagggaggtgtggctgccagggccttagaggttggcatcaggctgcccaccccagtcactgccagagcctcccacctgagtgttcctcccggcactggaagccagtggccgtccagaggaacgtgattgaattgctgtatatccatctggtggagcactgctgtgtgtctgttaaaaaagaaaccataggtttttagggatatgtaatgatatttagaaagggtttaagagacagtaaagcttggcagaataaaccgtgtatacagaatggatgtttgcttgcataaataaatttatataaatatgtctgggggataaaaataagtatatcacaatgctaagacaggcatatggggaatttaagcttttctttatacttgtccatagtttccaatttttaaatttgtaattttttatcagaaaaataaatgtgtaaatatagtggaatctttattaaaacattcacttttatttgctatttcagaagttactgctttgcttattttttacaacatttctgtggtaaataatcggtgacttacaagcctagtgcagccagtgatgggggttggcaaacggtgacatgcaggggccatgcggcgtctagtgtctgtttctgtgttgaatttgtgtagcaacagagcaagtatttctcctgaaactcagactcactcaggccacctcagcccttctagttcctttcgtttattatagagtaacctacagcaggaataccgcgttcatttactgttaatagaagatccacaaaagattttgaaatcaaatacattctaaaactaggcaagacacgctgcaactccccttgtcctctgggttatgaggggtgagcgttggtttccgtgtgctcagatcccatgaatgagacctcacagggaagcgcccagtgactggcaggctccttaatgcctccaggtcaggctcaggaagtctctggatgcctgggtagagtctgggtcttctcagagcgggaggcacccagggcctgtggaggcctgagggctgctctggggttccagggccccagatagtggcttagcatcctggtgacacagaagggagagcactcaccgcggtcccacgtgtgtgttttgaagcctaagatgtttgcaatgactctcaacagtcgctttgaccttttcccctagatctttagcagttaaggagtttttttcaaagcccaagtataaccacattttgaaaccagaagactgtctctctgaaccgtgcactatattgcagttggacatgagaaccgtgcaaatttctgatctagaggtgagaaaaagatgaattgctccttacattcgataatcagtgaccacgaaacactcagaccagagcctggcttatcaaaaaccttcagtgagtgctgggggtgtgagtgaataactaattattttattatgcaaataagtgaatttataaaacgtttgctactgattttttccagtcttttttcttttttacgttctattttgattctttcatattgtacaccattttatgtctccagcgtcttcattttagatttatgtttaatattctcagcatcttcaaaatcaaataaattatatttcgtttcattatggtatttgcattacagtttttttcaagtattttaagccactcttcatgacagaatcgttagaattccctccgtgaatccctgtctgtggccgcgcggtggcgctcgtgggctctgggcggtttccccgcgcccccgccctgcctggcgccccagctggcgccgcgtctggagatggggcgggcgcggtggcgccggcgcgctttggtttttagttcgttctgctgtggaaaggcccagcctggagctctccaactccttaactggaagagctgagcgccgaaaagattccgcagaatctggggtagaaaattgggcgcaagaagctcagatgcttgaaacgtttctgactgaagcctctgaactcacgatgcgggttttgggggtggtttccccaggctggggggcttttctacggttcctgacgcattcagcgtctgcgcggggcgcgtggagggggccgccccaacccgggccctgcggtgccacgcggtgcccacgcgtgccttgtcatctgcttgacccagaccctgaggggcgagctgcgcttcgacatcaggaaggcggggaccctgcacggcttcacggcctggtttagcgtccacttccagagcctgcaggaggggcagccgccgcagtgctcagcaccgggcccttccacccgtgagtgtgcggggcgcgggcacggggtgcggggtggggggcaggggagtaggcggggtgcggggatggggcgcgcaggagggggtgggacgcggcgtggcggtcgtgggggggtggggcacgtgggggcgcgggcagtggggtgggggcggcgcgcatgggggcacgggtggtgtagacaccgcagcctgtgtgcccccttccgggtctcgccaccactctgggcccagcctgggcgtccctccgacaacagccccaacgggaggagctccctgtcttccaccccgcgaggagcaccacagctcttcatggtctgacccaaagcgcctccacggggcgtcggggttcacctgacgtttttggaggtgcctgttttttgggacacatttccccgccagcaccctgggcatgtgtggcagtggagctgccttcagggccctgcaggccttccctttgggtggggttggctaccccgctctggcacctgccccgctgacttcccagcgtggtggccccgcgaggggaccccggctccagggaggtcgcagaggtgcggggttgatggcctggcctggcatgtggtccccatcacaagagtcctgtggtggcccctccagtgccatcaccgggtggaggtgggcagcttggaggccagttatacccatccccgagtctgggggcgtggagggggcagtgacctggggcacaggctggggtgaggggtgtgaccagagtcagggaaaaactggagacctgaggagccccccacttcactgctggccccaccgtggacagtgggagtttgagggaagacagagcctgaggaacttagagatgtttccaacgcaacccagtgcagaatcatagcgttttactatttccccccaaatgtgacagttgtcctcaccttgtaaccttcacagaagcgactccttggacctgattctgtctgtgtacaccacagtttaacagcaggagctagatcaccagcctctgcagcttaggcaagggtgcaggaaggggttgcacagccgtcctcctggcgggccggggagtcgacaccacacgggacctttagtgcagctgtgtgtcccctgagctcccgcatcctctgggccacccagggtgagccgtccacacctcctggaatctgagtggtctcaggagcaagcttgtgtttggcattggcaggatctgtctcactagcgtaactttgatcccagtgtatcccatagagtccctttagatcacagggctgggggtgtatatgttccctgagttagcctgaaaagccaagctttgtgtccccaggccctcagggtggactgccggctgtgtgggtgctgttgggggcgagagccagtgcgagcctgagtcagcgccccgagggccatgtggagactgccctagctcagcctccaggtcacacgcacccctgtcttgcagcaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagtaagatacgtagttgtaagattctgtcctgtgggtgccggtcctcagggagacaggcctgggtggtggtagtgatggcagatgctggcccacactggggtccacgccttttgtgcaggagtgatttaatccttacacagaaagcgcctgttgtcattggcttcatttcccatctgacagcacgggaagtggagggctctggaagggaagtcagggaagtcattccctcaggtgacacggtaagtgagggagagcagagacccacatcagcctgaggccccttgtgccatgtccagagggtcccccagatggacagaagcctgagctgtgccttggcgctccctttacacaggcctctgtggcttcccaggcagcagttagtctaggcgtgtcgtctgtgatgcgtgttctgactggcagccttcggatccgtgtgtgaattcatgtgtagctcgcccagctcacttgggcttcctgtctcagaggctgctgaaaatggaatgttcttctttgggctcaggattaatgtggcaaagaaaataaaaataaatggttttccttcattttttatatttgttttgtgctttgctttgtgataagtttttgttaaaagtttgtcatttaaaaaaattctgcacctgaatactgttctcttgtccaatattaaaccattaggaaatgtagtatgttaatcaaatgatttatcatctgattgacctgttgtcatttatctttttcaggttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctgtgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcattgtgtatcctgttttatgcatatatgttattttttgtaattacaggatcatactatatgcattgctttataagtttttctcaatattgtgaaaaaacttccacatcagtagatacatgtccataatttttttttgtattgttttgatttttattaaattttattgaaatataggctgggtgcagtggcttacctctgtaatcccaacactttgagaggctgaggtgggatgattccttgagctcaggagttcaagaccaccctgggcaacacagcgagatactatctctacaaaaaaaatagaaaaattagctgggcatggtggcgtgtgcctgtagtcccagctactcgggaggctgaggcggggggatcacttgagcccaggaggttgaggctgcagtgatctaggattgcactgctgcactccagcgtgggtgacagagcaagaccctgtctcaaaaaccccaaaaaacaaaactgaaatatcaaatatatattgaaaacagtgctagtcatgggtacatagatgatggcattttataaagtggacgcacatgtaaccagcatccaggccaggacacactacagattccccgattccccttccactcagtgcccaccctctcaagggtgatgtcctgacttgtaactgtcgattactcttgcctgaatggagttgtacacgtgttcttttgtgtctgccttctttaattaaacattgtttgtgagactcatctatgaattttagacagtgtggttgtggttgactttttcattgtggcatagtattcaactgcatgaatagaccacagtttatgatcttgtttcacatggtgtccttttgggttgttgccatggtttagctatgatgattactgagactgtggacatttctgtgtatgtgttttggtgcatgtatgtacacatttctgttgggtgtacactgtataccaggttttcaagtcaaggaatctaatatccctgccagctgtgcatgagagttggcatcctcgtcaacacccagtattgtgttttgcattttacctgctctggtgggcgtgtggatttggtatacatttcattgatgactaatccagttttgtagatttgccgctcattttggatatcctgtttttgaggtgcttgtttaagtctttggcccattttactattagggtttttttttttctatttctaattgagattccaggtgttcctgatataatttggctgagtcctgtaacacatatatttttgtgaataaatcttttccctttctgtggcttttttttttttttttttttttttttttttttaatcaagcatcaagctgtgaagaagctgtgtcagtattttcttttttttttttttcttcgagacggcgtcttactctgttgcccaggctggactgcagtggcgtgatctcagctcattgcaacctctgcctcccgggttcaagcgattctcctacctcagccttccaagtagctgggattacaggcatgcaccaccacacctggctaatttttgtatttttgtagagacggggtttcaccatgttggccaggctggtctcaaactcctgacctcaggtgatctgcccaccttggcctcccaaagtactgggattacaggcgtgagccacagtgcccagcctgtgtcaggattttctgtcatggacatggaggctggtggtctgggtgcagtttcatacatggttattagaaaaggcatctcatccaaatgtggtggctcgtgcttgtaatcccagtgcttcaggaggccaagggaggaggattacttgagcctaagagtttgagaccagcctgggcaacacaacaagaccttgcctctacaaaaaacttaaaaactagctgggtatgatggtgcacacctgtagtcccagctacttgggaggcggaggcgggcagatcgcctgaggtcaggagttcgagaccagcctggccaacatgatgaaaccccgtctctac

SEQ ID NO: 16950 - DNA, 7472 bp, Human
tcaaagtcaatgtccagcccccagtctgagcccatgtgatggggacgtggccaccaagtacagttgtggaggttgtgaacagctccactttcaactagcgatgccactctattgcagacgtcccatctcgtgtaatggtttcccaactctgtgggcactcagtgtccctgcgtgggggcctgagcaggattccagggaagcatgcctatgacaacacaggcttccgccagggccaggagagtgagagaggctgagaagtggtctcttttgcatgggtcaggtggtcgcagcaggaatcctgaaggggctgcagtgagcggtgggaagtcgagttgatggggaggaagcagagaggagaggtgggtgggaatatgagagaaaacaatgactcagtcacttatatcatgatggtgactaaagtgacagggatgtagaacaaggaaactgaccttgccagagttttcatggatcgagtccctgtggttgcccagtggtgaacagtcagcagagagcctggaggtacttgacccggacccagaggagccctggaggatggagcctggaggacgggggcctggagaatgagggtctggaggacgagggtctggaggaacaggggcctggaggatgagggcctggaggaagagggcctggaggacaggggcctgaaagatgggggcctggaggatgagggtctggaggatgagggtctggaggagcaggggcctggaggatgagggcctggaggacaagagcctggaggacaggggcctgaaagatgggggcctggaggatggggcctggaggatgggggcctggaggacgggggcctggaggatgatggcctgaaggatgaaacctggaggatggagcctggaggatggagcctggaggatgagggcctagaggatgggggcctggaggacaggggcctagaggatggagccctggagaatgggggcctggaggatggagcctgggggacgagggcctggaggatgggggcctggagtatggggcctgctctccagaccctgaggacagccccgtggtggaccaaggattttgggtttcctgcgtctctgggcccctgactgctcaaccatcagaaacagactggcaaccccctgtcatttccctggcgtggggaacttcgggtcccctctgtccttcccaccacacttttccctctttctttccgggtgtctactctctggcttctgtcttctctgtcaggtccacagaatccttctccagcacatcctaccccaggaaggccatgggctgggtcccaggtgccatctttcagaagatgtagagcattcccatggaacaaaaataacccatttcaggggttggctgaaaatgaacttattaaaacctgcctgtcacaggctactccgctgaccctgtcagcctcatctccatggagagcagcccctcctgctgaagatgggacaaagggcatcgtgctgcggttggggaggctctaaccacagccctgggagcagtctcttacctcctctgagatgcttcccttcctcagggaggggacttttccatgctatctgctggcctgtacattttccccagtaaacttggccctaatattttctaaattcctgtggtccctgcccactctatcaatagaaatgcatagcttatcccttcctgggtgtgaccctgtgtgtgcccagccccagacctgcacgtggccggttttccacgctggcagcctggcatgacccaactctctgtccagggcaggaagaggtatcaccgagcagggagagagtcaccctggcccggaagcctcgcctgcacagggcacagctgcctcttgcctcctcttcgcctccacggtggaagggctggggccacggggcagagaagaaaggttatctctgcttgttggacaaacagaggggagattataaaacatacccggcagtggacaccatgcattctgcaagccaccctggggtgcagctgagctagacatgggacggcgagacgcccagctcctggcagcgctcctcgtcctggggctatgtgccctggcggggagtgagaaaccctgtaagtgaaggagagggtctttttatgtgctttctttatttctcttaaagaaaaaaaaaaagcacaaccataaattaacttgagagggggaatggctataaaggcatctggcaatgtgtgttgttcacatgggatttgccactgctcaggagggtggctccaagaagggcctccctcctagggaaaggctgagtgacggcaggtgtcagcgggccccgtgtcgggccaggagggcattcccaccaagggtccttggagtcccagagcactcacctctcgcctggatcttggccttgggtccatctgttcaccctcctctaggagggttttgtttttgtttttttccgagacaggatctggctttgccgcccaggcaggagtgcagtggtgtgatcttggctcactgcaacctctgcctcccaggctcaagtgatcctcccacctcagccgcctgagtagctgaaaccacagttgtggaccatcatgcccggccaatttttttttttgtattgtttgtagagatggggtttcgacatgttgcccaggatggtcttgaactcctgagctcaagcaatctgcccgcctcggcttcctaaagtgctgggattataggtatgagccaccatgcctggcttttttttttttttccttttaaactaatataacaatttcagcaaagccctatcggcttctcaggaggaaaccgcattgcttaaatatgggcaagataagactttgtgtttctctatgtggcaacaagacagtagaggcatcccctagaacctctgagagaaggagcagtgtggtctggggtaccagggtggggccgactgagggtctttccacagccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaaggtaatcttccagggaatcttcctgggccagcagctggcaacccaggacccagcttcacaggcggagcccagagcaggggctggaggaggcccagttgctagtctagggttagcctgggtgggttagtctcgagctagccccggttggttagtctggggctagcccaggttggttagtctagagctagcccaggttggttagtctggggctagcccaggttggttagtctggggctagcccaggttggttagtctagggctagtgtaggctagttagtctaaggctagcccaggttggttagtttggagctagcgcaggttgattagtctggggctagtagcccaggttggttagcctggagctagcccaggttggttagtctagggctagcgtaggctggttagtctggggctagcccaggttggttagtctggagctagcccaggttggttagtctggggctagtagcccaggttggttagtctggggctagcccaggttggttagtctagggctagtgtaggctagttagtctagggctagcccaggttagttagtttggagctagcacaggttgattagtctggggctagtagcctaggttggttagtctggagctagcccaagttggttagtctagggctagcataggctggttagtctggggctagtagcctaggtttgttagtctggagctagcccaggttggttagtctagggctagcgtaggctggttagtctagggctagcccaggttggttaatcggagctagcccaggttggttagtctggagctagcccaggttggttagtctgaggctagtagcccaggttggttagtctggggctagcccaggtttgttagtctggagctagcccaggttgtttagtctggagctagcccaggttggttagtctgggactagcctggactgctagtctagaggtagcctagaggactgctagtctagaggtagtctagggctagcccaggttggttagtctggggctagcccatgttggttagtcttagactagcctggactgctagtctagaggtagcccaggttgtttagtctggtactagcctggactgttagtctagaggtagcccaggttggttaggttggttagtctgggactagtctggactgttagtctagaggtagcccaggttggttagtctgggactagcctggactgttagtctagaggtagcccagattggttagtctgggactagtctggactgctagtctagaggtagcccaggttggttagcctggggccagcctggactgttagtctagaggtaacccaggtcagccaacagtgagatgaaaatttcccacctaccctgtttctacactgttagttctttcaacagacatgtgtgtgtggagccatcagttttactttagttgagaaaaaaatatatatatatatagtaggtctcctctagtttttgaagtgtgacttctgaagaagcttccatggggaaatgaaggtatttaataggacagcagtaacataagggctgacagccctcaaatgttagggaaggaagtgaagccttctagggttctttgggagtgagttttatgttagtgcacgggatcaggacccaagttgtaacgccgacgagtgctcaaaggaaggttgtgtgtgtgtcgtgcacctgtgtgcgtggaaccaggcacgtcctctggagaaggaggattcatccccaagattgttgctgggaggcttgctgggccccgcagggaaaccaggcagatggtggattgttcacgagcgcccactgaatggcagtgtctttgggaatcaataccatgtccaaacgctttccatcttaccaaggtgcccacaaaccttttctcatcttggcccgggggaccaccccatttactgagaacactgagtcccgagaggcaaaatgatttccccaaggcgggggactccagagcttctgactgtgaccaccccacatgggccccaccttcgcggaggacaggccagccaagcgtcgctggggccgacacttccacagtccccgggggaggcggtcccaggggccgacacttccacagtccccgggggaggccgtcccgggggatgctgccccaggcagcacctcatgatccacggaggctgcaaatcagcgctgctctcagaggaggaaggggtggagctttccagggcacagcaggcctgactgggtctcggtgctgtgcctgtcccatggcagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaaggtaacgtcgctgtgggactctctgtctggttcccggacaccatgattcctcctccgtccgtagaggtggggtgcagggaggggagctgcctcgcagcctcagtgccatcgaggccagggcccctgcctcctatgggattctgaaggcaattccagaatgttcttggcaaagacagcgtcttttcaataagtttatagcctccagcattgccactgcgtcatctgtgatggctctagaaacagcggctcatccctgttgcctccccaggtgttgcaacgttcagaggcgttgcctgttttattgcaagcccatctgcatttggaggctactgagtgtcttgcactgtgctgggtaccagagagggcccaactcaagcagacctggccccttctcccgtggcttccccgttctcccccacatgaccccgaatgacaaacctcatccacaacgtcctgctccgggcagtcccgggagggtcccgccggcagaggtgaacgggtccacttctcccacccgcttagtgatagtgtgttcctgactcggagtgtggcgaggtaaaaaaagaccaagcagatccaggaaaatggggaaagagctactggcccttgaaggatgccttttcttttccttttgttaggatatcaaagcactccaaagagcgaaatatttcatgttcaggattttccgagtgattttttttatgtgacctaaaggtccacctagaaaatgttcacttgtctggggagaatgcgccccacagaggaaactctggcctggggtgggaagatttggtccctttacaccccctccccgggaaaggagctccttcttcagtaggaagctcctgggcaaagtgatgcacgcccaccccagcttcgcagcctaggcactcccatttctggggttcccttaccaaccatcttgcatttaaacttctagactgccattactaagagaggctggttccagaggatgcatctggctcaccgggtgttccgaaaccaaagaagaaacttcgccttatcagcttcatacttcatgaaatcctgggttttcttaaccatcttttcctcattttcaatggtttaacatataatttctttaaataaaacccttaaaatctgctaaatttctttttggtttcattaacacagaggtggtaatggtggtgtgcgtgtgtacacatgtatgggtgtgtgtacccatgtatgggtgtgtgtacccatgtatgggtgtgtgtatatgtgcgaatgtgcatatgtgtgagtgtatatgcagggtttttttgtgtgtgttttgagacagagtcttgctctgtcacccaggctagagtgcaatggtgcaatcttggctcactgcaacctcctcctcccaggttcaagctatcctcctgcctcagcctcccgagtagctgggattacaggtgcccaccatcacactggctaatttttgtgtttttagtagagatggggtttcaccatgttggccaggctggtctcgaactcctgacatcaagtggtcctcccaaagtggatgactttggcatcccaaagtgctgggattacaggcgtgagccaccatgcctggcagttttaatgtcccttccatttttctaagagaaaaaattcatcaaatacattcaggtttctctaaaagcaataaaaaagtattgcatgtaagaacatttcagaattcacaatcactttgtaactcccattctcagtcctttttataaaaactcaaatgactagccctaaaaacctcttggagtgatacgtgacttcagattgcaattgcaaaatcctttctctttgaccgaatgcatcgcagacccctcgattttgagacgattgtgcggcagccggtcgtctcctatttctaaggcaagcagggaggggccttgaccaggtaggccaaaaattctctcccaactctttgcttctgtgttttctggcctctgcctgagggtagctttggtaatctgctaacagttgaggata

SEQ ID NO: 16951 - DNA, 8256 bp, Human
ggacttgagcatttgtggattttggcatccctgggtggggggtcctgaaaccagtcccccaggggtactaagggacgactgcattgtattttaagttcattttccctttccctggttaatgaatatttattttgcttttctttccctcctttccttccttccttctttccctgtttccagctgttacaaacaatgctaaaaagaatatctttgcctgtgttttcttctgcccaagtatgaacatgtttctgggattaagagaccaggcctggaaacagaagaatttgctgagctgtaaaatctgtatggcttaaacctcaccgaacactgcccaccttttctccaaatgattgtgcaatttacatcccatttccaagagcccccattttgatccgagaaattagagcagcgaaaaccaccgtcactatgagcaccaccctgggcctggtgcccccgtcctgttttcaataaacttaagctgaccacagaggacaccaggcctcggcccctccctgggtcctgcggtcaggcccctcctggagaccctggcccaggagtggagaccccggtgcaggagtggcagccctggaggaggggctgggtcctgggatggagcgaagaggaacatggccgcccccattctggcccaggctcccctcccagaggggctgcagaaatgtactgactaggtcacccaagaaaagatagtacctttgttaggctagcatgcattttcctcagggcctaatttctcactgaagaagaaaagatttctcctgttgtccatttcttcatgcagctcttcaacagctgtttctcgaatgccaatcaaagccactgttctagggtctggggccacctcaaggcactaggagatgaggacttctgctcccatgcgccctcccgtctgctgcagggaggagtgcaatgaataaataaccaacataatgtgtcagtcacttgttttatccaccaggaggtaataagagctatgaaagagaaagctccgagcaggggaggggagtgaggcatggtacaggagagcaggaggctgtcctctaaaatacaggagtccaggggaccaactgggaaggtgtgggagggggagggagggagccccatagacacaggggagtgaaccacgttcactttgtcagtttttgatggcagctcgtatatactatttttttctccctcctgcccccagcccctcccagaaggagacttaatctgtcgctcaggctggagtgcagtagggtgatctcgactcactgcaacctccgcctcccaggttcaagtgattctcctgacttaacctccagagtagctaggattacaggcacccgccaccatgcctggctaatttttgtattttttttttttgtagagacggggtttcgccatgttggccaggctagtctcaaactcctgactttaagtgatccgcctgctttggcctcccaaagtgttgggattacaggcgtgagccactgcgccaggcctacaatttcattattaaaacaattccactgtaaaagaattagcttaggcctagacggaatgggcttcatgagctccttcccttccccctgcaaggtcacggtggccaccccgtgagccactgttgtcacggccaagcctttttccggccatctctcactatgaatcacttctgcagtgagtacagtatttaccctggcgggagggcctctcagatatgagtaggacctggattaaggtcaggttggaggagactcccatgggaaagagggactttctgaatctcagatccctcagccaagatgacctcaccacatgtcgtctctgtctatcagcaaatccttccatgtagcttgaccatgtctaggaaacacctttgataaaaatcagtggagattattgtctcagaggatccccgggcctccttaggcaaatgttatctaacgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacaggtaaggcgtgcttcttcctgctctgtggggccacagccagctctggcagcctccgccaggagccactgttttacatacatatttttgagcacctgttttgtgccaggtgctgttctaggcccttaaaagtatatccaatttacaggatcggcaaaagcaggtggagagtaactcagggtggcagggcccccggagaccttcgagaagtgcgacgaggagggggctgccttcagtcggggctgttttcctgtgttaggaagactatacaatcctcccaagtgtcatgtttcaaagaggaagtgttggcgtggggtctcagaatagtgcttttgactgttcatgccaacatctcccccaggggcagaccctcccaaggcccatccagataggcccaaatgccggtcccagtgatggccacctgggagaccctctcccacaggcccgaatgcccgtcccagtggtggccaactgggagaccctctcctacaggttcctgggctcccctgggatccatgctctgggagtcaaagccacctctctcatgagtgcgtggctggcaacccatattccctggtgttgtcaagtggatcggttgccctgggtccttctagggagtggaggaggaggccattcttgcttccttgggaagtgtttgcatctcaactcctttacctgcagaatggatcaacggtctgccctagggctgtcaggaaatgctgtgtggcagcatctgcgacttgcactttgccagctgtggggagctgaataacttatttgccgttattaggtacagtttcaaggtgggggcaggagaaagggctttctacgtttccaaagcaagggtttccagagaggcctgaagagggagcgcccagtggtgctgtccgtgcccccactgccctccagccacctcttgatctctgctgtggggtaccgggcctgaggggtgggcttgggcagcgtagaagagcagccagcattgggctgcagtgggaagacccccaagcccatggcagggagcgggggagctttggaacccgagagaggaagtggcctcggtgtacagaacgaactgggtgggtccccgtgctggccacccccaggcccatctgcctgcgcccttgcccccaccccagcccccagctctgccccctgtgctgtgggatcacagaggccgtggcaaactcccctccccaccccacacaccctctggctcaaggctcagagcgtctttgcgggtcactcaggtccatgatcctgttacaactgaaatctagaaaattgtgattacagtttagtgcattcgtgtgtggaaaccatttccatttatttccatcatgcgacaaagacaaagcgggtgggcaagacagagtctgccggaggcagagcaccggggctggaaatcttcctccctgaggaggaaacccccccgacccccaggatgatgatcctccctcaccacggggcctctcttgacccccacagtgtcccgggggtgggcgatgatcaccttcacgtcgcgatggatccagaccccaggagggcaaggttcccatggaagctgctgggcagcgggagctgaacacggatccttcccagcaagccaggaacactttctccaaagacatctcgaggcagtccctgatagcaaagcagacaagagaacagcccctctcggcctcccctggggcgccctcacctgagccagtgtggccagactgagttcctcccctcctatgccccaaggcagggacagggaccggagggtgctctgggctcctctttcaccccctgctgcaggctgtcaaccaccagatcctaataggttgctttctgagacctttgattccgcggagctcagagcctgaagctctggtgttagaacctcttgcataagatcctgcggcagcccccagccagccccatctgtccacgtgtcttcctcctctagatccctttcctcactgccctgcttcaagctgtttcacagcttgtaccctctgtcggctcctcctagaccaccccacccggtcctctcaccttacctgcaatgggtttccacctcctgaacacacctgggtctctggaatggcctttgcccatgcggctccatcttcacctggtgaacctcctcctgcagggagcccccctgctttgttcaacctgcttgtcattggcctctccggggagtgccctacccccgtggttaccctgggcaccctgggacgatggccttgcgttgtctcgcacatgttcttgcctttctcctccatcagatccttagactcttttttttttttttttgagatggagtcttgctctgtcactcaggctggagtgcaatggtgcgatcttggctcactacaacctctgcctcctgggttcaagtgattctcctgcctcagcctcccaagtagctgggattacagacgtgtgccacaatgcccgcctaattttttgtatttttagtagagatggggcttcaccattttggtcaggctggtcttgaactcctgacctcaagtgattcacctccttcagcctcccaaagtgctgggattacaggcatgagcctgggcccagatatttagactcttattaatgacttctctggttttaatttctgggtctctctcacctggcacagtgcctggcttttgccatgctagctcccacttctcatgcacacaaatggtgctcagtaaatatttatgtattgagtaaaatttaataatcatttgttgaaattaaaaagtgaataaataagttacctagaaagatgcaaagtccacaaacctggggcaccttgcattttccctgagcgtaatgtttgcacatcaggatgtgaggaccacgtctccctctcatgtcctgagggttttatatccgcctcactggacagttgctgatgtcattggagaaggaagctggatgggtgtgtgcatgataacatcaaggaattcagcccacaacttactttgcttcttacctgtgcactttcagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaaggtatggcctttttatacgatgggttctgaagatttagaattagttagaaaagtcatttaagactacagaggctctgatcagcatcaccagctatgcctttacacagagtcacggccgccagtggtggtgcaatggggtagcctgagtcaggctgcattcaggtccaggaatagaaaggcagggctaagggacttgggaagaaacctgatttccccccggcttctcttcacatctctaaccaaaagcctgggaagagccactgttggtaacgctttctagcttgcctaggatagagggggaaggcatgacgaaatctgaagacatttcatgtattcttttttttttttttttttgaaatggagtctcgctccgttgcccctgagctggagtgcaatggtgcgatcttggctcactgcaatctctgcctcctgagttcaacctcagcttcctagtagctgagattacaggtgtgtgccactacgcccagctaaattttttttgtatttttagtatagacggggtttcaccatgttggccagaccggtcttgaactcttgacctcaggtgatctgcccgcctcagcctcccagagagctgggattacaggcgtgagccaccgtgcccggctgacagttcatgttttctaaagaatgtgcctatggatactttaaagtaaaaactctgtaattgtttaaatgtgaaagaaaatgtttatcctcactaaagcatctctttctccctccccctcacccctgtagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaatctgtgctgttcattcttttaaagaatatgaatgattttcctttctttgaaagtgaagcgcagcgtttcaccctgggctctcgcagaggttctgcatcttctgggcttcctgagctgggatacaagtgggcagctgagtgcagaaagcagggatggtggggtgtacagtaggacagtggggtgtgcagtaggacagtggggtgtgcagtaggacggtggggtgtacagtaggacagtggggtgtgcagtaggacggtggggtgtgcagcgggacggtggggtgtgcagcaggacgcaagtccaagacgcactcttgtccaggcatgaaaatggacaccgactcccctggcatttcttaactactcactgcggatgccccagcgaccaagtgacacaagttagctttccgtttatttgctttcccaaatagaaattggcgtaggagatgaaacctgtagcagaatgtctgaaagcatgtgtaataaaaattgcagagggtggcatggactgacccctccaggaaaacccctccccaacctcagatctgaacgaactagaaaatagaacagcagaggagggatacagaagccaaaatgtcactttattcccactggcccctctgtagcttggcaaggattgggagagggtgtccccccaacctagtcgtccttgctctggggacctcagctcagcaagccccaagctaaatgcaccctgggttcctcctcctcccacctgtccctccatctggtgctcttgtgctgggcacacgttgcacagttatactggagatgggatcccccgggagctctggaaagctcctgctctctgcagccagacggttccagggaggaagagggaggtgcagaactgagcggggccagctctttccacattaaccagtctggcaaatcattcccaaacccttggctaccacgttcagcagataaagaggcctgagaggccgggagacacccaccaagaagaaccatcaggaacgggaagccccctgccccctgcacacagcagcacacacatgagccgtaataatacatatgtcacgtatgtgtcaggggggccacagacacctcctcttacctctcagatgtgcaaggaagttttagcttttcttttccatctatggtatgtctgatcttacactctctgtctgctaattacaggtaaaaatgagctaactttatttagtccaattcctcttaaaattcagtttgtcataataatttgcacagcttctgtcagtcacagtctttgggaacgcattgctcagtctcttacctcgctctactccgtcttgccctctctacccctgggtggggtgaaggagcccctggggtctgcccatgccctttggattcctgctggctcactgtggagcagaagctgggggttctcagagcccagctggtgtgtggcctgtccgttcttcccacagttctccagtgtcagaaaggtgggctttccacacaacatctcgtagctgactgtttcctggctgtccaccatccgttctttcttacctaacttgcactctacgaaggaagggggagaaagaattcactttcccagcccctcttttagccagaagtggccgtgcaattctatgtggcccatgagacatagggggcatctccttgaaggtggggcaggcttctcccttgatgaatgaagagcgccctctggcttcctaggccagcccttgcagcctgcctttgggtgttgtggaaggtgggtgtgatgtggtgttgcaggcagccattatgtaataatgaggtaaggcccaagacctagagccttaataaccctgagctactgatttgagccccccacccaccttgagacatcatgttaaataaacctaagtgtgcttgtgggttaaatcacttctggtttggtttcctgtggcatttcagtatattaccaaggcccatatcttccatctaccacagagcagtgagcctatggcccagccacgatggccagga

SEQ ID NO: 16952 - DNA, 28203 bp, Human
aacctcaggcagccagtcctcaccgtcatcaccactcgtgccgagtcatggcccttgtggcccatgaggtgcagcctccttgtggctgtccttgtgtccccccatccttaccccactctatgccctgcctgtcaacccaaatttgccccattgagatcgcccaaggctttccacacatcaaaggcaaaccagagcccttcccatgcccctgggccttgggatctgccatcggctattccctgttccctgctttctaggctcacggcccctcttggggttcctcaaacactccagcgtggcccctattccaggctttggagctggtggtcgccctccttggaggaatttcacaagactcacttcactggtcaccaaggtctctactaaaacatcatcaaggtccctgctgaaacaacactctccctagaggccgtcctgtaccactctgccctcatctctctcagaccctccccggcctaatctcttcctagcgcttaacatctggggccccatgggagcactttgtttttcttgctggctgcactgtgtctagagtctggcccatggcagatgcttgctaaatatttgctgaataaatgcatggatttgcgagttgccatccacaatggtaaattcagcccttcaaagatgctcagcgctctggtccccacagcagcggttaaacccctttaagcagtgctgtgtgcagaagcctcttgggatgcagaggcctccgaggaaggaaacatgacgtgtcttttgtggagcgcaggctgtgatgagcatcttcaggctccccatcttttgtctgcaggagtagctgcagaattgaacttgggggctcagttacagggagggacagaaacccccaccagagagtatgtctgccctcttgacggtcacatgctcagcactgggcagagcctaccccttctttcaagtaaaaggagcggctgtgttccgatcactccctgatgcaaagcttctgaaaaggtttgctcaccttactgactaattaaagggaagccacatttttccctccctggtctctgcagccataccaccaagggctatttgataggcccacggcagcttgggttacacagatgcccgcgataatgccatttgctgcgatgattgagtcgacaaggctgagtgacttggggaaaatattccccgattggactaacctgttggcggcctgcttaccatcacacttgtttttataatgaaaaaggaaattatttctgcttttaatgatggcagctccagaaatggtgagtaaaatgggtgtgaggagagaagatgcttctcaacacttctcagtgttgtacagcttgccaaccacagcctgtttgggaggggatgttctcacccaggttccatctttcagaagccatttgcccacttattctttttatatggataaacgatgtaatttgctacatgctgataataaacagaggtatcagcaagaatgaaagccagaaaatggcccaacatgaacttcttgcttttctaagttactctttcaagctcttcttgcgatagaaatgaaatgaacatttttggcacagaactcttgtttagattttactatgatcttgggaaacacgggttgcttcaaatggcttactagatccctttggaatttcaaacgttacaacaggtagtcacaaagggaatgaaagcggatgatctgagtgtctgtgctgatgtgcctgctggagcccctgtggattttagcccttggaggaagcaggttcccagagcagccatgcctgatatctgggagagggaactagaatttaattgggaatcttctgctatttccctgcttcctccgccctctcagagttacagggaatgacttagaaaggtctctggtctccttggcattgtgataggtggaattctttcgtaggaaacacagccccggggttattttgatgcaagccgttggtccaaagccactccccactttgctatgtgggggaaggaccgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgtgagtaccgaaactacttatgcttatggtaggtgtaccacacgcacagggaaagaattgcgtttatgtgggacaggtgaaaacaatcgcaaaaaagcaatggaaagggctttgagagtaatttatcttctgaacaatagcaatatggcaacttctaaatggtgagagggagtccctctaaagcaatcgatttgaagattggttggacaaacaatgggaaagtcattgtcttagcagaattaagttcatactttttttttttttttttttttgctaattctagaagcttttctgttatctgctgtagctcagacgaaaatgcattctcaccagatgactgtttttggttaatcgatactgaatgcgctttgtgtggactgtcgaatttcaaagatttaccgtatgaccaagatgcacctgatgctacaagtataaataggggaacaaatgctttctgttcttcctcggctaaggaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccaggtaagtggacccaggtgaggactctgtgatttctgcccataccctcatgtaggtgaccaatgtgactgactgtccctgtgggggaaatatctccccagccattctgacacccacaggctggacacctgcacttccctagatctgcagaatctcagggagaaggggcattggagaggggatcgtttcgttaagccctttgctctctccctggagaccggtgttttcttctcttgttggaggttttcagagactggggctccacaattgtcctgtcaatcctgaaggaggtcagatcctggccaggaaatctctgagtcctccaggaagtcctgagaagcagtggccaccagtccctccgaaaactcaggataaactggatgtcgccaaagatattagaggcctagattaaaatccagcagcagatgacggagtggctcctaacaactgaaggaaaaaagttggtttcgtaaataagtcacaaatgcctgataaaacagtggactctctagcaacctatacggctaggatctttttgaccagagatagtcaggactggtcaaagggagctgtggggttgccggttctggaagtcagggcttggacgcaggcagattcctgacacattggtgctagggaggaaccacaggagctctgcctgaggttccagaaagtgggagtgggggtcaccctaatgatttcttttaaaccaactggaaaattggcttggaggaggtttggaaaggatgggaggtgggagaagaggtttcaagtaactgaaaagacacacatttaaaaatatggctcaaaattagctaagtgtcaatgaaagaaaaaaaaatcttgcaatcacctgactcccaaaacttacctggtttttatgtctgcaaagtctcttcctgcttttgcccgtatgtgtggtttcatgcacagtacagatataggcaggtgggttttttccataaaaggtttttataaattttttcttatggaatcacagtattccatcaagtagatatgcaatttacacagccatttgatcatagtttgacctatagttgttcctaatcttttataatataaataatatgaatattaatagcactataatattcctttctcttattttttgattattttgctatgactaagtagtggggaggaacaaaaacttttcctcgtaaatagagtaatgtattgttcattagaagaacagtttagaaaatacagttcattgaaaagatttttaaaaattacccacgacggcatcattactcagagataatcctattagcaatttattattgaatttcttgcctttttctatctatatatctatatttcctttggaagtaacatgtactatttgtattattttgaagcttttaaaaaattttaacaatatcaccttcacctttctatggcattaaataattaaatattttctagatgttgacaaactatggctgatgggtcaaatctggcccacccccttcttttgtaaataaagttttattggaacacagacatgctcatttgttcacatactgtctgtggctgctttcacgccataacagcagagtggggtcgttaggacagaccgcatggcccataaagtttaagtgctgtatttactgtctggtcctttacagaaaatctctccaaccgttttctatatcatcttgtcctcctataggtattccattatatgtgtacctcatttgttatttcacccgttcttttttgtgggtaatttggtccgtttcctgtgcatcaatattataagtgccattcttctaagtgtccttgggggtcgatatttgcgtatatctatggtgacattttaggataaattcctagaagtggaactgctaggtcaaaactttcatctgtttttgagctttccggtgtctaagtttacacagctgggaagtttacacagtttctacccctgtgactgtaggtggggggccatttcctttcacttcatgtgaatcattgtgaagttggcatgtagttatgtctcatttgcattgttttcatttctcaagaagttgaaagcttttttttttctttttcttgagacgaggtctcgctctgtcgcccaggctggagtgcaatggcgtgatctcggctcactgcaacctccaaccgcccgggttcaagcgattctcttgcctcggcctcctgagttgctggaattacaggcacatgcccccacacccagctaatttttgtatttttagtagaggcgggtttcaccgtgttgggcaggctggtcaagaagttgaaagctttttcatacttgtgcgccatttgcattccttctttggagaaatgctgtacatttcattgtttattccaggcaatgtcctcaaggaccaagcacagaggaggcgtggggcccctgcagtgccctcagggcagcctgacagagaagcagggcaaacgggaactgacacagcctttcgattaaatgtcaatctttgatttgacaatttggggtcattttctaaatccaacttaaatacagagcagctggaatgtgaagatgtcattcctggggttcctgcagatttctaagtataagacgaagggtgggcatccttatagaggagaattgttagtgtgcaggggatcgaggtgtgagggtggagagaggatcctttctgccagctcaccaccgcagatgggctgtcctggaaggacttggtctcagaccctgagttaaaacggccttcattatcatgatgtcattcattcattcatctagcacatttttatcaaggactactgtgtgtcccctgctgttctaggtatggataatgcagcttcaacaaaccactgagcttgtccaggcctaaaacacagaacttgccacggtctctcatcctccctcactctgcgttcctcacagcctccacatctgcgaagtgcagcttctatttccctgctcttcctccatctcctgctcaccctctcctctgcacactcttttctcctcgcattccatgtcttttcatcatttttgtcttcaaattctcttctttcttaggcagcctcaactgatattgatcatttcataatcacactccttattgccagagggtagaagttgtgagtctccacggtcaggcagggaaagatctttttagctcttccatgacagagctctcggctcaacatgtccaagactaggagaagagaggcaggtgccagtctcatcctgggcaattgtgtgaccctgggcaggcttctctcccctttctggattccaatcttccttatttttaacaaagacaacttgggcattcatgtatttttaggattgatgaggtaatttaggtgaaatggcctgctctccccaggagggaagagtgctagtgggaattctcctgctgcccagagaggcttatacttctggccaggcatctggacactccttacatattgtttccaccagatttgcctggttctaggggcaagaactgtaaagggcctgagatgtcaccctacttgcaagccaaaatttagcctgccacagtttcatgggtgctttggaagacacgagagtcctgggtcagagacaaaggactctattcctcacagtgcagcaaggggcacaaatatcctgtttgtgctggctgcctttgccttctcagtcccacagaggcatgtggagcagcctgtgtatgccgcacgtgcaggcagtttgcattgctgctgcatatcccagagttaagggaaccctcatctttacagtggtctgcaagcagacctgtgcaaactttgctctggaggaaggcattatatttgttaaactggacagtaaacaaacctgcctcttgctctggagggagacgctatctgtatcttccaaggctgtttgctctacacacattcttgaagagatgatctggaatgaaagctgtcagtgtctgtgcacagcaattgtggagaatggtgtatcaacatcctgtcctcggctggacatggtggctcacgcttgtaatcccagtactttggagagccaagtggggagaatcacttgagcccaggagtttgacatcagcctgagcaacatagtgagatccccatctctataagaaaaaatttaaacaaacaaacaaaaatcaacatcttgtccttgcatctcctctgggagatctcagcactacctctgcctgcaagccccccgtgtgggtttcaccccctcctctgcagggaaacagccttggaagttgggatgctacttcccctccatcttagtgtcatagggctgctgaaacaaagtccccaaaactgggtgacttaaaacaacaggaatttattgtctcagttctggaggccagaagtctgaattccaaggtgtcatcaaggccatactccctcttaaacccatagggcaccgtgccctgcctcttcctagctcctggtggtttgccaataatctttggcatttcttggtgtgtagatgcattgttcccatctctgccttcatcttcatgaggctggcttctgcctgtgtctcctcccatcctcttcccttcatgcatgtttgtccctgtgtcctgatttctcctttttgtttttgtgttttggagacggagttttgctcttgttgcccaggctggagtgtagcagtgcgatctcagctcactgccacctctgcctcccaggttcaagcgattctcatgcctcagcctcctgagtagttgggattacaggtgcctgccatcatgcccagctaatttttgtatttttaatagagatggggtttcaccatgttggccaggcttgtcttgaactcctgacttcaggtgatccacccgctttggcttcccaaaatgttgggattacaggagtgagccactgcacccggctgttttccccctttttataagggcaacagccacgttggattagggcccaccctaatgactcattttaactagatgactctgtaaagactctccaggccatctccaaataagatgccattctgaggtactaagagttaagacctcaacgtgtctttctgggggatactattcaacccatagcacatcccctcatcccccatggaataaccgggtcagaggtggagcaggtaggactgaactagagaatgtgccccttggtgggtggccctttccctaattaaggcacctttctttgggctgagacttctctgcaaagaggggagggggaaaggatagttaaatttgtaagtttcatggcactccaagtcaggttctgtggctttctgctcttcctttttctggttttcagatgcagatgctgttgctgcacagatcctgtcactgctgccattgaagttttttccaatcatcgtcattgggatcattgcattgatattagcactggccattggtctgggcagtgagtacaattcattatttagtaggatctcaaatacctagccaagtagttaaactttcatgagcgccccctctcatcccagcattttgctgctgcccagccttaattactggaggcaaacatccttttggtttgctgacttgaagttttatttgcccacatgaatgtaaagtcagtctggggtgccgcaagggctgctggccatgctcatggctttgtcaccaaggaacctgcccggttaggagtggccaaaggcagctgatgaaatagaatcctgcaggtgggagggaggcactgaccggggcagcggggagaagacaaagagacctattcatgcaatgcaggcgcaccagctgtttttacaataaggtgcatgtggcttttgagaaagtgggtcatttggatggagggtctctaatagggaacaatttttctttcaaatacctgaatcacaggtcagttcaattcgccacctgccccactgtgtggtccacacttcgttcactttctgccttcggtaagagaaaccaggaaggccgagcagttctcagtcaggactccttgctcggctggctcagcaggtcggccccccgccatgcagtttctctcttgaccttgagacctccagagtctaaattcaccttgcactgtggttcctgggccaggccacatagcgagataaagtggggcacagcagccccaccccttggaattcaaaacagaaactgggctgcaggaaacaggctgctgacagggacgcaatttcaatacaggtttcattattcacgggccagctccgcactgtgtggcagggggacagttgttagtgttgcactctgaaagagctgttggttaattcctgccttcctcccttttcccagtccacttcgactgctcagggaagtacagatgtcgctcatcctttaagtgtatcgagctgatagctcgatgtgacggagtctcggattgcaaagacggggaggacgagtaccgctgtggtaaggtcatggctcttcccctggggaaacagaaggaagcagcagaagccaaccctgacccttcccatctgtaaaatgggtccaagtcattgccatttttaggtcatgtcctcagctgggattgaactggcgtttgcccaaagacatgttgggctggggggtcagggagggccttccatggagctctggctctcttggggagaccacataagcaataagatgagaccagcgagaagtctcagggatccagagtcactgctctgtgatggggaggctgccgtggacaagaagtgggtcagatttggcagaggaggggtttgagctggctgtggagaaacccctgcctatggtctcagggttccactggccactaataagcctttctttctgcacatcggccagtccgggtgggtggtcagaatgccgtgctccaggtgttcacagctgcttcgtggaagaccatgtgctccgatgactggaagggtcactacgcaaatgttgcctgtgcccaactgggtttcccaaggtaagttaaagagcatttccaacccatgggcaaaacacagagaggataacaataaagaaagacaactaccatttagttgggcactattgggtgctttaacgctctcagattacatcctcacatccaccttaggatgcccgatatcatcctcacttcacaggcaagcaaaccaaggccagacaggctaagtgacttgctcaaggcacatgggaagtggcatgtttgggggttcccagggccaggccaggatcggagatacgaacatgcaataaaaagtttcaaagtagaaaacaaaaacaaaaccaaaaaaccctccagctcctcagcttgcagctcctagagtagcttcctggacactttcctgcttggtcctggcggtcacatcaatgtccatgcacgcttccccaagaaccccacagaaccaattgttgaaagtcagaaatttagtgaagacacaatcatccaaaacacttgtttagcaacatgtagaacaaagaactataacagttgactattcactttttagtgtttgtgttgcctacatgattttttgcattggagtgacacagttttggcctaggcatgggcctccttctctcccctggccccttccttctgacttcctgcggccgctgtacttccacgggttcccctagcagcctccttactcccctttgctctcaagtctcagcactcaaagcaggcaggctgcattctgctttgcactcaagtagatggggtcgttaaagccacactgccctgagtcctccacagagtctcagttttcaaattccatgaatcatattctcggctgtctttccccaaagctggtggaagccaaaatgccctccagcctccagccctgaggtctgcctccctctccctccacaccaactgagattcagaaatgagctgcaattcaagttcaatgagaagagcaaaaatcatccacactaacgtcttcaggaatgatgtattactccttagagacaaggaggaagaggtacacacacacacacacacacacacactgcacacagctgagagcttccccattgggcatttctcttccccgctgagcctcttcctctgactcattgggtggggggtgttggggggcctccttttctcttctctctgccctcctcctctgtcctggaggaccaccgctctgtctgagcaaaccccaaggcctctctgctctgttatgcagaaaaactcagctcaatccctctccttccccacccagcagacccaagtcaggagccccagctgtcccaggcatcaggtagaggccactcatggtgggggtagccttcccgtctctcttccaccccagcccgtttggtaaaatattccttctcatccttaatatgctccctctacaaggaaatccagggaatgcgatgtcccccatctctcaccccaatattgcctactttcttctctataggcttgttcttttgttctctatccattgcttcagtttctaagatttatttctgcattttgttctattttcttaaattctccttaaaatccttctttaatcttctctgctctactacatcctatgtcagagatctgtgattcaaaaataaataaataaataaataaataatcaaaggacggtcaagctagattgcttgggttcaaatcccagtgtagactcaggcaagttccacacacagttcatgcctcagtttcctttcttagaaaagagggatgataatagcacgtacttggaggggaactgaagttccgctgacgctgtgagtgtggaagggcttggtgggcaagagcacactgggcgagtgtgtggttgtggctgtcattgttaccattttgagacttggacagttcatggggctccagttgcagcactggggtccccttgcctggcacaagccccgccacctgcactggggccaagccatcccagcaaccatcggctctttcatgccagtgccagcggaatccgtgcattgagcaatccctggaagggctgcgaaggtcgtgcccgccgccttgattacattttcctcaaaactcaaagttgactgaactttgtattctacatacacacccccatagcatttacagtaagctgaagaaatcctgttgataagctggtgtgttcactatgaaaacaagcctactgtactgtgttttgttcatttcacaagggaaggagaacatggctgtttattcaccatcttccatcttgtgactctccaaacatgtgattcttctttaaaaagttgcatcactttcaccactgttctccagaagacctgtgtcctggcactgtaaaaatgagctgggctctggtgttcgtggaatcgctttcttgtttgtgttcatctctttccagtggggctctgcgctggtcctgggcaggtgagggatgtctctcctgttcctccaactcactgttcttggagaacttggtgtccctgcttgggtgccccccgacaatactgcacctagttttgtgctcacctcccctctggacttgcttcaggccaagcaaaaggcatttcactggaatgcgcaaagagtgactcaaccaaggacataggagatggtcactcactgtgtggctgcagcccagggtgggtggacggggctgtcaggtacaggccagaagcgggggtcatcccagaacacagcaggcctggactgaatgccttgccagggtgagtgaacttcattctcttggcaaaggaagcctttgatgggtttggggggacaaaatgacatcccccatgtacaatccctgtaatattgtgactcgcacatcggttgaatgcttcaaagtgtaaagttaccacgtcgggtctgtctttccgatgtgcttgcagctatgtaagttcagataacctcagagtgagctcgctggaggggcagttccgggaggagtttgtgtccatcgatcacctcttgccagatgacaaggtgactgcattacaccactcagtatatgtgaggtaggtggtcaggcgatgctgttgtctgcacaggtatcgagtcacctgctggatttgtgatgctatgcacaactccacaaggacttaagaggcatgcatgtgttatctcagatggaaggtgggagttggccaccttgatgagactggtggatgcgccaggctgggggtgtgagaacctgagggagtatggcccaataaagaaagggaaggaaatagagtagaagggtaacaatgctgtgagtgtgaccaatgtactgtcatgtgacaggcactctgggtgtgtctggggaatgaaagcaggcaagcaagaaggggggtggggaggaaaagaggaagggagggagggagggaggaaggaagggagggagggaggaagagagggagggtaaaaggaagaaaaacagaaattaagatagaaatttatccttctttgtttacgaagtattttagcattcattatttattttacatgttttccccaacaactcatggggaaggtaaaaccaggtgttcttaaataaccaccaggtaactgaaacttacagggaccacatgccttgccccaggttagacggtgtgtagcagatacagccaagagttctgaatccaattccatattctctccctgacatctaggcccaaaccctaagatgtgcattttctgctctgggaacagtaggcttgttggtctgtccgtcggggatgaataagcaccccgggacccacctgcagtctggagggacagctcatgtgttgggtgctaaatccacagtctggtgacactagctttctcttgcatgatgagctggggctcaaaaggcagaaaacattacaaagattttgggatccctttcccttcactatgagaaaagcacacaccctggtctccacctgtgtgtgggggtgggggtaggagtgtcaattttggggcaatcacactttattgctctggggaaggagtcctctgccagatgtgtgaacccaggctacaaggagtcctagagagcttgccacgctgtcccttgggcactcttgtgtccctaggggccaggaggtggagaacattgggctgaatcgccatgcaatgacagcgtgacatgttgatagaatatatctccttacacatcctttatcactagctatctaaagcttagaaatacagaacggcctgttgtgtacacaatacttcactgttagttgagtgttttacaatgaattgtgtgacctcatcctcatggttttttttttttttgaacatagactaaaattgtaatctatattcaaagagggggaaatagaatttatttttctgttaccctaagattgagtttttaagagtgttcctttcacagatctggggcatttttcacagagcctactttttctccgctttagggagggatgtgcctctggccacgtggttaccttgcagtgcacaggtaagagttccagaaaggcaggggtccagggggagcaagcacatgctaagtcctatctccttgccctcagagtcctctccccccatggggctctgtatcccttcctcctgggtgccaggcgggaactctgtgtacccctacctgctggaggaggggagcagtgtcatcctcacctgtcggcctcacctgtcaggtgggggagacagccagagcaactcattagcagcggacaggaccaaggcccatgatgtcccatcactctgaagagccttgagtccctgactcagttcccacttcctccttacacgtgcacagtgcccactccaggcctcgggcagtgcccctcgttcctggcagaggggagtgttcacaccacaagggtggggtctggagcagtcagggaggtgcgtgcaccagcggcagtgaggagggggctgcagaaggttcctgcctgctcctgacatcccagggtgttgtcatcactgggggaataggatggggagtggtgctgccaatgctgggcactgaccaagcagggcaggtgcttttcccaccgcatcctccacagcacccaccatcctcaggtctccccaagagcctgaccacctcccctgctgagctcccccttgcagcacttgtcttagagctgctgtgagctctgggagcaggggcagtgagggtggggagagaggagcaggtgcatggtggtgacaccatgtcccccaaagaagtctgcagggtggacccacaagcctttgttcccctccatagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgagtgagtgctgctgaccatcttcccagacccctgttcactcctgggtcatgtcagggtggggctgctttgggtggtgagaagcgggtccagagggaagacagagagactaacctccaagtaatgtacagttggagaggagtctccagcctcactgtggacccatcatcatcagctgggggtaacttgtgaccctgagcttgttttaaggattgtagctcctagagaaagggcagacagaagaggaaggaagctcctgtgctggaggaaacccacaaaaatgaaaggacctagaccttcccatagctaattccagtggaccatgttatggcagagacagggtgagacggtggtgcgggaggctagagggaatatgttgggggccaggtactgggtctcttcttaaaatctcaggagtttagagtgcaagaaaactacagaaaagacttccaaacacaatggttctccctgatatttttaccccctattttgttgctgtttgatgaacagtagtgcctgatagactccttgcagtgaccaatgttgagttcagccctcaaatgccaagacgacctcagaggtgctgagagtgaggtctgggaaacacatggggtgtgggtctgtgtttctgtagggcgtggcagtgcagttgcatatacagcataaacaagcagggtgatgggaccacatcttgcctgataacctctcccaccatcttcctaggttttcaggatacctgaggtcaatgagttcagtggttggacttttcctgtgcttcacctcttgctcttctcatttcagcttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatggtacatctgggtctctatgtggttctgcagctcttcctttgtttcaagaggatttgcaattgctcattgaagcattcttatgatggctgctttataatccttgtcagatattaataattccaactcctgattcatgttggtgttggcatcagttgattatcttttctcattaaaattgtgatgctcctagctcttggtatgacaagtgattttcaattgtatcctggacaatgtggctctcatgtttgcagacttgagtcctacctacattttcaatgttaccctgtttaaatgtagtttgtagatcctggcctacagaatgaatgcactgatgactctgccaggtagattggtgggctgtagttccaacgataattttagagccttcgtgggctgtgtgctttgtctggtgccaccttctccctgttggtgccaccttctccctgttggtgccacctggaggcagaaagagcttcttgaggccagaccagctggggcctctaggtggtggaagagagtcatccatctgtagggacaaagagcactttcctgtccaggagcctattgtggaggggtcactcagccagtgcctcccacctgcctggtttctccaggtagaggggccatcttggttgagaaacagaacctcccaggctggccaggtggtgtggtggagtcctctcatttctttacaagctgaaagatgctgggcaccctcagctccctggaagtacagaaaagttctctcccaaccagcagctcctaaagaccctgtttcttgaaaaagtcaagccctgccctctggacattacgaaaatgccagaagagccacacctgataaaactttcaaacatctcgtagatgcaaacaaagtactaggagactactcccaattaaattaaagccctctttccttcttaagaaagcagggaaagcataataaataggttaattccctcttattgaagcagaatcctgacctgagaccagctgcaggctctacctggcagagtcattactgcatccatcacatggacacgtaatgcccagaaacaaatatttccagagaagcaggaaaatgattatggtggtgccagtctgccaactattattaatgatattggttataggaaatgaggtgccagcacttgtactttgccaaagtttcaagtgagttcttttattccttctctacctctccattactgttctgcacagaaaagctcggggaacctcagggtgtgttcacacgaaagcccgaggtatgtgcagggcactctggctttgggggaggcccacaggatccagccctacacacaggcaaactcgtcgcctccagatatcccaggaaccatagcaatattcatggagccgtgttctataggcaacacccacactgtgatctagccaggagtgggcacgcgttggcctgagagcctggtctgccccatcgtgttttggtaaatagacattttactggacacagccacacctatgtgggtacctgttacctggggctgtcttcatgctccaatggcagccagagaccgcacagcccacgaagcctacaacattgactattcagccctttccacaaaaggtgtgctgaccctggtctaggttccctcacgctgcgacggtggagggctcttttacagttttaagtgctctgggtgtggtggatggggtaaggggctcctgctgtgagctgatcgttttcaagtaaccaagggcttgaccttccttcccttgggagatagtttgggctcctcagaggcagaagcatagatgagattgttttctcggactcctgcttcaattgagttgtgaactattgtttcccttcaagcagaaatgatccagcctgtgtgcctgcccaactctgaagagaacttccccgatggaaaagtgtgctggacgtcaggatggggggccacagaggatggaggtcagtgggctgaagccaagattcggagtccaggggctcagaacccagagggctgcggagggggctcccccaatgtcccattgtgatgttcccatgggctgcccagataccccggccagggagtgcatgtcagctgctcgggacacagtcagccaaggaactgtgggtcaggagtcacggttccattgttatggggacaacatgaccctgcagaccttctcaggagagagttagaccttctcgaacacagcaggtgtttccctttccctgcccggacccccggccttgttaactgaggacatacagagcccacctagacaaccctcccaggcttcattcagaactcaaagattcgtatttgtgaagactctttgtcttgtgggactttggaagatgtgttctttcatcctacaaagagcaagtggaagcagcagcagatgagatcgctgtaataataagggaagtaggagtggcagtaaccatagtccatgcaaatgaagcccgggccaccctttccttagtgtgggtacagagctggtcatgagtcttaggtttttccatcaatcactttctttgttagtaggaagaggattcattttccgtggctgccgtgacaaattatcacagtctgcgtggcttaaaacgatggaaattggccaggtgtgttccctcacacctgtagtcccagcattttgggaggccgagtctatgggatcccttgaggccattagtttgagaccagcctgggcaacatagagagacaccgtctctacaaaaaatacaaaaattagccaggcatggtggcatgcacctgtaatcccagcactttgggaggccaaggcaggaggattgcttgagcccaggagtttgagaccagcctgggcaacatggcaagaccctgtctctacaaaaaattaaaaaaattagcctgggccgggtgcagtggttcatgcctgtaatcccagcactttgggaggccgaggcaagtggaccatttgaggttcaggagtttgagaccagcttggccaatgtggtgagaccctgtctctactaaaaatacaaaaattagccaggcatggtggcgcacacctgtaatcccagctattcaggagactgaggctgtagaatcacttgaacctaggaggcggaggttgcagtgagccgagatcatgccactccactccagcttgggtgacagagcaaggctccatctcaaaacaaacaaacaaacaaacaaacaaacaaaaattagcctgacatggtggtcccagctactcaggaggctggggtgggattgcttgagcccaggaattctaagctgcagtgagccgtgatcatgccatcatactccatcctgggtgacagagtgagactttgcgtttaaaaaaacaaaacaaaacaaaaaaaaagtggagatttatttccacacgcagttgaggtgtctgtagggtggttttcctggaggctctgacccctttcctttgggttctggtggcggcggctgcagctgcactggcattcctgggcttgtagctggatctccagcctcagcctccttcctcccgtggctttgccccctgtgtctctgtatctcaaacttccctctcctgtgtcttataaggacagcaagtcgttggatttagggtccaccctaaacgctgggagatcttatgttgagattcttaccttaattacatctgcaaagaccctgttccaaataaggttgggctccatagtggcaggtaggcatattttggaggggcccacagttcaacctaacacaggaatttcagtgttttccactcaacaccaattacttgagcccacccccagctgaaggcacccaggagctaacccggatgcttcgagtctgtgggcctacttaccccccacccactggcagtgctgcccacctggccgagggcactcacagctctctgtagtttccaacccacccacatggcccaggcccagttctgtgccagtgtggctggtccagggcctttctagcttcatcagaaccagcacccctggtgtgtggtgggagctgggacaccaatctacgctccccttcctctcatggtgggctctcattccggaccaaccagcccaccagagtcattctgatgacactgggctctgaagaggaggctgtgcaacagcttcatcctcccaggagattctccatcccgctgccgattttcttctcgctgtcaatctgctctgtccagtgcaaaaggtccgacgagcccctgtcctgatgtagcttcagctccagcctgtcctggaatcttctcccataatgcattgagctgtttcgccacgttccgggcaggaagctgagtgtcttgtgataccatgtgctcctcagagcagcccctcagggtcctgtcattgtgtgattttgttgtctccatggaatctatggagtctttaaaacaccaagatgcctgggtcacaaaccagctgagttggaggggtccatccctcggtgtcgggggcgtgcttggcccactgcacgtggattaagtctcctgtgactgttgcaacaaacgaccccaaattcgtggcttaaaatgacagaaaggtatcatctcatagttaggaaggtcacaggtccaaactcagtctcagggcgctggcgtcaagtgtgggctgtgctggctcctcctggaggcccttggggaatctgtctcctgcctttcccagcgtctgcactctgcccacactgcttggctcgtgcccctccttggtcttccggggcagcaatgccgcatcttcgaatctctctctgactctctgactctggtccctgctctgtcgtcacagcttctcctccggctcctccaaagacccctgtgacttcgtcaggtccaccctcttacttgggatcatctccccactcaaggcctgtccctcaatgcacctgcaatgtcccatttgccctgtaaggtgacacagtcacaggttctggggattggggtgagaatgtctttggggtcatttttctgctgaccatcccagagttcacaaagacgctgagtgagtgaccctcctgagcctcagtttccctcccataacctggggtgttctgatggctgattgggctggtgccctggggaggtgtcttggccactgttgcccctactcctcctcctctttggacaccttaggggagtcggtggccctgccttgaagcagactggccccttgcggccactcgtaggagggcaagctcgggcttgaggtgcttcgagacagtgggagtctgctcgtcccacccgcagggccctgtccttttccgctgttgcgtcacaccagagagcatccccctcgtccctcgttccctcacccccctggtctcagcatgcgccttctgtgttttgggccgggcttccttctcacacacatcccctcactcactttgaagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccaggtacggggccgcagcggtgggcgaggccgtggcagggtgacccagcccttgggacaggtcgttgccagcgtttccctgtgacaggacaaaaagtaaatttacagggcgtggagaagaaatttgctcaagatatcactccttttcctggctgccaggcctgtgtttacccagtgatctggctctgcgtgggtgctgggtggtgggaggggactcatgctgctcccctccaattctgactttgtgggggaccacaggggaggcaggtggtggggaggcaggtggcggggaaccagtgaatctggccctccgaaagctgcagtggctgggactccagttctactaggtggatcacaggtcacctgagggccctggccaggtggaccctccctctcaccagctgcccttgagcttcagagggtcagggtctgcattctggaagggacacacagctggaggcagcaccccaaaggggccgagggacatcctcccttggggatgctgtgtctggaagggctggtgggttcccttctgtaacctgggtcatccattgggacatcatgaaggggggtcccaactccatagcaagcagcctcacacggcagactgtccacagaaagcaatctcgcatggcggtgactgtcccccaatctttgcttctttcctgtcacccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggaggtgggtgcggcgccctccccagctcacgttgtccctggcttttgaccctaaggtcccttaaatgcaaccctggtcttgctataaaaaccagggcgtgacccagtggttgtcaattcagcagcagtgacttggtggctccagggtgtcagacgcttgtgctgaaaacagagatcacagctagtcctgggcagctctgggtgggtgcagcctggcaggcagaggagctggggcccgggaggaagaaggagcctcacgacatgggaaaggaggaggcagcgaggaggagcccctgctgggatggggatgggtcgggcgtgccccgtgtgccaggagcagggagaaagtgggagggggcggggggctgagacagtgcgggagaggaccttgcctgcctgctgaggggctggaacctcgctgggagccagggatgagaggcagcagtcaggagaggcttggggagctctgcattggtggtgtgggggggtggggggtcccggagggggaggcgtggaagtgggaggggcctgcaggggggcacccaacagcgaggctggcttggcaggacccgggcatggaggggaaacctgagacggtggaggaggaagaaggaggcttagggcttcgctgggaccctggcagctgcgtgctggcaggtgaacacggcgcctttctcatgtgggcgccggggaaacatttgctggcttgatctcagatgaagtctctccttgggatggtttcaaacacaggaggtcctcacttaatacggttgatgggatcttagaaactgcagctttaggagaaacagtgcgcacaggccctccagcaacgtccttgcttgcaatgtaattttgttataaagtcgatgagaaaaaaaaaattggtttcattatatatcattttgcttaaagtcgtagtttccaagaactaacaatgacgtcaaagtaagtacgttttttttccctaattcaagtgaaatttatataacatacaattcaccattttaaagtgaacaaccctgtagcatcagcacattcacagggctgtgcagacaccacctttgtcagttcccagcattctcatctcccaaaagacacgcggcaccctagaagcacgcagttactccccactccacttttctccccagcctctggcacccaccagtcagctttctgtctccaaggctcaaagacctttttaaaaagctcatttaatttgaaacaattggccaagaaaggacatcaaatgctgaatgtgcctcaggcgttaattcccgttttgctctcactgattttgtgctttaaatgagaaactaaagaatggtgcccacgggcacagggtgaggcctgggactgagacctgggctagcttcacctccagcactgccgccctgcagccctgagcaccccctcggggcgtggtgagggctgtgctcgggctgggtggaaagtgcttgctcctgctcaccttgctgggagaggcagcctggccccatactaggcactgagtggcctgctatgctcttcagtataaagctcagcccagcccgcccgcactgtagaaaggaccaggatggacaactgaatgggagacctcctcactgttcagggtgctgtgggagcctggggggcacagaagggtcgcgtgggcacagagggcaaagggcaggaaaggagaagccggtcctccacacgggtctgcagtacatggaggccttcacgggacacagatccccaggggctgagcactgagctggtgatcctaaaagtcccccttaagacactgaaggcgcaaggcagagaagcccaccgccgtgtcttccagctgtcgtgggtgagctggagacaaacgttcaaaatcagtctggggagcccgctcacaacggttccatgacggggccacctcagcccctcccatgtcagcaccgtcctgggccacagagcctgtgaccctccctgtactacagcggagacgacctgcatgaggcccccccagctaacaagggcagagtgtgcctcacatcagatccccgacgtggccccagtgtgactgcacagcagaatcaacagatctcaaacttaggggtgcagaagcctctctcaggatgtttgttaaatgtgaagattgcagggcgtttatctggagtctgattgggaggtctggggtgaagaccctggtgaatgtgttgcatgggggcttcagggcacactgagaaaccctgggagggtcttggaggcagtttcccctgttgtggtgaagctgtggtggaggagctcgtctgtgacgctggctccggcgatgcctggggcccctgctccctgcacaacgccttagtcatccgctgcctccaacccaccagtgcatgcgagagatgcgcagcctcagacacgccctttcccaagtccctcttcagacgtcctaggggagacccagaagagacttcctttcctgggaggctttccagcaggcccgctgtgcgtttcagttgtccattgtgaggaaagtcaacgtgagggcctttggaagactcactgtcttgcggggaagtgtcccgtgtgctagttggtggcatgcccatggcctcatcttcattttcatccagcacttttctctatctagttgggggtttaaaacaaaattgttgtgactcaaaccagaactcaggaacatagtgccgagacctggaagtttcctacggaagtgacggaactgtcgcagggcggagatgggacctgcggatgcattgctggttggagcttttcatgcctgcctgggatccactcagagctggcagccccagggggaggccaaccttgtcttcatcgtggagaacagccccacaattcccacagggcaaaatgcaggtgcccgctccgtcatcatgttggacggatggctggaagtgctaaaaacaataacgcctttgttttcatttatagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgagatggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcattgtctggcgtgtctgcgtggactggtgacgtgaatcaaaatcatccactgaattccaggggctccattactgtcatctctcctgtgtgcgttgtggacttggcattcttctgtcggaacaggttgctcagcagatcagcatcagctcgtgtcatacacagaactcaaaagtagagcaaggccaggcaaagtagtgggtgtgagcggtggccggagggagtgagcagtggccggagggagtgagcggtggccggagggagtgagtggtggccagagggtgtgagtggtggccggagggagtgagccctgtacagagggagttagcagtggccggagggtgtgagacctggatggagggtctgagtggtggccacagtgtgtgagtggtgtccggaggaagtgagtggtggctggagggtgtgagacctggatggagggtctcagtggtggcagtagtgtgtgagcagtggccggagagtgtgagtggtggtcagagggagtgcacggtggccagagagcataagtggtgactggatggtatgagcggtggctggacggtgtgagccatggccggaggttttgagtggcacccgaagggtgtggccggagggagtgagctctggctggagggagtggccagtggcaggaaggtgtgagcaatggccagatggtgtgaggggtggtcagagggagtaagcggtggcttgagggagtgagtggtggccagagggtgtgagtggtggctgaagggtgtgggctgtggccggagggagtgagcagtgatcagatatgggacctggacggagggtttgagcggtggctggagggtgtgggcagtggctggagggtgtgggtggtgactggagggaatgagcagtggccacaggatgtaagacctgaacggagggttggagtggtggctgtagtgtgtgagcagtggctggagggtgtgagtggtcgttggagggagtgatccctgactggagggactgagcagtgaccggagggtgtgattggtggccagaaggagttggcggtggctggagggtgtgagcggtgtccggagggagtggatggtgtctggagggtgtaccaccaaggacgcctttctgatcgtcctgcgtccatgctcagtcctggatctcctcttccctttctgggtgtgtgtggctctggaagaagctggctaacctgacgaggttaccgccctactgtcaccatggaagcatagcgcctcagccactctccctggaggagcctggcctcacactccaatcattcccctctccttctgggttaatttgaggaatgtggtcccgctccatgctgtgggtctgtgcctcaagttccctggccaggaaagtacctgcctcctccaatacctgaggaccccaaccccagggcctcagctgggtgtccttgtaaagggtccctggggtggcagttgcttttttgaccagaggcctggcaggaaacgggcttcaccacagcggatctgggcaatgcgaggagagtgaagactgtaaaagtctccttgcggctggtaaaccccccaggctggggcaggggggtgaggggtctgctctggggcctggggaagatggtgtgtggagaggacgcccacctgggctgtggctgagagggggacgtggcctgtcccaggtgatcccaggagggatcctggaggagagccctggatccacttcctcccaaactcctccctccctccagggccacctacagaaccccctcctgccaaggcacaggtcaggggcagcgggcaggtggggagcgtcaggaggagactgactccccaactgcgcgtcccccttgtggggaatctgggcggctgcggggccccccactgaaaatgaggggctctcgccagaccgcagggaggtcggctgggcgcaggaaacaagcaatgcctgcacagccacagacgcccccacggccatagatgcctgccggagagggtctgaggtgcggagtcttcagatgt

SEQ ID NO: 16953 - DNA, 28203 bp, Human; identical to SEQ ID NO: 16952

SEQ ID NO: 16954 - DNA, 28203 bp, Human; identical to SEQ ID NO: 16952

SEQ ID NO: 16955 - DNA, 47752 bp, Human
ccatacacagaatgaattcaaatggatcatagagctaaatatgaagagcaaaagtagcaaaacttctagaacaaaacatagatgatcttcatcgatgttggattaacaacaatctcttgaacaggatgcagaaaactctaaccagagttcccacaaattgataagaaaagcaaacaccctagtgaaaaaaaaaaaagagcagaatatctgaacaggaacttccccagagaggatattcaaatgggcaataagcctgtgaaatggtgcccaatatcattatccctcagggaaatacaaatgggaaccacagggagatacaactacacaccacccccaccacagagtggctaaaattagggactgataatattaagtgtgcatgaggatatagagctttgtacaactgcttggcagttcctaatggagtttcacgtgctctgtgatccaacaaccccactcctagatgcacacctaacagaaatgcatgcacaaggcactcaaagacacatacaagaacgtcctcagcaacattagttacaatagcaaaacaaccgaaaacttcctgaatgcatatcaacagagaaatggataaatgaattatgttatatttattttatttatttatttttgagctggagtctcactctgtcccaggctggagtgcagtgatgcaatctttgctcactgtaacctccacctcctgggttcaaatgattctcctgcttcaccctcctgagtagctgggattacaggcatgcaccaccatgcccaactaatttttgtattttttagtagagacagggtttcaacatgttggccaggctggtctcgaactcctgacctcaggtgatccaccccccccttggcctcccaaagtcccaaagtgctgggattacaggcgtgagccaccacgcctggctggtatatttattaatcaaatactacacagcaataacagtgaactaactgtggctacaagcaataatgtggataaattttacaggcataatttgaggaaaaagaaatgagatatgatagagaatatgctatatggttctatttacataaggctcaaccacaggcacaattcatatacaagtgatacagcagtttactttctgggggagggaggagataactggaggaggctgagctgggggcagaggtgcatctgaggttctgagaatgttccagagcaggctatctccaccttggcactagtgaaattttgttggggagactgtcctgggcactgtgacattcccggcctctacccactagtgccggtaccacgatgtccaccccacccaccaccacccccgcctcattttggaaacaaaaatgtctccagacatttccaaatgtccccttgggtggaggaggtacaaaattcccctggttgccctgtttgattttgggtcgtgggggaattaggggtgtgggctcatttatggaaattccttgagctatacacatatgattcatcaacttttctgtacacatataaagcttttaaagtttttaaaataaaaaaacaagtcaatgaatgactgaaagaaccagtaagttttccagcaatccgagacaatagatagagtggggtttaatgtcttgttcacagacaaggagactgggatccagggtgggtcagggcagggggccagcaggatccaggagggaactcattccctgacttctcctccgcttccttcccccatgctctcacgcattcttgctcccgaatactagccaagtccctacagaggctgatcccgtgcaggggctcggttggacctttagcctcaaactcccgtggtggaaacagttaggattggtggacgctgcacccagcatcctgcaaacagaattctgaaaactgatatctcatgcaaacaggatatcaacttttgtcagaaagatcaaaaagagcttgaggtttttcttcacagcctcagccttgcctctccccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgtgagtactgcccagagaccccggggcccagccagtaaggctggtgccagaccctgctgcggcccccggcatggagctgcaggggtgtagggtacggcttcctgccaaagcagtgcaccttgcagggtaagacactgcctcttcacagggccctcttctgcttctcgtaaatgaggtgatcttgaccaagcttgtccaacccacatgaggcccaggacagctttgggcttaagccatcatcccacctcagcctcctaaggctgccctgttcaatttgtgttggctgcccaacacaaattggtaaactttcttaaaatattatgagattttttttttagctcattagctattattagtgttagcgtattttatgtgtggcccagggaggcacaagaatacccctgatattcttgaccttttaaagaccagctcggctggctgactgggggaccctgaaatttgtgaaaatcagaagccatgtattactctgggtgccccattttgggggtttggaggagattggggcctggttgtaatctctttgtgtgcagctcagtgactctgaaagtggcgtttcaagatattcaaactctaacgtgaaaggccccaaagcccgctgagtctctaacactgggaccaactgtcagcagggctgtgcttccacgctgcccggggaaagtcacttgtcctcagagacaatcccttgagtgtctgataacgaaacaaatgggtaggaaacttcagacacagtgtgagcgcgaccctgcttacccaagggaaaggcctgcatgtggaagagcttagccttcagagttaccactctcggagagggaggccacgacaccaacattgggttacagctttcatggcaaaccagtgccttaaatctgacccattcattttttcacatggaaaaatgtatcagaaacacactttaaatctgacccattcattttttcacatggaaaaatgtatcagaaacacactttaggtaactttgggttggggaaggagctaaactttccttccacactataacaaaagcttggccaaattgggtgaagtaactctgaagctagacaaacccatttcttctccccaaatcagggctttgtcgtcactgttatgttcaagctaagccaggggcctttgaatggggagtggggtcaggcatgtgcagggcggccaccgggcaccgtccaggcattacagacaaggcagcttttgtccactgctcaccacccagtgcaggcaggacactgggcccagagagtgcattagtggcggaggtggaacccgaaccagctttccatgcctttgaaggagtccacgctggattttactactaaacgtatagcatggacttctactcaaaattccttccagtttaaacattaagcacatgttggaggaagagaaatgtgtgttaatttccccacaccagagcacctcatagtaagtgccctgcaccaaggctgccttgttcaaacctctccaggtggccacagccccatcggtgcccacccaaatagcagcattcggcatcatgtggtgggttcctcatggacgcccgctgtttccagtctgcattcctgataaattacctttgctatattccattctgtttcatttggtccagttctgcccaattcaatgcaatgtacttacgtcccgggttaccgtgatgaataagactcagtcctgtgttcagggagttcttggtctagcaggggagagccgtgggtgcaaggggactgtgtaagccgtaacaagtgcctgcctgggtgctttggaaagggctgtttcccagcagagaggtgtgggaggcgagcctggggatcagggtcgctgatgctggggtgaggaaagcgtgtgtccgagccaggggcacgttccgcagggtgggtccatttgatctaggcagtggggggggggggggcaggccagggagagggattgcaggagcgggcggaggtcaggtcctcagccctgagaccccgtgccaagggctgaagcgggtagccagggaaggacagtgagggggaggtgtgagctggtcagcattgtccaaaaccacgatggcagcactcaggggacaggcgctagaacttccagctggaagttcagcatcaggccctcttcagagcaccccccaaagatcctgggtgtgcaaggccacaccctgcctctctgacccttttcccaagaatgggcgacgtgactttgtgtctgtgtctgctcttctgcaggctgaaagcgttggcagccacggggaggaagacggcggaggaggccttggcctggtgagtgcagctgcttctgtagacccaggggcgtttgggctgaattccctgtgcctaaggactccctcccaccagggctgataccaggaagagccgggcgcctctgggtgggatggggccactgcggaagtgaaacaaaataacctccctgcctacccatagtgcactgagggaggggcacagggctttggttaaccatggaaagagaaagagagaactctgaacaaggctttcttcacttacaaacctgattcaatccaatttgactgccaagaagaacaggttcatgtgctttgttgagtaaatggggaagacatgattgttgtgttgtgataagcacgtaaatgagggtaattgttagaataaagtaattaggttaaaaatggtaacatttgggtttatattagtactgctaatattcagcctatttcagtaattgaagagcaggctgggattttgcatacttgtgtttgattatgtcctcctcaactgcctactacgatggataagattgagatagataggaggatgtttgtgtttattgatggaaagatttgagacataattgacatctttgctgatagagactagcggccaccatgctctcgggctgcctctgaggggaagggagtttactggtggtcatgaagccaggtgtgtgggtctaagggtgccaggtgtgtgggtcgggtgagggctctgatttgaggtgacctcaccaggtaccagctgcgtgagtgattcttcaagccacccactgccatgggcctgttctctgctctggggatggagaggagggccaccgtttctctaaaaccctctcctacccggatgtgctgtggggagtccttcatcctctgccctgagatagccacggggaaaatcaaacaataaaaaccaggtcctgggaggctggagtgtcctctccaaagcaggagggcagatactgatcctgggtctctgaacgtgcagtgttcccaatgggatgccccctcctcctccagaaagtgtaggccacgggcaaaatgggcaaccccttcacagagtccactaaagccagttgccaattttggatcagaaacaagcccactgctgtgaagggcatggccagcacctgcccactgcaacccagtcaataagactaggaaccccaccaaaaaatagggaggcaatggggtcccctagactgtcaagagcaccccaacctctcactagtaaccagggaggtggtgcaaattaagatatcattagagcaaacaaggtaactccaagtgttgatgagggtgagggaagcagggcctcacacgtcactggtgtcactgaggaaggcagtgctgggtatctgccaaccttggcaatatgcacagcccaccagcctccgtcgtgcgtctaagcagattccctggagaaatgcaaggagcctaaagagacatgtacaaagatcttgattgcagggttatgaaatggttttaaaataaaataatttagatgttcatcaatgcgggaatgaacaagtgcaacattgtatatgtatacatgaactattacacagcctttaacaaattcgcgctgacaaacttcactagacacgtgtgtatcaacagggattaattgaaaagacatggtagaggaaaaatgccagttgtagaataatttgaataacagcttatgatttatgtaaaacaagtgctatctataagtccgttacttaaatttctgggagaaggcaaagcagcttcaccctctgggtgaaccctggaaagggggagggtgggaaccacgatggagaggagtggcaacttcttctgtgatttttattgaagagaatatggtcttgcgtaagttctgtttcctctagtgattgaatactactttctaaattgaaaattatatcacaggcactttgctgagtaattagaaattcttccaaaccatgatttctaatgaatgcacggtaaatagatttgctatcagttatggagtttttcttctttcttctaaataaccctaaataaccttctaactttcttctaaatagccctaaatagatggttcatgtgcaaagttttgcctatacagtactttgtgctctttcctcgggagaaatttctggaagtagaattattaatgcaaagagtgtgggcattttaagactctcaatacctattggcaaattgcttcacataaaagttgaaaggtctgtccttaagtcctgctgcatcttttacacattgagcagaacttttatcctttttattgaaaaaatctttgtgaacttgacagatgagaaaaatgccgtctcggagctattttatttccatttttattgttagtgacaatgaactcctatgttgggtcatccgtcgtttttcctttaatttaaaataactgtctgcctgaaatcccagccagtcaggaggctgaggcaggaaaattgcttgaaccggagaggtggaggttgcagtgagctgagattgtgccactgcactccagcctgggtgacagagaaagactccatctcaaaaataaaataaaataaaataaaataaaataaaataaaataaaataaaataaaataaaataaaataaaaactgtctgaatctaaagaaacgcagcagctacctaaattttgtctaggtttttggttttggtttttatatgtaatttgaagtttgaggtaaaatacaaatgtgaggtttttccacaaaattttcccacaccatcaaggagatgctgggcccacggatcattggaagaccaggttttaggtcttgctgtcaactttctttcattttttctacctttgactttggaatcagactaaggtgggtctgagagcaggacttacactgaccaggtctgtgccacacacagctgtgccgcagtgcctcccaccagtaggatggctgtgagattaatttatgtcatgagcatatatgatgtcttcagtgtgccctataattctgcattgctgtcattgtcattctgttgtgtatcctcaaaggggaaaactctttttgttgtgacagtgggtgatgccggcttgctctctgttgcaggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacggtgagtcaacccagtgtgccttcaatgctcacggcagctggaggcatttttctgtgctaactaggccatgatgggacaaagttgacttatttaaatgggatagtccagaactgcatcattagctggcaccttcatatgagctgtcctttattttcctctttgccttcatctggtcaactcctattaatccttcagaacccaactcatttatcctctcccctttttgagtcttctccagctccccaggcaaaaggagttgctgcccattttctcgttcatgtgtctagtggcacttttgtatcatacgggccatgtgtctggtgcagcaccgcatccctcaccagaccgagtccctcaagggaaggcagatacctcactcatctttgcacccccagaaactagcacagcccctaaaacagagtttgtgcttccaaaatgtgtggtaagtcaactcaaggatgggtgattgttggctacccacaaatgcagaacttttccctgtctcagggaccagccgtctgattcagaaaaaaaatggcccagtgggtagctccacagcaaaacacaatggcccagcaggcagctctacaggggcaccgggaagacaagaagaatgtgggagctgctcaggagaaaagaaggagaagggagagacagacagccactgctctactcagctccgccagaggggcttaaggaagggcacacccacttctgctaccgcggcctggccccaactctgctgttggcaaactgatttgttccacccatttcaaggaattccatcagggcccaaggaaccctccattccaacaccaggcccctcggtgctggatggaaaggaggaatgcaaacctctgaagggaaaagatttctggaagatgtcccaggagaagcagtaccttccaaagcctccaaccaccaccccggattgcccgagacttgcagggatccccagagcacaagactaaacctggaaaagccccagaaaaatcgagagagttttccccctacatcgacatcaatggtacttgtgacaagctgactcccttctggttcaccctctggagccaacggggaaaggcaaggcagcccaagccatgtgacacagctcagaaatcagagcaggccttggccccccactccttccccagcccactgaggtgcaagcacacacacacacacacagatagacacagagacacacacatagctcacacacatagacacacacagattgacacagagacttacacatgcacacagatacacacacatacatgcatacagacatacatagatatagacacacagacacacacagatagacacagagacgtacacacggcacacacagatacacacacatacatgcatacagacatacatagatatagacacacagacacacacagacatggagacgtacacacggcacacacagatacacacacatacatgcatacagacacacacagagacacagatacacacagacacacacagatagacacagagacgtacacagcacacacagatacacacacatacctgcatacagacatacatagatatagacacacagacacacacatatatacatgcatacatggatacagacatacacagacacacacagatagacacacatacacactacatgtacataggtacacatgcaaacagatacacacagatatacacacacaggaatacacagatacatgcacatagacacacacagacacacacagagacacacattagatagacacacatgcacaaacacagacatgcacatacatgcacatacatagacaaatgcacacatacagacacacacataagcaccacatgcacacatatgcacacagatacacacatgcatacacacagacacacatatagacatacgcagacacacagacacacatagacatacgcatatgcagacacacacacagacacacacacatatagacatatgcagacacaaacacactcacacacctccctctgtcgttagctcctcccagtcccccaccccagttctggcctggccgtggttagtggagctcccctcacaggcagaagagtgtaacggagactcactgtgtaccttgatgctgtaaaatgaaaacactaatcttccgaagtgtgatattgatcacagctacacttataacatgactattcttgaaaattacatatctgaggccaagaaacacaatgtgagacggattcaggaatggacatgtgttcactgggtggttttgtgttgagtgccgttgagggttgcagagaaaacagacagggaggaatgtcaggccggcctgtccatggggagacggaagctgcattaaacactgtgatctggcctcatacttgggcttgtaagaagcactgtgggaaattccgagggcagcccggtgctgggaagagaagggatcaggccaactcccgccaggagggtgtggtgtctgggtttcccctgtggtccgatgtggccaatggcactgggaaggttttcaagcccaggaagcagcctccccagggcggtaggcaacaccgagcccagatgtcaggagaggctgcgtctggctggaggatgggggtgggagccccgtgggcaaggctgtcgggccagcacctgtcgggctccgtgggcctgagggattctccaggtgacagagagcctgcggcctcaggggtgggagctgcatcagaaagagggtcctgcagccactcagggggcatcagggaggccgggccaggggctgtgcaggctcaggtcctccagggagcagaccccaaggcagaattcccagtgcaggagacgcacaggggagagactgctggtgaaggcaaaagaggaggagagggttggaggcaggcagagcctcagtgccttagaggagtccctgtggaacccgactcagtgctcagccgtggaagagagggtggccccgcagctggaagtgcagctgagtcccgctcactacaggctctgagcagtgcctgggcagccttggagtctgctagaaacctccagaagccaaatcatgcaaacctgagcaaagcagtgtgccatgggactgaggaaagggcctggcaggtgatgagcacgtgccatggagggaggggatgcagttcaacgaccaggggatttccaacctgggcacctaaaggagactccaacctgcaaagaaacttacctgaaatatttgaaaaaaccgaggtccaggtatagaacaaatccataaccccagacacaaagggacgcaataaattatgttacagcgctttgaacagaaaagaatctcactttaattgctgcctgattgttattaattaaattaatagatgacttctgatgagaggtgtggaaacacaggctctgtctctgtccccttagtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggtgggcagccctggccagttgcaaacacagggctggattcacagtgagtgagccctctgtggcagggactagcccccggcacatggatgcagtgggtgggttccaggggagcagagcccagcagcaatggtgggatggctgggtgggctttcttccgggctcagtggctgcacctgtcctcacccaggcacttccgtttcccgcttctggattttcagccaggtgcctggacatggccctaacctgaggctgagcaatttaactagagcctccttcgtgagccactacatccttcaaaaatgtaagccattagaaagcttccggaccagctttggtcttctctttaggcgggaatagccttgttctcattatgtggtttttaaaatgcttagctatatgccaacagcctgggaaagtgccccagaagggtgtgccaagcatcaagcctgagtgggtgactgtgacggggttggaggctggtgcacacagggagtcagggcctccccaccccagccttgagtgggagacacacaagtcctacgtgacttatttctgtattttcagtatgagcttagtgctctctccttggcctctccagggaaagattatttagactcatattcagaatcatcaaaattcccttctctccaaacaccagccctggcctggagaccaaggctaccattggggtttagtggaaaggattgtggacttgacgtcagaagatgtgatttttttctgtgtccctgatgagtggcatgaccttaatcaagtcatgtccactctctctgtctctttttctttctctacaaaacaatgagggctctcactcttcaagaacaatgttgcctgagtctgtggcccatcctgccatagttcccgggacacagaaggcactcagtattgctgagatttgccgactctaaaatctgacgaggccgcagtgccttggtgggagggctccccactttctctctctgggagcgtgtctgtctgtgctcagacatgtatgaagcacagatcctggcctgtaaatccatccctgaatcctgggcttccacttggatggcagcttgtgagtctggagatcgaatctgctgaataattagaaagtcgcccccggtctttgtggattagtatcctttatcaaatgatggctctttcacacccaggccctcccccagtgaacctcattggcagcatcttaaaaacaggaagactgaggctgcaaagggtgaagggcctgcccaaggtcctgtggtgtgtagagcggtgtcccctaaaaatgtttgtccaccaggaacttgggaatgtgacctcacttgggaatagggcctgtgcagatgcgattggttgggaggaggtcacactgcattagggtgggttcccgtaagggtagaggccgcacagagacacagagaagccatgtgccgactgaggcagagactggagtgatgtagccacaagccaagggacgcctggggccaccggaaactggaagaagccaggaaggacccttcccaggagctttcggggagagcacagccctgccaacaccttgattttgaacctctagtctccagaaatgggaggcaatacatttctgttgtttgaaaccaatctagtcccctaaccaggctggcggagcagggacctgaacccacctctgtcctgctccatgctgcctgggttcatgctgggcagccccacttcctgtgggagccagcgttgacctcacatctacgccccgaccctaagcaggctgtgtcctgcccttccatggcccatgctctcagcctgacaccgagggggtggaggggactctctcagtgatgagtgaccagtcactgctctgaagtggccgaggtccctcttggggcaaatgcatgaggcccccttgcccgcgttggtcctccccagtgaaacgtgcccataggcacaggtccgcagagagaaggaaacgcaaggacccgttcagaagtcggtgtgactcactctgacgtcagcaacctgcagtgggtctttcccaggccacactcactcgcatggcaaggcggtcctccccgactgctaaaaacaaaagtcaggaaaggaatttccccaccacctacacactcatgctgctccccaccacctacacactcatgctgctctgggctgtgcagcctcagtgccccagctttcctagagaccgtgggagcttcccatttgcctctaaaggctcacctctcacgtgggagacagcagtgagccccaacttcggggctccagggaaaggcttgcatcaaccttgaccttttttagggggtgagcagatcctgtttgtaagtgccctgccgtggagtgggggcagggtacgtctgtgcaccgacacggcgtctctagcaggaaactttaggttaggaggctgatttcccactgcagccttggcgagcaggcgctgccgtcctccagcagatgctgctgaagcagaaattgggcaggcccagaggctcagtcaaggtcaccctgcaaaagggggcaaagtgcagcctaaaactaggtctatctgacaccaaagtttgtgttgttcccgtcaagacacagaccgcctccctaggacataaaatactttgtggctcaactgaaatcagatcctggctgctttggtgatgccagctgctctgctcagactgacctgagagcccctggcaggaccagggagggctagggccacaggggcagaggacacccaaaaagacctgaggctcaaccactcccaggacttcctgcttcaccaaaacaaggtgaaccttaaagacactgtgtgttttatagttttgttgcctaaagagttttcttcttgaaactctacgattaaacaaaaagccgttgaactggagctcgggcctgcaagtccaggccactgggtaacgtgcacaccccggggaatggaggagccgtttactctgtgcatctgaatcgtgcattcgggcagctagcctgcaaaccgataggcccccgagaccctgaacccacatctccatatcgtcctctttcctacttcctggaaaaatctacagggatccagccatctcctttatgatgtgagttctgagcgggccaaatgagctctgagttctgagagcccttgccttgtggaggaagcatggaggtcggaggaaggagacatttaggtaacggtgtcctggcaccctctgtgtttccctgatttcacagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccaggtgagagagctgagcaggggctcataagaagcagatgaatgggctgggctcggtggctcacgcctgtaatcccagcactttgggaggccgaggcggcggatcatgaggtcaggagatggagaccatcctggctaacatggtgaaacctcgtctctactaaaaatacaaaaaattagccaggcacggcggcgggcacctgtagtcccagctactcaggaggctgaggcaggagaatggagtgaacccgggaggcggagcttgcagcgagtggaggtagcatcactgcactccagcctgggctacagagcgagacgtctcaaaaaaagaagcagatgagtgaacggccactcacctgacagcatgtaccccctggagccctccaagggagatatgttagtagcaaggaaaatttctattgcttctctaaagccattctctttcttgtgcaatttacaaccagcattcttttatatgtgagttagagatgcacagacaacaaaatagaagcatttccaatattagaaaaggaagctgggtgtggtggctcacacctataatcccagcactttgggaggctgaggcaggtggatcacttcaggtcaggtgttcgagaccagcctgggcaacagggcaaaacgctgtctctactaaaaatacagaaaattagccgggcgtgatggcacgaacctgtaatcccagctactcgggaggctgaggcagaagaatcacttgaacctgggaggtggaggttgcagtgagcagagatcgtaccgttgcactccagcctgggcaacagagcgagactggcaaaaaaaaaaaaaaaaaaaaaaaagacagaaaggaaaggactattgtaaagatctatgaatacatgttttgcttattaattcttttttatttatttattttttaaatgtaggggccatgctaatcttctctgcagcattccaattttagttatatgtgctgccaaagtgagcacaattcactttaaagaatgatttgagtgaaacctcattctgggacttcctgcccatgaatcgatgggtttagaaacgaagtgtgtgatgctcctttcagacccagagagcacgtgtgaatgaatccaccatgttctgtatcgtatgaggtgtcaataacctcacaccgaggaaggcggatgtgaaagtctgcttatgccttcagatcttttgtagacaaaaaagtacctagatggatggatgatggatagatcccaaaatgtatctcttttttttttctttttttcttttttttttttttttttttttgagagggagtctcaccctgtcacccagggtagaatgcagtggagtgatctgcgcccacttcaaccttcgcctcccaggttcaagtgattctcctgcctcaagcttcccaagtagctgggactacaggcacccgccaccatgtccagctaatttttgtattttcagtagagacggggtttcaccatattggccaggctggtctcaaactcctgaccttgtgatccacccacctcggccttccaaagtgctgggattacaggcgtgagccaccgcgcctggccccaaaatgtatttctaaatctatccaaagaattctatgctgcgtttcattacattctgtgctatatattgccagacaaagctttggatggagtcttggagacacagaacacattggaggggcagaaagcaggaggtggcaggtgataggcctcctattgctgccattttccaatgtaaatctttgctcgagacgtgaaacccctttgcctcttttctagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggtgagtgctgcctctggctgcagccccgtcatctctctctgagttactgtgtgagagtgcccacctgccaacagtgtgcttctagaccattccattattggtaaaattgcattctgtatgctgacaaaattattcctgcaggtatatagtaaacatcttggttcgtccctggttttctgatgataacattcaaaaaagaatgaattactctgcattagagtaatttgagatggtaatccccaaattactgcaaaatactacttctttatcacacacataataaattatactcagaggtcctgagcttgggtttatttattcttctgctccgtgtatgaaatgtaaagtcctaggtcgtattattagttttctatgactgtataataaattaccactaaaacaaagtgcaattattatcttatggtatttatgggttgagagtcagagtccagcttcactgggtcctcagctcggggtctcaaggctgtaatcaaggtgcctgccagggctgggctccccactgaggcttcacaccctcgcctgagcatacacagttgttggtgggagtgatttccttgaagctgtagggctcctggtgagttgcttcttcatcagctgaagaatctcttaattttagcaccttttagcatcatctggtgaggctaaggattttcagaatcatcagatactggttcttttttgttcgatgttcttccctcaatttatctctttcctctcccgcttcactataaataacatgaagaaaccaggtgatacacttaacactttgtttggaaatagccttagctatgtgaccaacatcatcgcttacaagtcctgctctccatggacaatttcattaaactctctggcacacatgggaaggatcctccttgctccgatttcctggaacacctgtcacattcctttctgagttctccccggaggattcacctttagcatccctatttcctctagcagtctgttcatggtgatttgggctttctctgctgtgctactcaaaagtctcttagcctctactcgctgccaagtcccaaagttgtttccacattttaagttcagaaggtttccaacttacaatggtttggcttaggatttcataatgttacgaaagtgatatgggttcaatagaaactgtacttcaagtgcccatacaatcattctgtgctacattttcagtacaacattcaacgaattacatgagatactcaacacttgattataaaatcggctttgtgttagattattccgccctatcataggctactgtaagtgttctgagcgtgtttaaggtaagctaggccaagctgtgatgttcagtaggttaggtgcattaaatgcattttcaatttatgatgggtttgttggaacataaccccatctgaagttgaagaacatccactgtttgttagagtagcaccccattcctgataccaaatttagtaaaagtttaaccagagatgcagaaccagtcactttcatacaatatataatacatataagtatatgtacagttgtcccttgctatctgcaagggattggttcccggacccccacagatacccaaatcctcatgttctcgagtccccgatataaaatgctgtagtatttacatgcaacttatgcacatcaccctgtatcctttaaatcatctctagattacttgtgatatgtaatacagtataaatactatgcaaatagttgttatacggtattgttttttatttgtattttttaaattgtattgctattttttaattgattaatcttttgaatatttttggcctgcagttggttgaatccacaaatgcagaacctccagatacaaagggctgactatacatacatagtattttatattatatacacatgtatcacacacatatatatatggaaaggtatatatgtatacacacatctatattgatttactacaatgaattgccttatggaattactggggctagctaagcaagggcagacaggcaggaagggaggagcctacttaggctgaaaacccatgggcaagctgaagcttgttgtccacatgtggcagttggaaggaccacccgggtgatgggagagcagtcacagacacagctgctattgaagtctctgagtgtgaggaaagcctaagtttttaaaaaaaaatgccttccaactgcataagtcagacctgctcagaataaccttgcttttgattaatttaagctcaactgattaggggttctagtcacatttgtaaaatctccttccagcagcacctagactagcatttgatgggatagctaggaaggctgtgtgtgatgcttaggatggctactgcctcccttccatcctccagctctcatgagaatgcctcttgtagcccaccctgatcagacatgtgctaaaaaggaagtctaggaactgtcgttcagtctggccaagttgccacaccataaagccattgcaaagtgttaaggtggctcttgtgagctttttcactctcttctcccaggttccagttaggagagtggagagagcaggcagaggtcagagtacacatggtgaaaaaagagaaaagctgctcagcctcatgggtgtgcctgttggggtggagctcttgcaggtgtcaagactgatggttggaacaactgaatgatgagagtgggaggagaagggcagaaatacacagaaaaaccctatgttgtggttctgggcttcctggcaccttcagagctgtgtggctggggaagagagcctggaaaaacaccatcgtggccatccctctgtctccaggcaggaggtcttaaaaccattttatatttcactcatttgtttaattctctcctaaaatgctccacagcttctctagggttcccctcaccaccctgacaaataaataaatcattaagttgaacacagatgtatcagcatctactcaatctatagattttcagatctgtgctggacatttgctgtggacttctatttccagcatctatacatccagggaattattttctgtacccttcctaatgagattcatgcacatggcaaaactatgaaaattgtgacgttttatttgagtagtcattaaaagctgcttaaaaattgtcagaggctatatggataagcctctgtgtggataagactagcattttaagtaaattaagaaagaacgtattttgaagagctgaaataaatgattgcatattggtcatttttatccaaacccccaaaaaagaaaagaaaagatggtttaatagtacctgatagaagctcttggtgaaatgattagaatttgcaagaaatagtagtaaaaataatggaagtattgtctgaaatatttataaaaggagatttggtgactatggctgatttctttaagtattatatttctttttgctaattattcatacactgagatttgtataacaagccagggacagtacctatgtccctgggctcccccactaaacataatagccacttgacattcaaggagagcagattccagccaaagccccacagctgtgcatacatgacattccatatcatcttctcttgaggccatttaacttcttaccctaatgaataagaacttaggaccacaaaatgcaaatgtgggatgaaaaatgcagccgtagtcacacgtctttatttattgatgtgttgactcctaatccacttaaatctattttaaggcagcttaagagatgtccaatagctttgcacactaacatcaccccctgtgcctggctctgtgccatgcatttcccttactaactgatttacttctccaataccccctggataggcacttttattgatccattttatagttgatgaaactgagacacaaagagatcaactcacttgcctgtgttcacacagcaagtgagcagaggaagccggattccagtcttatacctaatcccacgcttgggctttcaactatgacctcaactgcctatagaagagatcattaaaatttaaaaataagtccataaattaaattatgacacatccatacaataaaatatttgcagctttaaaataattaaaagggagaattttatatattgatttgaaaaaatatgcaagatttattgataaatgaaaaaaataagttgcagaacgatgtgtatggcatgatatacttgtgggggaaggggagagaaacacataactgtctgtaaatacatgtgcacaatatgtatttctatacatgtgtatgcctaaaggttccctggaagggagagtgtctagaaacttctaaccatggttaccggtgggtgttgggagtgggagccaggagaatggaacagaaatgggagggagtcttttcaaacacgaccatttcataatgtttaaatgtatgaagcatataaatgcattacttactcaaaacataaattaatccattttaaatttcaagaagagaatgtaagaaagctgggtcaaagggagagtaaaggtggaaaagctagacaaagccagggctgaggtttgtccataccatggcgtgcgctgtgagctcccagctccgagctttcccacatccagtgagaaaacagacacacattcaaccaacagtcatggccatcccagatgcgtgcagaccagcggttcaggagaaacacaatttgctgacatagacatgtccgtgggtccaggggccacatcaaaatcacaggatgtgggtgccacaagggattgtagagataaccgaaggcagctcccctgcttgagaggtgagaagactcgggcccaggaggccaggtgacgttgtacaatcaaggaagctcttgctttcttgcaagctcagttcaccacctgatccaatcaacagtttaaggaatagagaggagatgctggctatgccctaactaaccatctcaatttcaggagggttggggctcccctgtggccccgcatcatttagcatgtccttcgctctctgcccgggatgggagagtttcacagtcacagaggaaccacaaagactctgcagaagatgagtcagcggctatgatacttttcacttcacaattaatacatcagacacctgccatcaacataaccattccagcttttatgcctgacatttctgggactattctttccagaggaactttctcttgagaattaatcagtattaacaaaaattgcaatgaaaggaaagagaaataagcactgggctaggtgctgtgggttgtctgattggtcctgctttggaagcaccctcattgtggctgggggagcatcaagacaccctgacaagctgtgatctgtgcttatgggccagtgaggcagatgacgggagctgttggactccactgtgctggctaaatcttttcaaactgctgaaaatccttattaaacatctaaagctttcaaaatcggaaaatgatccttgaatgtctccacacatcactgacatattcattagtggaaaatggggtcagacagcaatgtccagaggccagctgacccacggactgacagatagctgtgcagatgttgaataattacttcctacgagccctggtcaggactcacacttgcacgatccaagcagcagaaccactggcattagagtgcctggaaacagacctgcaggcgcaccaggaggaatccccctgcccgccacagagggcacctttccaggtaagagtctgcagctctgatgaatagtacttgtcaattaacacaccagtcacccatcaccactataatgaccccagcctcagcctccgtgccagacggtgcagggattctttggacttatctaccgcaaaatcacactgtaatgtttgtccattgctttgaagatcagagatggcctggagagactggtgatggaggaccgtattcacaaaccacagcagcttccaatcctctgtccaggagagcagaggggagcacccctgtgggacaaacaacaggggggcttgagtgtgagggctcgggagaataagtgccatcccccagtcaagatgaggactttcccaacactgaagacagacacagcagattacttcaaaaacctcagagcaagtttacagcaaatatctcagacataagaaaggtacaattaagggctaaattgcattctgccaacattcatatgtggaggtcctgacccctaacacctcagaatgtgaacttatttggagacagggtctttaaagaggtgactaagttcaaatgagggcattagagtgggccctgatccaatatgtctggtgtccttataagaagaaatgaggacacagacacacacagagggacagcctgtgaggaaacgaggagaagtacctgtctacaagccaaggagagaggcctcaagagagaccagcctcaatggtggcttgacctcagactcgcagcctccaggactatgagggcatctgtggctgtcgttgaagccgctcagctgtgggactttgttatggccgccccaggaaatgaacacagggacgtagtgatgcaacccccagatggcagctatgtccttttaagaaccagggagaattcaaacacatctgtttcatggtgtaagttactgtcaagaggctctcttaagtcaaagagaaaaatggaaatgtgaaaatgctaagctcttttctttctccttccgtcacccatgttcacagcataatcttgattgtatttcatttgaaagactagcaaaatgcactccgtttctctctgtaaacctcacagatgtcatcagttgatagcaaagccctactgtctgcagagcgagccgcagggaggctgtgggtgccctcgccttgccctcaggaaggggaaaccaaccaatatttcctgtgctaatgtggggctatgaattgtgcctcactgctctgagcatgttaatttgaagaggaaactgtcgattgttccaatgagactatctatattcttggtctacttaggatcaactcaagtgtgcatttcctatctaatggcatctgacagcttgagaagatgcaaagtaaattggcctggacctgccatagtttatagatggagacagggcaggtaatagtgtgagaagatcatgtgtaacgcagatgctgagatgcagaagaaaagatgcccttcctggctctggacgggtctcggtggaggagtgggagctactgctggttttatgagaatgtggggacttgagacctctatgggagaaatgcaaacatttgcaaatgggctggataaatagaaacatgccctgtgcatggctgagaacagtaaactgtggtggtgtgtcagttcctcccagagtggatcaaaggggatggtgtattagtcagggttccccacagacagagacagagacaaagacagagagacagagagtgaccgagagagaaagagagagagagatctagttgaaggaattggttcaagactgtgagcctggcaagtgcacaatttgcagggcaggctggcagatgggagaccctgggaagagttgaggttacagctcaagtccaaaggtggtctggaggcaggatttccccttcctcatgggaccccagttcgtttcctcttaaggccttcaactggttggatgagacccactcacagtgatgtgtcgagacattcaaggaccattttctgatttaaaaagctttaaatgtttttaataaggactttcagctatttaaaaagattgagccagcaccatggagtccaacagccccatcatctgaagggtggtctctgctttactcagcctagtgacttaaatgttaatctcattctaaaaaaataccttcacagtgacatctaaaataacatttgacccaatacctgggtactgtggcctagccacgttgacatgtaaaattacccatcatagacggtgatcattgtaataaaacaaacacatcatccacacttcctgagtcctgagcactttgcacacgctacttcattttgtgctcatgggaacctttctgctgaggttgtcccggacattctcaagtacatacatgaccagatgctgggtctccatggcaacaacatggtctcacttctgttcaagccgtgctttccttcccctgcaggatgtacaccttcagtctagccacagacctgaactccagaaaggatggtgaagccagcagcagatgcagcggggaatttcttccacaaacggcaaggagtcttagcagcttacaggccttgcaggtaatagaacattcccttttttcttttaagtaaactaagcaaaactacactttgtattaacttcacggtggacacagcttcgtaggtgtagcttttgttccatagacacatcctccctgccctagagcgtggtcagcaagggggcctcccaggtctgagggtgccgggggtcctgccctggtctgtctgctctgggcagacagggagccaccccttcatggcagagtgccccaccttgagctcctcaaggcagctgaatcccgagttctcatcccattccctcattcatgagccaagaggtccccaagacgtcacctgccccggtgccttggcccctcatcttttgaggcaaaactctccataacctgggggtcagcagactcaggccagggtccagggcacagcagggcaccccgagctggccaccctcatggggcacatccaggagtgcaggctgccaggcagggacaccaaggagcaggcagcccctccctgaacgcaaacaagtgacatcacatccctgatccctgtcctgtgatctgaagcttcacactccttacagaggagccctcaggaaggggctgtacctgctgctggcctttgtctggttgccacagtagtgaaaatgcctctctgtccttgttcttcccaaattcgtccgcctgtgccctgccatgtgccgcacacgttactttaggatctctcatccttgctatccccaatcgacacaggaggcgctattcctgccccctacccattttacagatctgaaaactggggctcatggaggctaggaagcttgtcggagagcacacagactcctaaccaccctcccatcagattgttggaaggattatgtgagatgggccatccagtgcccaccacggccaggcccctggtgcggagaaactattgtgcccagagggtggggtcacagtagccaggcttattccctagtccccagggcccatcctggtgcctggtccataaatctccagaacaaccaaaggaaggctctgccgggacttgtcagtggctcaccctaaggtcaacgctcaccctctgttacggattgaattgtgtgcctccaaaattcctatctcgaagtcctaacccccagtctcactgaatgtgattgtatttgtagacaaggcctttaaagaggtatttaaggttaaatgaggcaacacaggtgatgcaatctgatccaatctgactgctgcccttataagaagaggggatgaggaaacagacacacaagagggatggccctgtgaggacacagggaggggacaccaccggcaagccccagagagaggcctcaaaaggaaccagccctggcaacaccatcatctctgacctccagcctccaggactgtgggagagtaaacttctgctgtggaagctaaacagtcaacccacacgcagcgtccctgtcgccatttgcacctcctggcagctggtgcaaatcagcccaaagctaagtggccttggcaggtctttgcagccttggtggctaggtgaggaggccttttcttgagaaatcaagaatgtgtctctgaagctgggtccatgagaaatggcgatcagcgttcaccatgtgagaaaggcccagacttgggagagccgagactccccagggctgtggcctggggattatttaaaaagctttaaatgtttttaataaggactttcagctatttaaaaagattgagctagtaccatggattccaacaaccctatcatctggagtaaaacagagaccattctgttttactcagcctagtgacttaaatgttaatctcatttttaaaaaataccttcacagtgacatctaaaataacatttgacccaatacctgggtactgtggagaagtacccaggtattgggtagggggagagcctggaatggaagtctctgctcgtagctcagcctgtgtctaaaccgtgctttcaatggctgaaaacagaacatgcatctgcctgtgaactggcccccctcacacggtcttctctatagggatttcaccccttccctacagtaagaaaagacaactggccacaggtctggtagaatcatggccccagagatgatgccctaatcccgggaacttgtgcatgtgaccttattaggaaagagagtttctgcagatgggattgagtggagggtcttgaaatgaggaaatgatcctgggtcatccaggagggccctaaaccccatcacaagtgtgctgatgagagaaaagcagaggggatctgatacagcagcagaggaggccatgcagccagagaggcagagactggagcaatgtggccacaagccaaggaacacctggggccaccaggagctggaagaagcaaagaataaattctcccctagaatgtcagagggagcatggccctgccaacaccttgactttggacttccagcctccagagctgtgagagaataaatgtctcttgcttggcaccgcccagcctgttatggcagccccaggacaccaatgcagcaccttctgtctagagaattggtgcagccctgcctcattccatagatcccaggggtcagtccattccactccccacagggctttcttttgctttatcatcatattcctgtggcaaagctccacagaagaacatttaaaatgctctgagctcttccaggaagaaaataccccaaatccaaaacttcagcccgcaagttgaaaacttcagggactttgttactaggcagaatgagtttccaagagcatgcatgctttgcaatctacttgcagatcagctctctacagctctctaggatgttttaatattcattctgggataggggcggtgggtgctgcctcttggtgtcagtgtaggcaacctctgcataaccacacttcacatgcaagagagcaagacagcaagacaaaccttcccctgaagctgttccccaggagatgcatgtttctatcctgaaacaaacaactgaagttttccaataagggaaagcaatactattcacttggccttaccgtatatccgttttgaagactcagcccagtgaccctaagaaagtgtttgcatggtgactgcaaacgttctcactggctcaccaatcccatagtttatgcacctaccaaatgtagccagggccaccgagaactgtctggtcctgataaatttcagcagctggaaattctgcatcgtccgggccagcgtggacttcacaagggatccacaggatctggcaggagctgcccgtggtgctgaccccgagaatgctttcaaggcaggtgaaattggcccccaccctactttctggtgtcccttccttcccagtagtttccaatcacttccctaggtacagggacaccacgggggaccactcttgccagagcgagtggccagttagtgcagacccttgagactggatcactgttcacagaagaaagtccagacaggaatgatcagctgcactggccaggtggaaaatgagtcccttcctccctgagggtgtttggatgttaaagccatttgcattttcctctctaggatttggagggaatcagggcgatgctggggctggtgtatgagggtttatgcagacaaggcttacctctcctcacctctcttccttaccctgctcagtaggaaaacacacacaagagctgccctctcattttagcccagagagagctgtgtggccaagagggagcagggcagggatagtgcctgtctgagctgcctcctgcccaggggtcctccctaccccgtccatccctggtcgcctgggctccaggcaggatttggtccccagaaggccccacagcccacctcccgtggcaggccgtgttcgctctgcccccaccatctctgttaatgactcatctttccatgttcatcccttggcccagggagacctgcagctccctaaagcagggatgctgtggactgcagcttcatggaccagcatgtgacatgctcccccctgcggtgccatgtcacagggaggttgaggcatgagtcctgggtgccagagggcagcaccactgggcctgtgttgctgcagggttccccacctcttgctctgaaatggacccccctggatagcctgggcctggctctggggctgggaatgtaggtgaagggccgatgtcagctggcacattagtgccctccagggaagcagccgagcctggtgtctccctccagggtcctggtgcagggcttatgctccacgcagctgtcctggtggcctctagctggctcggcccctagcactctgctctctggtcccagggggggcatcctcagctctcattcactctcttcatctcatttgctgtgggttcctctcaaggccagtccctcaacttgatcagccctgcacagcatggggagaagggtggcctagcccctgaggacagagccccccacaacaccatcccacacagtggaggcccctcccaaagggtagccagcctcgctgccccaagcatgacctttgggctacttccccaaagcacaggctccccagaaagagggcgggcgtgagccctgtaactgcaaggctccaaggccatcctgcggctgcctgaggctggggaggaaggtgccagagagctgctgtccctggctcgaagctgctggccaccgccaaggccagtctcatgccgagaagaagtaaataaactataaagtactgttttcctttagcattcagccaaacagagaatgaccagctatgggaaaacagcaaggggatggatgagggcttctccccttggtgctcagaagcagaattcatacctgggagccataaaaggacggcccctcaacaggtcaacaccagggcagtcctggagggtttctcagaagaagtgtgccagcaagagaggagactagatatatagataggtaatctatactataacaatacatattataatatagatagggataatgtcctaagacgtctctatgggaatgataaggacttagaaaagacagaaaagtagaaaaacggatgtgtcatgataggggccaatcctgtctcttttcattttcttgatgttagaatgcccagaaaataaaacattggaagaaattgaagagattgtcaatttcatgtcctctttcattctaatgatttgggcaaaatgggctgagctattgactaacgaaggaaaagattccctcgcagttgctgggtgactgggagagctgccattggtgcaagtccagtgagttggatgttaaactgcatgtgccttgcttcctgccccaccccccaggctaccgttgcaaggaagagcgtgctggtggttcgccacggggagagagtggatcagatcttcgggaaggcatggctgcagcaatgctccactcctgatggtaggtcacactcaggcgggtctacggacagaaacactgtagatctaaccaatgagatctccttcttaatgaccttacatggcaccagatcccctgaggcaccattctgtagaatgaccatgtgtagactgtatgtgtggaaaacgtgcctgctacatcttcctccaggggtgttccatgtatgcatttgagtgtctgtgttggaacctctccaacctaatcttaactgatgtaatttttggctatgctgcttaacagatggacgtattcttgaacatgcctcttgcacaccccagcttttctcctctgaatgccaggaagtaagaatagtgcttataaatacacatacccacaagccaacctctgtattgatgatcaatgtccacatcaatgctaatctcctaataggaagcctgtagtgtcacaatttctaagccatgacccattacataaattaaggcattgaatgtagtgacaaaatcaattcacagttgctaggttagccgaacccttttgggatccccctccagaagcccagcagacccaagaaagtggtaaatgagtagggaaaaccattggcagatgacaatcacacaccagaaaagattctgagcagataacatcatgatcaagcatatttccaagaactcacagagctaataatatggtcacctctataaaacaagatcaagtaaagatacaagagcttaaagcaacaataagacaataggtggctatcaggatgcattaacaaacatataagaaactttttttcaataaaacagtttttttagctattgaattactgaagctatagattgaactgacacaccttgtccatggtggggagaaccaatacaaaacaatcaacaccaaaaatagttattgaacttcatagaaaaagaaaaaatatttggtcatctggacaaaagatcaagtcacttataagggaaaatattttaaaggcactggaaatccccatctgaaaggaaactcctggtggatcttttcccaaggtagagaggcccttgataaagtgaagaattacatctagtttgtctgaattttgtatattgcagggtttaataaatcacaaggaggtatagccacgtcctcccccaaggtgaccaacctcagggaacacaagggagatttggggggctctactggcctctccccagctcagctcacttttggcccaggcacccacatcctcacagggcccctcacctcaccccatattccacacagactctgctcccatcaggacctgaccttgccccacatccttgtcctctcctgagctctgccctctgcccccagagtgatcacagctgaagtgtcaatgacagcaaaatacctaaatggagtgtcttgacattttagagggggatcacagatgcctttgagaacacaatgaaattgatggactttctctctgattttaaaactgcctttcccaagagctaatgttggcattgaataaacacctctaaaatgcagtgttcaaacaagagtctctgcccatggaaatcccagggagggagtcttcagaaaactcctatatggaaactaaaatgcaggcatgaaaaattgccccccgctgacccctgctgccccccactgccccctgactctgggtttgtgcaaggctgtgggccaggatgaaggggcctggcatattctggggtgcaaagggcagggcctgctatgtatggcagagcaggtctcaggaaggtcagtgtggctgctggaacctcctaataaccaggaggcttggggtccctttggagaatgtgaaggcaaaccagagtgcactggagggagcagtgtgtcgtggtgtcctgtgtgaggataatcagtcatcctgacgtggtgacatgagaccagtgccccgactcgttgaccactccctcttgagtcagactctgggctatgggtgttacctcactgacacctcgcaatcgctactctttccctgttttttactgataagagagatgaagtcatttatttctggctgcacagtgaggagatggtgatgccaggatttgctaccagactgtcagatcttagaactcaaggtcaaactccacgtgaaccctggcaccgggcagcctctggtgggagacagtcccagtgagcccacttccagcctggcttcaagcaattgactaaagaatgcacaacacaggcatctccagctcaagcactctgtcccctgagcaagaaggatacgtttaaagctagggggatggatcattgatgccaacttcagattcttaccgagttacactaaactagtcatagagacactttatcaggttcttcatcaggaaaatgtaagagtgaatcttcatggggcattttgggaggacaaagagggttgcatagttcctggggctgaaacctaagttgtctgcatttgagaaaatgttgtgtgcacagctgagcagcactttcttctcaaattgaagccacgttgcagagaatgttcagaaacaacacagttgacaataatttcaataataacattgctgttagagtgggtcttggtcttgggagttttgtggaacaaatctgtactaacttgatgaaactgaacgtctgatgcttatttatacttcagggaaatactacaggccagacctgaatttcccctgcagtctgccaagacggagtcgtgggatcaaagactttgaaaacgatcccccattatcatcgtgtggcattttccagtccagaattgcaggtatgtttgaggactgtctagtaggaaaggtaacaataacagcaacactgattatggctagcaggcatccagcctgagccctagctacacaccctttgatacagtgttagctttgtctccagtctgctgaggaggctggggcacagagaggttaagcaacttgcccaaggtcacacagcaagaaagtggcaatgtagaggtttgatctaggaatggatgattcaggaagttggcaggaatgaaagaaaggcatggaaagaacaagagaggggaggaaaaatcaacaaccaaggagctccaaggagctcacttttcaaatggaaaaccacatcctctcattcgttggttttatttcaaaatctgtcactttgggcttttgtttcatgtctggcggttctgcttctacgtgactgagtttatgtaaacagaagagaccattgagttcatcgagtcttcatttcctaaattcagaaaatggaatccagagaagcaagttacaccaatggttaactgcagagacccccacggcccactcgcccagggccccactcagaggtgtgctcagaaatgtttacccacctgctccaggcagggtgggaagtccgagttatagagttatagagttagttatagagttatagagtcatggagttatagagttagttatagagttagaatcatagagttatagagtcatagagttatagagttagagttatggagttatagagttatagagttgttatagagttatagaattatagagttagttatagagttatagagtcatagatttatagagttatagagttagttatagagttatagagtcatagatttatagagttatagagttagttatagagttatagagtcatagatttatagagttatagagttagttatagagttatagagtcatagagttgtagagttatagagttatagagttatggagccatagagttatagagtcatagagttatagagttagttatagagttatagagtcatagaattatagagttagttatagagttatagagtcatagagttatagagttatagagtcataaaattatagagttagagttacagagtcatagatttatagagttaattatagagttagagtcatagagttatagagttatagagtcatagtgttacagagttatagagttaattatagagttatagagctatagagtcatagagttatagagttagttatagagttatagagctatagagtcatagagttatagaattagagttatagagttataaagtcatagagtcatagagttatagagttagttatagagctatagagttagagtcatagagttatagcacttgctgagtgcagtggtgagaatactgcactccccgacaactgattccagactcccagtgtgagctcccaggacactgagtcgggaggagatggtggtcccaggcctctgtccctggcttgcaggtgacattttctgtcttcctcttctcttctctgcatgtctctgtgcacagatttccccttttagaagggcactgtcacactggattagagcccaccctaatttaattgattgaggtgcatacccttattttaacttatcactctgtaaaaatcctgtttccaaatgagtcacattctaaggcaccaagggtgaggactctaacatgtttttcaagggaggggatacagttcaacccagaagagcctccactgaaacctcgctcatcagctttcaggctgtgcaatttttgtgctgtagggactcccatatttccctgagagcagggcttccagtatcacagggggaaaggcagagtacaggcttttccttccacgagcttcagtgggtcttgagttttctcaaacgaccacaaatgtgaagccccgcccatttctgagctcacagtggtgcagatccaaagcccaggcccacgaggctgcttctctgctgaaggtcttaaagcctgaagtcaaggtctctgctgggctgagttttcattgggagctcaagtctccttccagactcattctgctgttggccaaattcagatccttgcagtgggaggactgaggtctgttccttgctggctgttagctgggggctgctcccagccctagtagaggctgcccacattccttgccatgtggtcccctccatctttgcagccagcaatggagaatgttttgctgaatccttctcacttcacacttctctgacttttttccatgactggctggagataatcactgcttttaatgggctcaccaacttgtcagccccaccttggatcccttcccttctgccataggatgtaattgtcccaggagcaacagatcattctggtcatgggttccacccatacttggaggctgtgcagggtgtgtcacaccagggggtggaaacccggggccctttgaggaccctgcctaccacagggagcacatggctcatctgccatcagaggctagaattatgaaggggcattttctgcctttttcactattttccaggggacgcgctactggacagtggtatcagaatcagctctgtgtttgcctccccagccctccgctgtgtgcagacggccaaactcatcctggaaggtcagtgagaacctcggtgagcctctcctactgccttgaccttggggctattctccaaggggagtgggaagggagtggaggtggaattggatgactggcaatgaatgcccacaccaaagtcatcaggcaagtacgagccagccctccaaggatgctggcaggcatgctgggtccgtgagcgtgtctggaataccaggaccgtcagaccagtaggggctggtgtagctaaatgccagggcctgtcctcataccgtttctctttggcctccgtcagctaggcatttttaaaatacacctggaaagcggcattcgaaaaccttgagagctgggaactgctacggttccttgtaagtctgaattgcatgacccttcccagggcaatgcactgggccagtggagctgtccagcgtcctcaagggctgatgtgtgtcaggaagtcctgggcagacccttctgcagctcccatctacgggaagaagaaagttcctgcccataggagagcagcttgttccagaggcctgggctctgccttcagcctgaaccctgtcctgctcctctttgtctgggaagagggataagatctcggtccccaggcagggactggccgtggccaggagcatgggtgacatgcgagagagcatgtcgcctccatggtgacaagggagagggcagagcacacagacacagatgcagcaggagggcaaatgtgggggacagggcttgcctcgactttctcagagacctaggaagtaaggccaccagcggaaagtgggggcagggactgtgggaagtttggggtgcgccgaaggaatgaatggctgtcaggcagaggggcccaggacatgggctgggagatgcagagtgaccgctgggcagcactcagagcccacccacagttcatgagcatgagtttaaatggagatgcatcagccgggctagggggtctcttccagcttagaccgggagtaggtggagagtgggatgcaggtaagggcagggttgagctgtgagtacggtggagccagaggggacaggaagacttgagggcatagtgagggggtgaccgtgcccatggactttcagctgggtcagcgaggaggccgagcacgggggaggtgagtgcaggagaaaggaggtgatctgagtgaggctcaaggtccacgagggggctgcttggagacagcagagtttggcactgcaccatggcggggctgcagtggctagaatgacaagtcccaggtggaaggaatggatgctcaaggcagggaggaagccacgtcctgcaggaggtgggcaggaatggaggggccatggaggagccatcccgcagatggtggtcttgctgggacttgcacatggggccacatcagagccggggccacgaggggccgggaccttcacaggaggagccgttgggacagcagtggattcaatgcacacatgtgcattgccggttcccatgtcctcagatccccttcgccccgtcagagacgctccctcagagcaccttcaaatccaggtgcccaggaagccccagccaggagcggacctggttccaccccggagcctctcaggctcatcattcctgtcctgtgctctcatgaactttccatcccatagtccagtcctagtttcacgaggcacagaaatccattgtatcagcatggagcatccacgatccaccttccacacacttaaaaatgtcaagacactttctgcccacctcagtcttgcagcttcatcctttcatttcccacccaactgtggcacaggaccccacccctctgcacggcatctcgggtcacaagacagaaatgcagacttacttcactttgccttggaggttcccatgttgattgcatcacggcacctctgggctctcaatgagccagatgaagatcaaagaacaatatcagcttctttgaccaaaccacgaaaggactcgcgaatccccaaaggcctgacggcagtgtagccggaggccagaggcagctccacccgagggcaagcaaggcttccacaatccttgtctctcctcacaacgctggcatgcacatacacagcacacacatccacacacaccacacacacaccacacgccacacacacactacacacacccacacacacaccatgcacacccacacaccacacacacccacacacaccacacacacccacacacactacacatacacaccacacaccacacacacaccacacaccacacacaccacctacacccacacacacccacacacaacacacaacacacacaccacacacataacatacaacacgctgaacacacataccacacacacaccacacacctcacacacaccacacacatacacacaccacacacacgacacacaccacacatccacacacacaccacaccccacacacacccacacaccacacacacaacacacacccacacacacaccacacacaccacatacaccccttggggtttcacttgggggctgagtcacagaccgcagaggaggaggctgtgatctttgagagccatgaccccagcccaggtgacagggtcccgcgatgtccgcctctccctgttcccatgctcacagcagcaggtccagccttcgtgttttcaggaaggcctgagaaacaggacgtggcctttccagctctgcgctttgggagggacgagggtggcaagatcagaaatgtgaaggggcagggtctccgagtatctggggacccttcagtgtgagggtggctcttaataactatgatggaataaagcaaaattgatatatagcaatttcatccctggttgtttaggatcaatgtatttataattaaccaaacacctataatcataagatgtgaaccaagcaagaaatgcacacaaatatatgacaagaggggaacaggcctgtgcctcagtttcccctcttctcccctgtcgctggtctttgcaccccaccactcaatgagcgcattttgttggaaaccacctaagatgctgctgttcttccactaagtttcagaatcactttggtttctgccactggctggccgcccactagcaggccgtgcgagagtccccaggtcgcctgtgcctgccaggccagcaacaacagtctcctctcactggggcttttactgcctcagcctgcaagtttcccttctagtgaaaaccttcgtctttctttccctacccaacctctctcaccacgataacaacaacgaataaaaaaggaatctcttggccagcctttgtaataaaagaatacgactgactgaaaacacttcataattttatcttttttttgtcattgttcgtggttcctcattaacacacttattcccatttttggtggatttttttacttctattatttgggtcacttgcatataaaaagctttcaaaaatgtcttttgccagcaataatgtcaaaatctttaatgtgatctctcagtgacctttaagtgcagatgatgatgatggtgatgatgatggtgatgatgcctgtttaaagggcatgggtttataaatcctctgttaattcagaaaaacaaggacacccagtcttctttacaaggcctcagacatgatcaacctgcttatcagatggtgtctgagatgctaaggtgctcaactttgtttaaattcaatgtcagagaatgtccacatgaaccatttcacagccaagtccacaaaacactggcctgcaagaggtcttcaaaggaaagagacccatggccacacctgtctgggaagctctcacactgttccttcatcttatttgttcacaatggaaatgagctcttcacaggcttgggggagatttcgggggcctggtttatcagggaggacttgggggcccagttgatgggggaggactcggggacctggttgatggaggaggacttgggggcctggttgatgaaggaggactcgggggcctggttgatgggggaggactcaggggcctggttgatggaggaggactcgggggcctggttggatgggggaggactcgggagcctggttgatgggggaggactcgggggcctggttgatgggggaggacttggaggtctggttgatgaaggaggacttgggggcctggttgattggggagaacttgggggcctgattaacttgctttaactctcttttctaagcatgcttgatgaaagagctccttccatggacctaaaacacatttgaggaactgattttatgtccagcatttgagttcaatgacatcttctccattcccagtgaaaacattcaggtctttttttccactcaaaaagagatggccttactttatggctcttcctttaatcaaaatataaaatgcttgggaaatgtgagttgcagggagtcagaatattccagaagatggctccttccattcttcacctcttgccccgtctgtgtaagtgtttatcaggaaagtgcctcatgaggccaacattcttcatgatgggtcacatcttgtccattgatcattggatctgccatgttggaggatgcagccggtgggctggtttcacggtggagctgtgctgggtgatcaggtgagccccagcctaagcctgctgcctgggacactcaccagctcctggaagactctggcccttcctggcacacagggggccatcactcctctgataccttcccactgctcgtcagttttgacttcagaaatagcacagctatgcctaatcacagaacggtatttgccaagaagaaaatcacactgtttaaaaggcatgatttagacgtgtgtgtgacggtctgagatctaaaaggagacttatttatgcaaagtcagggtggatgttgaggatgataaacacttgtattctgttgaatccagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggtatgctgttctaaagttctctgccactggggcttttccagttattgttaaagaaaaatttcatgacactgttaaaatggtaagaaagactttattcaagagggaccactgcagtggggttttgcagcaggggagagaggtggggctcaactcctaatacaaggaaaagaggggagttatagccacagagcagggtgggggtcagtggatggaaaattcctgagaaggtgggtcattcttgctaaactgacctaaatggagactcttgctgaaggcaggccaaggtgatcagacatcacctggggggtggtagaggataaggaacttgatcagatgtcgaaggtaggaggttcttgctaaactcactctgcaagaacagacacagaagcccaagggtcaagacctcattgagaagaaggttcagaggagctggactggagtttagtcaaggagagagtctttgtcattctccacccatgtctgactctgccatcacagagccctcctggtgttgagtaagaatgtgtgctggagattgactgtcagtgctttgccagttttcagcacaaaactggagcctgcctgttgaccatgagcctgccttgaggcagagccatcctggaagaacgttctccttccccagctaactgcagctgagccttcctaatccctacgaaagtgccagggcagcagcctctccttctcatccttccaggcccgcgtttcccctgtccgccctcatgccggccgagagctaccaggagtacatggacaggtgcacggcgagcatggtgcaaatcgtcaacacctgtccacaggacagtaagtgcctcaccatcctcagtatgaacagcccctggggcttggggaattatctctgagatggaaattggccaattttctgaacctatgaatgcccctacttctcctgcctgcccccgcccccattctccagcaacaaagttttcatcactgctgctgctgctgcagtaaccgggtgcacagacacacactcccctgccgcccaggccctgggaccccccatcctgggactgagtgctgatgggaggggaatgatctctgagatggaaattggccgattttctgaacctatgaatgcccccacttcccctgcccgccccccaccattctccagcaacaaagttttcatcactgctgctgctggtgcagtaaccgggtgcacagacacacactcccctgccgcccaggccttggaaccccccatcctgggactgaatgctgatgggacccaggccagcagggtcagcacaatccacccatgtccaagggatttgagtcagcttcctgggaaacaaaagagacagagagagaaagaacaaccaacttccaggtggcgcccccttccctgacccatcacacgggtctcctaaccctcccgtgttgctttgtcctggatgaagcatgcacagaagcgctgacttcccacgccttcccctgagctggcagggacaagcgtgtctcctgagggagacccactcggcctgtggtctccaggtgttcttatctaaagcaggagtcgtagcaggctcgtgtgacaaaataaccggctgacctttctaaagtgaatcaggtctggcttgggcgtcagccaccgctacatcccagtctgtggctgacggggcccaggcagccagcgaccacagggggtggctcagctcacttcctaggcctccctgaggctggtgggcagctgctgcgtgcagaggaatccatgagcgagggtgggacgcaggcatcactgagcggttaccagccacactacttctagcccaggggtctcgccaggcttcggggcactctgagatagctctgccccccaccactttggggaccccagtctaataaaaggtgctctctggggctgctttgacctggaggtgttcttgttttccacagcgggtgtcatcctaattgtgagtcacggctccactctggactcctgcacgcggccactgctcgggctgccgccccgggaatgtggggattttgcccaactcgtgagaaaggtacgcgcccactcttggctctttgggccacaaaatcaagcatcccgaagacacaggtttatctcatccacttctcggaatgaaaacaagtgtccggctgacccagggccaccaggatccacgtgcccccggagactgtgcccaccggctcttatgcgaagggtgacttcgggctggggctggtggataggtcagtcaacctcatcatcattggccacttgccaactttttaccagtcagctcatgccatgaccccttgcagctctcgtagaaaaacagacggtccaggaaggagtaagcagtttagatgaggagggaagaaacgactgtgggactcgattctggcctcttctggggacctggggcagggcggctgatggatgaaaaggagccccttgatcctcttgcccttggagtcacccagcatggaagaagcttgagctggttgtagctgccagagtgctcaggctctggcaagggccttgtgaatgacaaacagaggataacgcacacgtgacatcttggacaaccttgattatcactcagcaaagccagagggtgatgtccagtccatgggtgaattgaggcaggcaaactcaggagtgcagatcccaccccagtcccagcccttccctgcagatctactcaaggctggactcaccacagtcctgacctttttatgaaattcatcagtccactggtcagtgcccaggcagcacgtgcagcatagacaatgcctgtcatcggaggtgcttgaggccctgacctggtttcttcacatagcactgccacaggaccacactggccacagcttgtttgccataagttgtgggcagcagtgggggttgctgagtccccccaagaggtcaggggcttcagaggagcccaactcccgggcccagcccagtgacaccagccaggtgcctgcaggagggcttagctctctagctacgcctgcctcagcagccagatgagaggttacgcacatgaagagcatgcctgccgtgggtcattgtcactcagcaattaggcatcagacacccgaatctccctttcttgctccattttcctctgcacctgagtagaaacatgcttcccctgcaaaatgtctccagggtggtgtgtcccaattatgatccagacatttccgagcgccctggattcttgagccaccaggtgagcattgtccaaatagggcagctcaacccccctgggccacactggtagaggtctgcatggattttcctggggactgtccggggcagccccggcaccacctgctcccaaaatgttgctcttgcttctgcaaatgggtctcccacacatgcgctctgatgcattcctcctgtccctgccccgcttcccacagtcccatatacacataccaagcctccagccccaggcgctcctggggatccacgtaaccaagggtggcagcactgcacacaccagctgctgacagttcctcaaacccatgagcctttgtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctccccgaccagcccatcaccgcccctcgcccacagcctctacaagcgtgaggaaagaatcaccctagggtcaacaccagcctcactcagacccccctgccagttggcatttttgtaaatttcatctgcctgaggaatttctagacattagaaagaggaaggaaagaaagaaaagaaaagacaaaaacaaaaaaggcttcaccacaaagctctgttctcacacatccatttcacagatgaagggatggaggtctaaaggttcactttgtgcttttcttttgggtctgaaaactcaatgtctgtgtctttttgtgatgctgaatatgagaatatgagtcactccttaagtggtggatggcaatctccacctcagcctgcagacctttgtggtgggggctgttctactcattgtaggatgtaccaccttgtaggacctctacctgctaggtgtcggcagcacctccatcctcagttgtgacaatcagaaatgtctccggaattacccagtgtcccctggctaggggacatcccccacggggcaccgccagggcagatgttggtgccattcaatggtggcagtgccagcctgggcagtcgcagaccctccaaagtagaggtgtgcctgacagttggctttggagctagtctgaaattgatggacttgctataagatattaacaagtgatttaaaactctgttccagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtcaaaactgggttgctgctccgtgctgtcaacattcatgttactatgtctctgtggttgctgtaaccaatgaccacaaacctgggggtcatggaaagaacacaaactttacacacacacacacacacacacacacacaggcacatacacacatgcacatatgcatacaaagacaggcacacacgagcatgcacacacacaaacacgtgcacatacacatgcgcacacacatgcacacgcacatgcacacacacgcaggtacacaagcatgcaaacacacatacacatacaaacgcgtgcatgcatacatgcacacatgagcacacaaacacatgcacacacttgcacacatgcacacaaaggcatacacatgcaatgcacacacacaaacacacatgcacacacaggcacacacacgctcacatgcacacacacacacgctgactctcctacggttctggaggttggcattttctcagcaggctatgtttcttctggagcctccaggggaggatccttgccttttctcacttttagaggccacctgcatcctccctcctcaagtacagcggcgtagcagcctccaagctctctcagtctctgccttcacagccacatcgccttctgcttctgactctcctgcctccctcctacaagggcccttgtgttgacactgggcccacccaataacccaggatcaattctcatctcaagagccttaaccacacatgcaaagtcccttttgccacataaagttgcatattcccaggtcccggggattaggacatgaacatctttgggggttatcctgtagcctgccataacataccccaatccttccaagcacagcggagctgcccgtacagggcctcggacatagggatttgagacactccccttgcaggccttttttggcttctcctattcttgtttctgatcacgtagaggagagaagaggactttgccagtgggagaagtaggctcccccgatttaatggggccccaaaagaagggccacgagcaaagtggagtctgtccatgatggtgatgctgaggaagctggtccagcaggggatggggtctccccagtggggagtctcatgccccagcccacaggtcacacctgctcccacagcccacacatgtggtgcctcatgctgcaggcagagatcccagcacggtgtagtgacagtccatcggtctttcatctcttctagccccctgatccagtgcaggtgttatttcatgattgcagtttggggctgtggtggtggctctgtgagtgccttttatagtgtgaatgcagagacagggcaggaaggacccatgctgcaccctcagcctcccctgtgagcacccaggcaagtggagggcagaacacaaagggagctcttgtagaaataaagatggtgaacaccccgggctgtgacaaaaacggcccacattgtgtagaatgcacaggaggccagacccaataaaagtttccttgctgttttagtcaatcaaacacgacctcctgagaaaaagacgcatctgtctgtcccttgttttatttcactaatgatgtagtttttctgtgtccaaacataaagaagtttgaagttgacacagccacagagagcagagcatgcaccccactcacaggcctgcttcgagtccaggccataccgaaatgacgtcttcagggagattgttctagacgcatcccagcagataccgactagagaagagatggattcactgggatgtaggtggctgggcagtacgtcctgcaacaaatacaccccaccgctgggcacctgggtggttgttctttctcctcggcaagtgtgtggttgggtccaagtccctcctggataccacagtgccacgctcgctaatcatgatgatgaattaaagtgctgcaagtcaaggtatggcattgaaatcacagtcacgtgttcaggtggtctgtaatgaatctctggattcaccttctcaggggtgaa

SEQ ID NO: 16956 - DNA, 125672 bp, Human
aagggttcctctctaggcagctgctgaggcctcatcgatccagtatctacacaggggtccagtccagctcctaagagtgcaaagtaattatagatgcgattattctcctgagcacagaatcagccaggcagtgtgaggggccagcctgcactggtgctggacgcacacagagtctcagagccacaccctccaccctcctggggaactgccctgcagaaccaccccccatgggcgggcactcgtccttctggggctcttggaggaaatggttacagaagactaggccagatgacaataagggatggagaataactaagtgccaagccaatgagccatctgctggtaagaactccatgccaggcagcacaggcggtcccaacagcacgatctctggattagcccaaatagcatcggaacatttgacaacaaattgaactactagtaatagtgctcacttcaatgagccggggacacagtatccccatggcgagtcagctggcccgctgtaaccacccagctgggtctccccaccccaaaggcctccaggctgtccccttctcatcctgtcacttgaaaagcacaactcatggtgccaaagctctgacacggactccactggagctgtgggcagggggtgccaaggtaccgagttccaagccgttgttatttgagagcgtgccccccgccatgagagcaggtggggggacataaagtgacacaggatggactggccaaaggctgaggacgatcacttacctcacaggatgatgccacccccacggacaggcaaggagctctcaccttccccaggaccccagctgccaccagagctccagatggccctgggggtgtctgtaaagcctgtgaccgtccaccaggtggagaccaggctggccaggggagggagaggaagtgaccactggccctggcactggctggccggctccagcaggcccgaaggggagggaggagcctgggtgcaccagactctctcaataagcagcacccagacacttaacagatggaaagcggtggcttggaactcacttccaacgaaacaatagcacatgctccggctggctttgacacttgcttccaaaggcgacctgcacccagggccaggaccacggcatctgagcctcctcccccagccgccaaccccattcccaatggaggagcccaggagaactgggggcggccaaggcagcccttccctgctccgcagatccagaggatgcccacagcccccttcccctcccgcctttcccacactccctgtagcaattcacacaagcggggaggggacgaaactgctgaatccagcagatagcttgtggcggggtaatcctcggtccggccccatacaggacagaaataaaatcgccatttcagctccgggcgcagctggaggaggctgacgccccctagttaggggaaggctgtgggtgaccgagaaggaacttttcccgttttctattcaaatgaaatgagggtggcggtcgcagcagggagagaggagcgaggggagttttcccggcggggctggggggtccacagcggcgcggccacgctcagcccagcgctggcttaggagggacgggctgcgtggggaggcgacggctccgggccgaaggggtcgctcagggctctgcacagctgtccagggggcatcgggagataggcagccgaccgggggctggagtcaagggaagaagaaagagggggaagggaggtgcagggagtgaagaggaggggagagaggagagacgggggagggaggggggaggggggagggggaggggcgggcgggcggccgggaggaggagcgcgcgagccggagtcggagcccgagcccgagcgcgagccgagcggaggagaccctgcggcgcgcggcggcggctcccgggcgtcccgggcccggtggcggcgcggctgtggttggctgagcgccgcgggccgccccccgcccgccccctcccctgctcccctcccccgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtagcccctcccccacccagacaccccctcctccccccgggtgacagcgccggggccgggcgcggcggggcgggactgtccgtgcgtctgccggtccaggctgcggcctccgtgcgctccgccagctctggtcgggggcgggggtccccacgcgccggctccccggggaaaggggcgactcgccctggggggtggggggtgggggggcgggctagtgtttccgtttcacaggcagagcttttctttttgaaaatctgattaggctgagtttttacattcaagggctggcacatgaagcctttaatttccggtggatcggcccgccgggcagccccggggtcgtggtccgcggagggggcgagcagccgccgcttcctgtcgcgcgggggcaggtgcggggggcgccggcggggacactgctcccccgcaggtgagtagctccgactgcagagggggactcgggccgctgcacctccggggccccgcggagagcctggggggcagcgggtccggctctcccctgctgtgcggagataggaagtccctcgaatgtccagcgttcctagcggacttgagttacacgggagaggggttcagaatagaccccctttgttcgtggccccctctgacgggcagggagggacaatgagcgcgccggcttggaaggggctctcatgagctccccctaaagtccccagggaaaagccattgtgaggaaatccctcaaacctcagctgggcgtttcaggaagcccttgcagctgcttctcacctttctgcccacggagtactccactgaaggaggccagggagagatgccccagccaggcacagagcaggtgccggccaggcttgagtctttcctgttcccagaggtgcatttggccagtttaatcagtagatttaagccaacaagcctccctcaccctgtgcccggcttgatccccgtgaaatggaaagtacagccctctcccaccgtagcccgctttgagagactcagataaccgggaggaggaagcatcttcaaggacaggtggtcacccccttatttaatcagtgctgggcagctgggcagctgggcagcggcagacgcacaactagacccaggtccctgactccaggactaggcgtctgcaattgcatgggactgtaacagcctcctttctccccaaaggaaggagtggccctcccttgaatatgtcactgcaccagcatgcacactcacacacacacacacatgctccaatgctcacacatccactcacaaacacacacacgcacacacgtgcatacacacacgtgcacatgagcacacagacatgcacaccacataggcacatgcacacacactttttctgcccgatagatgagaatgtatcaaagacctgcctttaaaagcaaaagtctttttaaagtgagttgtcaccagatcaacagtagcaggtccgtcctaagaacttcctaaagatgtcccgggagcagctctcttggaagcaggtgaaaagtggaggagagcttcaggaggggtgggaggaggacgctgggcatggcaggccaggctgttattgtgggcagggtagcttttcacagtggacacgctgaggttggggtgatctccagaaaagcagcctgcaggtgggccctggggaagacatggcatgtggcacctttgcgggggagaggcggattgactgccagctctaccacttcctgtaccacgagcaagcccctgggctccccaagctggcatccccgtccataaagaagggataataaaatctgctttatagactggaatgagaagggaatgagtgaatgtaaacactgcctggaacactgcagaacacgatgagcattattcttccctcagttccttccataaacgtccttttgtggtgcaaacagggaggcgccagacgggtctccaacccccaccccgccccccatctccacgaggtctgttgcttgctcctgagctgcccccgccctctgccccttgctgtgaaccccgttggaagctcctagctggactgtgagtcctggttgaagctgaatcgtttgcccaagccatgtgccgggcaaagcatgataacttctcgctcacctcccaggctgcacacccagcagtgctgtcacggatgggttgcaccgggctcagctgagagcactttcagtgccgctgccatcagccgccattccttctcttaaagtaccaggcactgggtaaatcctggaatttccagcgtgaatctgtctccctgccatccgccccatctcctctccatcaaaggtcatggaaacaaacccatgttgcttcctaggagggagccctgggggtcactgggtgcaggagataagggatgtgttgctttccgtcactgtgttcgtcggcaccacctggccatgagtcctggcgatgggcacacccgccccttcgttatctctgctctttgtccctctggttacctgacccctggccatctcagtttccccctgagaccgcagagacggggaggaaggagggaacattagaaactgggggttctgccgagttctgtgctccggcaaagctccaggttgacaatctgaagttgtctgagggaggccccgggcagcaagtgccggtgtctcctggcttggccttacctgtgcaggtaaccctgcagacatgcccagtgattcagaggagccgctgcagccacttggcgccaggccaatgctttatttatatgaagaaaactccagacacgcacaggtgtcacatcaccagagtgacacagtgggagtcagcaacaggaatttgggggattgtcttccctcctcaggagcttttccttcagaggttgtgcagaggaagctgggcgtgtgaagtgagtcggaggttgcctcctgagccctacacgaaggcaggactctgtgccctggagtccaactgaggctccgttttcagtgctcccctctcatctcgagaaccttgggtcagttacttcactctgtgcccctgtgctgctgtgctaataattaaatgggataaggcagattgcctggtcaatgagcccgccgtgtttattgagcatctactatgtgctgagtgctggggtccatgggaagctgagtgctggcggaatgggaaggcaactacaaatgataaacagcagcagacgttgcaggctgggtgggccagccccgtgtggggcctgatgaacaggtttttttccctgacgatcggctttgcaggctttgtgggctttgtggggaaggagccctttgtgcagaactggtagccatgaggatggcctggtgagaagctgctgaagggctggggacagcctccacccagccagcagcatctgcaccggcctgttcccgtcatctgttccttggcttgccagggtgcacagatcaggacttggcacttccccagcaccaggtgaagccctcctgtcacccccaaccccgtgtctagaccctcaggtgggctgttaaagaaggggagaggtggaagccaggtccccaaacctagggtgctgaggtccttgcttcagagagactgtgtcctctaggagctgaagcgcttcgtctttccccagaggattcgttttttcctttcctcagctgcccctaccctggggggccctggctgcagcacctgctcctttctcttgcctatggagaaagggtttgctcagctgagctgcccatggagtgacagggacgacgcactcagcactggggagctggagggggtcccacctggtggcacatccaggcttgggtttgccaatcttccgaatcggggaagagagaggcctttgggacccctgggccaggctgtgggctcgggtgtggtgaggagccacatctgggcaagactgaatgctccggggcctctgtggtgccactgccctgacctggcggccccctcgggacactcgcactgtgcgcggcctccctggcgcctctgggctgtggtgttctggtcttggccttgctctgcagctggaacccaggtctgaacacatcggtggccgcttgagtttgcggggctgtttctactgtaaaccagagcagtgaatgcgcacagcccaaagggaggagccgcgctagaaagtgttcaagcgtccgcagaagtcggctcccagttcttaatagtttgccacccaccgtggctacgccacacctacgcttgcctccacccgacctatgcctgcccccttcacatgcgggagcccagggctccgtgccctgggcagctggtggggtctgcccaggccttctcgtgatgcttccacccagcctggtcctggcacccaaggccaacctctgcgggccccagagctgtgcctttttggctcaggtcctccccgcagtgcttggagtccaggcctctgcaccctgctggggtggtctgtggtcctggcccaagggaatgtcgctccctgctgcctggttctactgatctgtcctgttcaggcccctctgccttcatttcttgctttggcacaagcatgagctgctgtttcccccagctcctcaggggagaggagtgcactgccccaaccttgtctggtgtggttagcatggtggggccttaagccctacccggctcctgcgtgcctttcccctctcctgcccacgacatggtcaaatgcaaacctcctttcattttagaaggcatgggctgctcagcccacacgcgcagtgccctttcctgtggctgcaggcatctctgctcaattgtgcagggctgcgtcccccggccacactgactcctctccaggtttctcggctccagcaccactgtctgcgccctccttcccaggtggacggcggctctcctcgccatcctctccacttccagcctatcatctgtctgcctgttacatgtttgtaacttttgacctttaaattggtataaaaatggtactgtaagttcactgaaccaagaaaatctgctgaaggaagggggtcagtcacacccttttggggtttccagtgtatgaatggagggggtggcggtggtggagggacagggagcaatgagagttgccagccttattgctgtcctgacccctggctggggacgactcccctgtctccacctgaattgaagctgggctgtgaaaagtagtaagaaccctcggtttttggttcctttttcaaccagcaatcagccatgaagtgcctgaccacttgagagctacagcaggtgctgtctcggagagggcacaggaaactgggcccttcccaattttagcccaagggtgccgaaaagtcagggagctgctggcctccacactccttcccattggtgtggtccgaattcccctttagccagacatttccaatgtccagaggcccaggaggggacagctggaagccagaagcccacctgacgccatcaggaatttccatgaatgacctggaaacctctcagactaaaccaatgccgcccaatctgggaatccaggagggctggtcccatagagtggtggggacatggtgctgagacggacagcctcgcctcatccgcctttcccacttgccagccgggaggcctgggcaaaatcactttctccccagggaagtggaggctcactgtgcagtccacgcggagcaatggggtgaagtttccagagcagggcagggcatgtggggaggctcaggaatgccacccttgccctcaggcctgggcacagcatagcccccatgacgcttctctcatcctggacccatcagcccggaagactctggaagcagcagtggcagcaccttcctgtcacttgtcttgtcactccccgagtccactgtgagctagaaccacaggctcccatgaagaaggagccagaaccacaggccccatgagcccaggtcccacagcccgcaccttcgtcttccagccagcctctccggagctcagtgtgggtggaggggctgtctggcctcagaaatgggcaaaagacagctctcgttgtcagcgaggtaaatctagcgcagaggaagggcacactgtccccgtcagacgcctcagatgaactgacatgcaaatgagagatgaaacggggacgagccgggcagctgatctcagtgcagcaactgggacacctcggggcataagccgggcagggaggcggcaggaactgggccccagggggccaagacttcctgagaggctgggcccggtagcccagtcctgggcttgcttcccagggggtggtgggcaaccctgaaccctctctcacccaatcacctgctcccctgggtgcaggtgacccagcaagccgcactcctgggaaatttcagaaggttttgggcaagaagggcccagagagcccccagagaccagacggcacagcccgatagctgggcctgccccagacaaagcgtgtctgcactccttggctttctccccagacaaacccaccctgagctcaggatccctccagcttccaggagcaggtgcggggcctgcagggacggctcgcagagaaggcagtttgcgagtcagtgcctggcttgtggaggttgagaccaaggccagttgggtgcttgcatttccaggggtccaaatatttttgagaagaaaatgttctaagaaagtgcacagggtggtggatgaaagaccacgctctgggtaccgtgtacaccgctcgggtgacagtgcaccagaatctcagaaatcaccactaaagaacttacccatgtaaccaaacaccaccccttccccaaacactattggaattaaaaaaaaaaaaaaagattaaaatggttaaaaatagaaagtgcacaagcaagggtccatctgcaggagttggaggagcgcatgcctgtattcctggcactgcgggcacagtcatgccatgggcaccagggacgcccagtgcactcagccacccaggggtggctcccaacattttcaagctcaaaaagaaatattttcacttgagggtgcaacttatttgtcttgaacccatccctgactgcctgtctcccccctcaccctgaccacatctccccaaatcccgaagctggtcacgcaacgggagcattggccctgaacagaaacccgcagtacccctgaaaactcggtctagaaacaactaaaagaagaaccacagcattttattccgtttgctttagattctctgccaatttttttttttttttgagatggagtctcgctctgtcgcccaggctagagtgcagtggcgtgatctcggctcactgcaacctccgcctcccaggttcaaggaattctcctgcctcagcctccggagtagctgggactacaggcgcctgccaccaggcccggctaattttttatttttagtagagacggggtttcagcaccttgaccaggctggtctcgaactcctgaccatgtgatccgcccgcctcagcctcccaaagtgctgggattataggcgtgagccaccacgcccagccttttttttttttttaattttaaattgtggtaaaatatatgaacaataaaccctccctccccatccccctcccccagcccctgacccccactgtacattccgctttctatctccatgaaactgctgagtgcggggacctcacagaagtggaatcacacaggatcgccctgctgtgcctggcctccttcactcggatcatgccctcaggtgcatccatgttgtagcacgtgtccgaatttcctgcctttttaaggccgagcggtattccattgtgtgcgtggaccacattttgtgtttccattcaaaacggatgaatcgatgaaactgcctgatatttttaaagcctcagtcattttcattcttagttcttcagtttgcaaagggccggcctgttgtgatgggtttattgttgcatcttctgaaaaactttgtgagttcccgaaggcctctccacgtcttgagtcatggctgtgctgctttgcgaagctgtgtgcatgtctgtggtgtagcctgtgtacagcctgtgatgcgtcgcagcggaagggtagggggctgcccagggaagacagatgcgccaggttccgctccacggagctcagctaccagccctggtggagagcgcagatggggccgatttgtcatttgtctgcgcttgagcccagcagctgtgtggcctccctggggcaagtcattcaccctctctgtgcctcagtgtctctgtgaagtggggggaagtttttggaagattaagtgggctaatacgcgtcaaatgctagaacacactggcacttggtaaatgctatataagtgttatcatttttgtttgtttattatttatttatccatgtcatggatttaaggcagtctaatctcagtgcctggtggagacccgggcgccacccccccaggttgtcaagtggtccctgtgcctcccactatcgtccccagcacggtgccgtgtccgggcgtgcgtgaagggccagctcacctcacagctctgcttcccaggttagctcccatccaccctccccctacctgtttcctcaccgaaggaaggggcagaaagatgccctccatgccccttccgactgttgcagagggatggaggactatggtacatacacacatatacacgcacacacccaccacacacacacaccatgcacatgcacatcacacacacgcacacaccatgcacacacaccacacacgtacacaccatgcacatcacacacaagcacaccacacacaccaagcacacgcacatcatacacatgcacacacaccacacacaccacacaccacacacacgcacatcccacaccatgcacacacacaccacgcacacgcactgcacacacatgcacacaccatgcacacgcacatcacacacttgtacacaccaggcacatcacacacaagaacgcacaccacacacaaggacacacaccacacacacacaccaagcacacacacaccacacacacgcacacacacgcacacacccaccacacaccacacacatgcacatcacacacgtacacaccacacacagcacacacaaaaacacaccacacacaccatgcacatgcacatcacacacatgcacaccacgcacacgcacatcacatgcacacgccacgcgcctcacacacaagaacacacaccacacacacgcacaccacacacacgcacatatcacacacatgcacatcacatacatgcacacaccacacttacacacatgcacatcacacacaagaatgcacaccacatacacgcacatcacacacatgcacacaccacacatgcacatcacacacctgcatatacatcacacacacatcacacacatccacatgcaccacacccaccacacacatgcacgcacctaccacacatgcatatcacacacatgcacacacaccacacacaagcacatcacaaacaccacacaggcacatcacacacatacatacacaccgcgcacacatcacacacatgcacacacaccacacacgcacagtatgaagatgacagagaagtcagcagagcccctgggggtttcaggagttgagtggggacgaggcaggtggccacacagctcggagggagggcagaaggcacccgtcttcgcagagtcacagtggggcttgcctcctatacgtgccggaagggtgaagccccttatctcattgcccgatgtgatgaggtttgaagtggttgagcttggagggtatgggctgagcccacagcagacaggcctggcagtgccccccgtcttcccaccctgcggtcatgcagcccgactcttgggggcggggtgccaccgtgatgtgccgtcacttgcagcagtatgtcctcatgccaggctgagaccagcactgtgtgaccagcctgccccatgtccctcagcgctgtgtcacactccacactgaggccccactgaagcatgccaggccccatcctatttcttccaggtagtcgtctgcccagcacctcccctcccaggccttgccctaaagcccaggcctctcagcatccaggactctggaatctcccaggtgttgatggctgaggtcatcagctggatgccaggacacccaggatgctccaggtccttgctggggtctggagtttgtgattcagcctcagtccctgtggtgagtccaccatgtgtcctcagacaatggatcagagagcccccagaggacggcccggggccgagtcgggtccagatgccaaaggggcttctcgaggcatctccagctcccacctgcccctcggagtgccaggcttggcttctggaagagaaagctgggggtttagtgactccagccaactgctgtgagcccaaggcatcaaactaaaaatagcgaggccaagagggagtctttgtgttcggctcagtgggcaatggtgcctcacctcgcagcatgacacagggctgatgacacggggcacgttggtcacaaagtgccagtctcagcctggcacagggacgtgccacctgcaggtgatgacacatcacagtggcagccgctcctgatggtgctgctgcattgagtaggagcccagatccagggagacagttgcagcagatgaggcaggaggccagcgaggggttctacctgctttccgggctggcctctgcatggacacaaagcagaaagggcataaaggtgaccctggccaccaaagcagacctggagcaaactggaccagcgcaaggccccggtgccagcactcagagacatttcttttctggcaggaaatttgtgcttcattttctaatgaaattccaaggcaatcaaaaggcaaggaaagaggagggaaaggaagggagggagggagggggttccattcccatccgaatggaagcccccaaggcttctgtagctccccccatcaccaacttcactcaccactcttatctgatgcctcctatttgggtacacacggccgggtcggccttgcgagagactcagtttcctctcgacttccgcccgcctgcactgtcaccacgtcctgccattgacctctgttcatccactcatggtcactgctgtgagttgaattgtgtctcccaaaaaagtggatttctgtgctaacctgtgaatgtcccgttagttggaaatagggtatttgcagacataatcacatcaagatgaggtcatactgcattgggatgggcctcaagcccatatgcccgccatccttctaaggagagggaaaggcagacacacatttgtccatggaaatgagaacggaagacgtagagacagaatcaggccatgtaaagacagactcagagaccagagtgatgcatgtacaagccaggctctgcgggcagcccctagaagctggaagaggcaagcctcctccctggagtcctgggaaggagccagccccgcccatgcctcgagctcaggcttcaggcctccggagccaagagagataaacctctgtggtttcatgtcacccagtttgtggtctttgttatagcagccccaggacactcagggggttgccttgtccacccccatcctggccctctgagggactggttggctcttagaagaccgttcaacctgccctctggtcctcctcccccacccagagacccctggctacaccctgcccaagggagctcaccaaagcccacagggtccctgtgatcttgtcacctgggctcccacaggccagcagtgttggaacctggacatctggctccagccttggtggccacccccgaccttgctctgctcctacagctcccggccttccctgccctggccggcccttgctgaatgtccccgctcctaggaagccggatgtgtcgcgtgcaggtgcctctctgcactgtaataactcctcaccaggcacccttggagcccaggatcaagtcactcaccttccaaccctgcccctgcccagagactggcacgagaaccagtaacagttgttgaataatgaacaatggatgcatgcagctcacccgtgagagggcgttgctcggctgggccagggatgaagcttctcccgcgtggctccaccgtctatccctcaagctcctgatgctcccctgggcacctctgcgccatgaggccccgttgaagtcagttggggaggcagtgtggaccgtgagaagggagtcctaagcacaggaaacgctgccttcctggggccctaaagaacaggctcaccttccccaagggccttcaggccctgacatctaaaaagatgttctttatcaaaggggaaagcagccctggggtgggggcgtggccaccagtgcagtgggcgtggccacaaccgagagggcgtggtcattcgtgcagtgggcgtggtcatcaagaaagggcgtggctgcagccggaagggcgtggctatcagctccagaaggcccttcttgctgtccttggacttgggttctccttgtcgacgaggatctcagctggagctgccaggggcagggctggcaccaaagcacttctgaagtctccccgcctcccaagtgtgaggctgtggggaaggagggagggcagctggcttgtttctggatgagcccatctgactcagcagctgggacccagcaggagcgcagagcaggtcctgaaggtgccgaggccccacccgcagctccgtctcagctttgtgagggctgcactcccccgtgtgcatccggcgtcacaaaggaccacaggcccggcggcctccacagcagacaccaaggccctcgcggtctgaaggccgaattcccaggtcaggctgcagcagggctggttcctgaggcctctcctgggctggcacctcctccccgtgtccatgcagggccgagcctctgcatgtctgtgtcctcggcgcctcgttttacaaggacatctcattttaaaggcccggtctccaaataaggtcatatcgtgaagtgctggggtcagaactacagcatgaattttgacgggacacagttcagtccatagcacccgctttgggaagtgggaatgacctctcccttccccatcttctggcctttgtaaccctaatgtgggaaagcaggagggatccagaacgacattgggtcaccaaagagagcatcgcagcccaaaaggttgaaaggcggcaccaaggtcccgcgcctggtgaccgccgactcgccctcccgggctccaggctgtccccactcccccccgccccaaccccagcatgttgaggcgcctggtcccaactgcccattcactccctgtacacagactgcttctttgtcctccagccaggggtgaagggccatgctggcgaaacagcaaacaaccccaacatgctttgcagcctggccaaccacatgaccagtttgaggaggttggctggagatcacaatgaggaagttggatgagggggtccaacttctagcagcccataagcctatccattcagacaccaaatccatggaaaacagagagacaatatactgattttcaaaagggagacataccccagcaagtacagaccagggaacagggtgctgacgtggccacagttcttaaactactcgacttcatggatggggcacagttttttttaaaggaggatttagaattctatttggcaggtggcatgaaaaagagttttgaatagaaacacacccctccctcccagttgcctgcccagtatgtttgttttgttctcttgaaacaaaggaagagagtggtgaggagggagggaagatgaaccaggaagaatgaaagcacttggcctgcttctcagatggtcttggactgtctccgctcacaggagttgcaggtttttgggttttatgcaagttcggatcacaacaggcctcttgcaagaaccaggcattacctttattccaaaagccttgctgggccttcttgaaaggactggcagccaccacttccctagaaacccgtggcaagttccctcctcccgaccccctgctgtttggtccaggaccccctgcagtcctgactgggacccacttggcccttctcaagggacccagcacaggacgtgtgtttctgctttgatgaaccgccctttcccccctgcagttctagtggaatctcccctcccttatcccattcccacttggaaatgatgatgatggaatgggcgatgccggcttaccaagacatccaagctctctgggtcgaagttggagagaggggtgcacaaaaaggattccactcctgtctgccttcccctgcctccccgctggggtgtccctttcccatggtttcctctaaatcttttcacccatgtccagccacaccattctcacatactgccttgaaactgggctcgaaggggctgcgtgctgagagaaggtcctctcccccagtgatcctccagaggggctgccgcctgggtcccccgagcacctcctaccccaccctccccattcctgccatccccagggtccagggagcccagattccagggaagggttgcattagctcccactcggagtcctgatgcagcagagacagacagaggccctgggagaagtgagcatgaattattaagacaagacaagggtgaggccccagagagggggtggcggaagggtcatgttcatgcagcgagagttgcttcgagcttgaaccgcgtatccaggagtcaagcagattgcaactggcgagaggccttcagaaatgccccgtgagagtcctgtgtgcagagctccatctcagcacacttcctgttcttttggttcgtcgatttttgcattttcagtcccctgtgatccattatttataacagtggagattggcctcagacactagcagtgaggaaaacaaaagcgaagctacgcagaaaaatgacaagagtgatgagcacagcagtcatgacaaatgagccctgtgcggaggcccgggatccgcgcagatgccggcgcgggggaaatgggccctgaaatcccaccgtcaggccaggcagctctgagcgtgacctggagggctgttcagacggtctgggtagccgtgtcctgcgcatgaacatcctccgtcgggagaggaattccccacggattatcagagctgctccctccaccccccgccacgtcccacgcgggccacatcaactccctctgcagcctctggccagcggctgagccctccgtgtctcccctcgttaatgcctccttcaccatcccctcctgaagtttcccccattgcatacacgcgctgaggcccacccggtatcaaggactcccattgcttgcgaaaaagattccacccctcttagaacagagaccagggccgctgtagcaaatggccataaatgccacagcttaaaacaacagaaacggattatctcgcagctctggaggatggagtccaaaatctgaatcgctgggctgaaatccaggtgtgggcagggccgcgctccctctagaggctcccccggagattcccttccttgcctcttccagctgctggtggctgccagcagtttgggaattgcggccgcatcacaccacctttctgtttgttgttgacatccccgcctcccctgcctgcggggtcttagatgtctctctccttcccactgagtttcactccacatttgaattggattaactcatgccatgttaggcaaacgtgcccctcaaatccttccacttaacagacatttattgaaggttcctgtgtgcggggcccaagagaagggacattaaattaggagatgaaccttgggaggccatggcatgcttcggagcctcggcgtcaaaatgacaacccacaccccacttggcggttcatctggggccctggaatcagcagactgaggctggaacccagcaatggcacatgctggctgtatgttctcgggcctcagtttcaacatcagtgacatggggatagaatctgcccagcggagttaagtcaccgcatcccggagagccgagtgtctcatagaggctcctggtgtggtctccatgctgctgctcagcacggaatgaagaggttcaggaacttgcccacagccacggataatgagggacagagctggaattgagcccgggaacctgcacacacagcccagtgtgaccgtgccttctagagagaggccagccctggcaccaggtgggcatgccagcatcaccttcaaggtgtgctttaaggatccaagataatgtgggtgcttcaacagatgcatggcaataaaaggaaagcaccatgtttcaccttcacacacacacacttacacattcacacactcacatacttacacacattctcatacactcacacatatgcttacacacattcacaggctcacacatgcttacacacacattcacacgcacacacattcacacgcacacatacacttacacacattcacacacatacacttacattcacacacatacacttacattcacactcatacacatacatacattcacacacatattcacacattcacacatacacattcacacacatacacttagacaccacactcacattcacacacattcacatacatttacacacacatccacacacacattcacacacattcacatttacattcacaaacattcacacatacattcacacgcacttacagtcacacatacacttatacacagtcacacagacttgcacatagacttacacacatacacttacacacgcactcacaccttcacacacacaggcaatcacacattcacactcacgtacacttacccacacattcacacatacacacaccacatacacgcatacacttacacatgcactcacacactatcacattcacacacacatacacttacaaactatcattcacacacatacacacatacacatgcattcacacacatgctcacacactcacacatacacttacactcacagtcacatacacccacattcacacacatacactcacattcacacgcacatacactctgacacacatatacatacattcactcacacatacattcacacacacacggatgcattagttttcaagtcaggatcctagcacagcccacaccctgcatttgcttggtgtctcctgaggtctctagttatacttcccatcccttttcttgccatgtatttcctgaacacatgttatctttgatccttaaaccatgacttagagatacagatgtatgacaagctgagagatgatgtgagactgttgttaattttttctccatgtactaattacattgtggttatcttaaccacaaaggaagcgttctactccagagaaccgcgtggaaacagtgcagatggactagcacgatacctgagaggagctttaggataactccggtgctggggaggttggggcccagttcaagcaggaggggaggcgtggggacaggtgttgaagctgtgggtgtgcagcggaggcttcatgacgctttcctcctgctcttgtgtacgtctgagcatttccataacagggaagtgttttgttttgttttttaaataacattttaaatgcctctggcacatgggaatccatggtaatttctgtcgttgttgtatattctttttcaaatgcaaggacctgaaaaatatctcctaaactggaaaaggaaatgaggctgaatacagattttattttagcaaatagagaagcagtgattgtctggcggttaactgtaatccattctgagtgtgactttactgttaagtattctaaaaacaagagaccaaacaaaatgaacaatatgtccaaatgtgtatatatataatttgtaactagaggtaaattgcagatgaattgcagatgtacacagacagatggatggacagatgattgatatagattgattgacagatgattcatagataacttgcaatgtttcttcagtgaacgcatatttatttcttgggtaataagaaaaaacaatagaatgtggaatttggggcttggcctcttttagctcatttaaaaaaatattaaacacttggaattatcgagcgctgaaaaaggcaatagaaaattcaccttttaactccctcaaagatagaaatgtgtgaatctgctagtgggttgcgtttggctggtcctgcaggctgatttggtctgttctctctcccagagagatccccaagcccggctgagatgtgcctgtttgtcttgagggcagacaaagcctagcaaaatcttatggaagctgatataaaagcttaatagcttataaaagctctaaaaatgattcacagtctaggatagagaaaataaaaggaatttgaattggtttattttcctttagaggagcctaaatcaatatttattctgagtatgcaatcagaaatatcagtaatttgagaacaaggcaaacagagctgcacatcccgttatggccacgagcccacctcgccttcgttcagaccacagctgaaggtctgacttaggtgcagcacgcacccctggagctgagggcctggagcagggccaggccgggctcttctctctcttgtctgtcctcgtctgtgggggaatgaagatgacacagcactcaggaggtccttttcaggacccagagtcactgggcttttagggcgtttggctctggttctagcccgagtgtggtctcagtccccattggtggttgtggttgtggcatgggcatcattagtcacacaacataaaaccacagaacgcagaatttgctcaccctggttcacacaggagcaagcttgggcaccagcaccccctgaacgcatgccaaagggcaggtccagctcagtgctggggtgtggaggaacccacctggggcctgcctgcaaagacagatgccctgccgtgtttagaaaaagagaaaactggcctaaaccacagtgaggtcaaatggatcatttaacccgtcgagtttggtttcttgttcatccgacgcggttgatcttattaacgcatatgtgtttgtgttgatgtggcctccagcttctgtcgcactgtggacacagttggatgtggctgctaatcaatgcggggctccgtaggtcagtgagagcaatcagagcctgctgtgcggtggcatccccgagttaagacaggcttttgtcccatactctattgaaacacccagaaatgctgacatgttgaagttaaggccatgtgccttggtgctacttgcttgcgaaacagcctttgaaggaaaaaggaggaggaggatccatgagtttcaagggtcccctcctgtaatcacggctgccactcaacggagtaagtaatgtgtagcgggccctctatctgcatgacgaatcctcctaacattcctgtgggcgaggtaggatttgtctcgctttgcagccgaagaatcagagcctcagaaaagttaagaaatcttccctgggtcaagctggtaggaggagggactggaactgaactcacatctccacctcctctcttcctactcctctgcctttcttgcacctagagcagtgtacaacatcaacaactgaccagggcgatcctagaggtaagagacagccgaatggcacggacccagccaagcccaggcctgcccaggtggaacagagccagctaggagcattcggtagcagaggtcagtccgctgattgactgttctcacttccaggcccacagcctcctccaccctgatggtctatgagtctagtgcggccctttgcacaattttagcaactgaacccttttcctcacagaattgtgataccgtcctaacatatgaagcatatataaacagttgggcaaatcataatagtttccattatttcataaatttgcatttgtggcaccaaggagagaattaatgggaacaagagggttcttgtgtgagttccgcatttggatttgggggttcgaggtggcagctataggctcacattagtgtctgcatcactttgcttcagtttgtcacggtggccccccaaatccagaaccgccctcctcgctgtgtgaggagggtcctgcctgcaccgctttgcagacatgggccagcctggatgcctgggcgacgctgccctgcgactcgctggcctgcaggacatctgcaaaacattcaggtctcacggcagtggccatgaacggcctcacagacactgagtggacctgaccccaaagagaatgcgtcgtccttgaacgtgtcgatatttaggttattacacaatgagtgtgttgctttgcaattagtgtctgaaagagttagagcagatgtacatatagaaacgaagaaacgaaatctgaatccatgctgacagattccccctccccaaaccttgctcaaggtaacacaggcgaccaggagcaagtcccggccggccccctgctagcgtggtctgagtggcccaagcaggacccctgcccaggctcactggactctcctggagcccccagacacgacacccttcctcatcactgaaaatccacttccacagtgtaggagatgcatggatctgagggccagtaggaagtgctggagctttaggctttagacattctttttttttttttttttgagacagggtctccatttgtggcccaggctggggtacagtggcgtgagaaattctttaacactctgccgagtcctggcccttggggagtgaggcctggctatgaggcttcttgtcagaactccgtgtgactctcaggatggaagaacagggtgggggctgctcctcccctccctccctccagcccctggcctttgtaaaacggctccgcctacgcgcctgtagccagtgcagaaccagggaggcctctccccttcccttcccaggaggggccccgccttgtcctccatgccggattctgttcgtcctcccccaggtcctctctgctgcctcccactgccccatttcctccaggaaccttcctctctcctaccaccagcctctctcctacccccagacacacactctttacatgccgatttctgtcctctggttaactggcgtttaattttctcagctgcttggcttaatgccaaagagtgttcttccaaataaaaatggtaaagaccttttttctcccatgagaattttatgtaaacgcagtgcagcatgctcgtaggctggttctgttatcaatttctaagctcagcttccagagctagagaacttttttattggttataaaaaccctacatattcagtgcagaaattctgaaaaatgcagaacagtatcagggagaaaataactcatcccccactacccagagaaaaccgctgttaacaccgaagtgccacagttgctggcgttctcacacaggtgtgcgtttaggagtgtgtaagtgcgtgtaagtgtgtgtctggctttctttcacataattttgtgtcctgatcattttcactcagcattacatcagcagcggtttccaatatagcattaaattgtcttcaaaaacatgattttaatgcctctataaagttccatcatggaggctcactaaaatgtaatcacttcattgtttatgagatactcagcttaattccatttctctgcagtgaataatccagaggaacacgctcagtgtgcatctttgcttgcagcagggcagcgcagggcattggttggggtataaatccgggggtgcagtggagattagattagatcgtccgtggaaagcaccagaatggtgcctggcacttaataaatgctcttattagtatgtttatcttcattatgtccctaagagccattcctggaaatgagactgtgagtcaaagggcacaaataccgccaacctgctttccgacagcgctgtgtggatacacgggcccgaacggcgccagcctcactgcctctgcgttagtgccgccacttcatctcagatactctcctgaagataagaggagagtcccatgcagccataagaaagacaacggagagatctgtgtaccctccacccagtctcccctactgggactgtcgtgcaaaattatggcccagtcttacaaccagggtattgacagcgagacaagcccccatctgatccagattctccagttgtacttgctgatgtcgtttagatatttgtccccgccaaatctcatgttgaattggtatcctcagtgttggagtggggcctggtgggaggtgactggatcgtggggtgggtttctcacaaatggtttagtgccatccccttggtgctatccttgagatagtgaattcttgcaagatctggttgtttatgtgtgaaggtagaaggcatctcctctctctccctcacgggtgtgcacgcctcccttcatcatgtgatatgcctgctcctgtttcaccttccatcctgagtgaaagctccctgaggcctccccagaagcccagtgatgtcggtgccatgcttatacagcctgcagaactgtgagccaattagaaattggctttataaatgacccagtctcagatatttctttatagcaatgcaagaacagcctcatgcacttgtactcacttgagcatgtgcacttacttctgcacgatgttcttgcctgtgtagactcttacatccacaaccacagtcacagtctagaacattccatcgccgcaaggctgcctcttataaccaaccacatcccctacctgcacccatttccaacaccccatgcctaactcgatttccagcaccccgtcctggtgaacatgaatctgttctctatctcttcaattccgtcatttcaagaatattatataaatgggattacacagtatgtaacctcttgagactggctttttccaactggcatcattcccttgagatccatccaagtggttgtgtgcaccttttccttgctgagccgtgttccatgttgtgggccgaccccagtttagcactcgcccattggagggttggagggcatccgactcatctctagtgtggggcagtgcgtcaccttctcacaattgtcaacgggattgtcactagtatttgccttccatgtcttggaggccaatgtggctgctcttagaaatcagtcctccttattttggttggggagatttctgatgtcagtttgacgtttataattaataagcatcatcatcaagttacaagagtaaataaaaatatgaggcagggtgaaatgtaagatgctcgagaggctgagatcagtagctgtgtgaatacagcagggcgggcaccagcagtgagctccacggggcccagcgtccggcctcattaaccagctgcccttggggaggagcagagcccgctcttccctcctggggaagggtagtgtgatggaaagacaggctgcccttctctcctgcaggagctcagcatcatgctgtgtacatgcctgggctctcttcttcagccctagccacttaaaaccacttggagggaaagattgtagaataattataatgaggaaaatttcgctccagattcgttactccaagttcagagaagctctgtaaaaattgttgctaaggcaattgaataaagaatgtcagccgatgtaagcgataacagcaagacaatgaacataattgcatgttttacaacaaccaacctcaaagcatgacttccctgacatagatatgttttttaatgattttgaaaggtaacacagacattttcagggatttggagaggaaactaatgccatcctggtttaccagctttatggggtcatctctccggtgaaaaagactgcagccagcctcgcagagagggcgctgtcttagggaggcacctccaactgtccccgcgacccagcccctaagtgcttcacatcaacactgttcttttgtgacggtgctgctgtctttcattcgccagcctgtcatgctcaactcaaacctcagttgccatccagttatcttttttttttttcttgagatggagtcttgctctgttgcccaggctggaatgcagtggcacaatcttggctcaccgcagtctccacatcccgggttcaagtgattctcctgcctcggcctcctgaggagctgggactacaggcacatgcccccacgcccagctaatttttgtatttttagtagagatgggatttcgccacactggccaggctgggctcaaactcctaaccttgggtgatccacccacctcagtctcccaaagagctaggatcacaggcgtgagccactgagcccagcctagttatcttgtttgtccaggaattggagcatttctaggtagcaccacaaatgtctgtgcaagaaacccacaatttccagtggtcattggctttgtgccaatccaaactagagtctgacaaacccagcaagaaatattcgcggcagctgcaaggaagctcctcaaatagaaatagaaaaatgaaccagggtctgctcttcccttccgggtgtggaatcaacggaagccgactcaacacagagccctgggggcgtgaggggtttggcgggatctctgccggctgcagatctctgctctgttattaccagcccttctgcccagctcctaattgctctgaagagggaataattttctcagcagccattgccagccacatttggactgaatagatgctgaaatggcaagggtaaatggggcagagacagtgaaaagccattttctatctggagcccaaataaaatcttcctcccacactcctgcctggctcctccgcagcctcaatgcccttctgagagctgcctgccccagtaggaggccaggctgggaccaaggacacccagttctgggtaaccatcttcccatggctccttggacaaccaccttaaagaagggaaaggcaagaagcagaaggaaagcagaggctggacattggaatcagcctttctttaaactaaaaaaaagttttcacatatgtgaatgcgtgtgtgaatttgaagtcgtatgtggaaggggccatatatccgtcaatgcatgctccaaaaatcagaactgatggacggcaaacagcatcggatgtgcagccagcattcttccggcggccacctcccgggggaaataggtgcagcagacaggaccgtctgtgggacggggacaggcaagcatgacagcaggtaccacagatcagggtgcacagacagggctgggggaggcagcgtggcacggcacccacttcccctcggcgtgtctgggctgaagcccagtggactcccgctgatcagaaggatcctccactagaaggatctcactggacgagtcccctccaaactggaacatgcaggtgccttgggcttcatgctgcacctttcagataaaaacacacaggtgagctgggagagctggagtcccatggaccccagagatccaggtcacgaggaggggatcgcgctgcaccaggacacattcaccaaggtgagccctggttcctccccacaggctgtgggcaaggaagtgtcgatgccaggctggctcagtaggtggaagaaccttccggaatgcctgcccgcaggctgctgctggcatcgagtctgtgtcctattttccattcactgcatgcatcctccaagtatgatttccactcggaaccctgagctgcctcatccctcgctccgtctcccctccctcccgcccagctcacactgaaatcacgcctcgcgttcagcggctggagtcctggtggattgctgcttcggggctctcagaaatccctttacttgagtcttggttttacaggaagaccatgaagcaccccccaggagctggagctcctccttctggacccagtgtctcttctcagcctcacgacgaggagacctgctcatggagctgctgcgccggcctgagctctgatccctcctccgacccagcctcaccctgcaagcagcaccatgtggggctcagaatggggatcttaagggacccttcccacaacctcccgataagcctttccacggagggcccaagcggagacaggagaacactgtatttgataaaatagagtcaaatccaggaaaatgcctctggacccggaaaggaaacgactcaccccccacccatgagagacccttctgtcctgtcccttaacccagaggccctgggcatgggtttcgcagccccctggaggccagaccctcaaactccagccttgtttcttctaagtgtgccagtcaagatgcttctcactgcaagaaacagactctttctcaagccagttcaagaagatctgcgttgctgcagaggccgatgggtgtggggagcaggctcagtgagagactgtcgtaaggaggctgagaggtcttcagaaaaatccccaggacctggggtgccaggagcctgggcgggcctgggctctcgcagcctgcagcccctcccctccctctcacagcctccgctgcccccgggctcagggcccctgcctgtgccttctcctgaggcttctcctttttacctctcagggtcccagtgtggccagcccggcactaaacccatgcgaccctggctcactgacagtcgccaccagctccacatctctcagtaaaagttcccccaaaagagtgtgattgggagctagccagcggggcttaaggcagccccctgctccagtccccttggccatggagacagggcagggttagcaggaggcaaggcatgcgcaggacagctggccggcagaggtcccgtgtgctgtcatgggtgcagggtggacactgtgaccctgggtcccccacttggaaggggtgatctagagggacttttgtcagaaagacccccacccagccaatctgactgatggggccatcaccttgacaacaggcttggtggcaaagcaagagggtacaaccgaccagagccccgggtcccctgtgccctcctgcactgcctgacagggctgggccatggcccgtaccaaccgtgagctgagccaggaatccagtcaaaccgtgtgcctgagtgacacgtagctctcttccttctctggattcactgctgatcaaccccaacaagcagcaggactgtcttgctgtgaacccaccgcttgcggacccctccccaggcctccattcccgcctttctgaaggtcaaggcagcgccctccccaagaaacggtgggaacagaggagccaggtgttcgttcttcccagctccggaaacgctgcagattgcgcactcgagttcctgctgacataacagtggctgccagacaaaatgtggcgaaaagtttttctaggtgcctttgttcactcagagacttcctagagacttgtgtgaaaatcacaggatttgcaaccagtggggacgttgagattcgtggcaactgaaatgatacaaacttgaactttgtgtcaaaccagtagtgttttgtgtaattcttttcaaacctgtcatttcacttactgcttctcacagccccaaggggcaggtggagttgatgccatcaaccctatttacagaatggtaaactgaggctcccactggttatgcgcttgcccacagggttgaaagagaagccatggacaaaaggagtcactggttacccaaagggcttcctgttctcaaatccactgctccttccattacgtggtgtctagaaggaggctcttttggatatagacattaaataatctgggagtcagtgtatgctgtgatcaagcatgtgcggtccgcagccgatggcccaggatgcagtcctgatgtacacttctggctgggtgcgtgggagccacacacatctctgtgtgccttggtttccgtgtgtaaacatcttagactagtgcttgcctgtggttggcacctggtaagtgtcagccttctctaatgtaggcagcttgagggctcccagacagtgatgttcccgctgacattcccaggtctcagctgattatgaagaggcatcaatttccagtgggggagccgccctctgtctcatcatttgtttctctcatcttgctttaatatcacagcactgccagtcaaaccacacaaaagggtttgtgatgacctgccgtgcattctcgtaagctccagccctgactcgcctgcaagccagaagccaacataaaactttcgtttttcccttaatcttgctgcctctgcatctcattttcaaatttcattttatcaactttttttgcactatttgtttctggataaaggatttgcaaaattcttcagcatgtggtcaggaagccctatggcctcctgacgaggcagcctaggggtcctcccgtggtctgaagctgcagccgggctggcctcccacagtcaggagcagcatcaggctgggtgcttctgacaccagcgaagagcgcggctgtccaagcccccatccctagggctcacgcctcatgcccaaactcgcacccactttggcgccgctggagactaatgaacagcaaaagctgaagtcatgactctcatccagatctaaaatgaccgtgtgtcaaacatttttactgaactgatgaatcgaatgggaactggtaagaaggtacgaccagttcaaaagagaaatccaagaaccctaaatgtataaggagtgaagcaatgttgaaatggacttacaaacggatgcagctatattctccagtggagacagccagtgccaacttttgtgcttattccaaatttcctgacagcctccccaccttttttccaacataatctcaaagagagattattctggatggcagaataaggctggtccccctaggtgtggcatccttgcttgcatagaggtggcaagagtgccaccataccaaacaggcctttttcagtttgttttgctggaagacctcagaagatatcagaagcaaaagcctctgttgtttgctatcctaaggttaggaagccaagcataaaaagctctcctccagatttcaccggcagtacttataaatttgatgaacccctctcttctcaaggcccccacgatattccaaaaccctggcctgccagagtagagccttttttcccatcttggaggctgtgaccctgagagcccctaccctcccccaggggactttgtgggcatggacgttgcacagtcaccctcggcccctcaagagcggtcacagcccagcaaatgagcgtcgttctcacgcacgtctctcaggcttaggctcggttgcataaaccttccccaattttatcctggcaaggaggaggacagatccttccggaacctttgcagatattgccaccaaaagtaaagccttcataaaagtttgcatttggggaggaaggagagcagatggtgaaaatcagatatcacttaagaattactcatttcagtttacaaaaaatctaggtcgttaaaggtgactgatagcttaagaagacagggaaagggcttcataacagagccggaaagtccaacagtacaacgacacgcatgatgccaaaaagtaaagcgttcctcactcattccactcagtgctccgtaactgattctccactggctcctgggctgcagcctcatgaagccagctgttcctcaactgaaaagagccctggaagccctgggcagcccactggcagggtctgaatatcatctgagcgaggccatcagaagctgtccccaggagtctgtgcttgggggtcagtcatcggaggtgcttactgcggtccttttccatggggctcgaagcttctgcattgaatcacgagctctggcctccagcctggtgcagaaccttccagggggcattggagtaaaagcttctgtagatgacagctaccccttttttggtccattttatagcagaggaaatttaggttcaaagaagttgagttgagagtcccaggagtaagaagcagtcaaggatccccccaggcctccggggccgcctgggctgcctggcctcacgacctggccccatgctcctgagatggagaagccccaggcccatgagcctgttgcccttggcaaagccacttcccttctgagtaaagtcagacgagcctgcccagtcccaagagactgcgattccgtaatcgccctcccctcgccttttgaggtcttgctggtaggtgcacccccttcaagccagcccaaggagccatgatttgagtcggtcttgccagatgtgtctggagagaatttaactccaagatcatcccccgtgcactctgaggggctgggacaggatgtggtgccctttgtgcccaggaggagaagcacccagtggggcggggtggggcgaggactttataaaggcgtcatttgctgcggccacccaggttggaacacagggaccacagggccccccgccttctgcaggaccaccccgctcatctgagggagacactgtagaaacacatctttgagcagtggcttctaatccaagaaacccaatagaagtcaaacgcagattcctagggcccaacccggacccactgcgtgggaatccctcagccggggccagaagcacgctttgaagacaccaacctcctcagcaagcctcttgcaaaccacatcctgcttctccagaagctgcagatccagaatgttcaaagaaagagccctccttgccttcctcttcttccacccctgccctctgcagactggggttctgtagacccccaaagtaagtccgccacaccggaaggaagtgagttacacaggggcccacatgggaaccgctttttgtcctgtcttggtgggaaaatggccacgaccccagcccaggctctgccacgccacaactccacgggcatagcctgggaggccgcagcgtgaactgtgactagggctgaggatggtgccatggtagaagtgagggcctggcacccggccaagtgcaggactcctcggcagtggggttgggagaagcagcctctgcaggcgaggccaggaaccaggacacaggaggagaagcacatctcagaggagggagctctgggaggagccagcagagtcctgcaaaggaggatgtgggggaaatggggtgaggccaaagtgggggctgctgaaggggctactgcacccgtgcgagcagggccaggaccaagctgcataggcagccagggacacagccgatgccacagacgtcaggaaccacgcaatgacacaggccacctttgaccgaccgttacccctggggcaaataccagtggggataacgggcaaggagaggtgctgtttactgtcttattgttgccagttcagcagcccacaggaaatggtgttagtcacagaaaaaaaaaatctgttttctatatttcactgtttccaagtaaagaaaaaagaaaactaatcttagcttaaaaaaaaaaaaaatggtgcgctgggcaccgaaaaataaccatcttcctaggcctgcgtttcccccacaccggggacttgtgctggaaagaaaagctgcgttggcagccaggagccggggaaactgtccagggaggcatcctctgcgatgaaggcggggcctcggcgtggcccgttccgcgctctgtccagccctggagaagccccaccctcaccgagctcgaaataccccctccctgagagccgagactcatggccgggaccccttggacagaagatgcggatgctaacccggcgcttccaccacagccccggcggcactggggagcgagcgcggccatcccgcgcgtaggtggtgtttctctgcaggcgccagtttcaccgcgggcgcccaggatcctcaacggttctgttgtgatgtgattcccctcttcgacttcgtcattcagcctcagtccctcagtccccaaataccgaaaggcagtcttttttttttttttttgagacggagtttcactcttgttgcccaggctggagtgcaatggtgcgatctcggttcactgcaacctccgtctccctggctcaagcgattctcccggctcagcctcccgagtagctgggattacaggcacctgccaccacgcccggctaattttttgtatttttagtagagacggggtttcaccatgttggccaggatggtctggaactcctgatctcaggtgatccacccgcctctgcctcccaaagtgctgggattacaggcgtgagccaccgcgcccggcctttttttcttttttcttttgaagttaatgaacttgaattttattttatttacagaatagcccccatgagatacttgaagacccggtgccaagcgacagtgttgaccccaggtggtcagtcctgcctggccccttccgagggatgcgccttcaccataaccatgtcacggacaggcgtgtgggcaagggggcatcgctgtatttttcacaactctttccactgaacacgacaatgacatttttcaccacccgtatgcatcaaccaaatgaaaagatgagcctgtgacattcccgtgcgtagagttacagcttttcttttcaaaacgaaccttcagtttggagccgaagcggaagcacgtggcgtctgacgtctccagggagacccgccgccctcgctgccgcctcaccgcgcttctgttttgcaggtaatcttcagcaagtactgcaactccagcgacatcatggacctgttctgcatcgccaccggcctgcctcggtgagtgcgcgctgcgggctctgcccggtgacgccacgcggcctcctcgccttttcgggatggctgggaggggcgggaagaggcgctgaagggcccgaggcaccggccttctacaaggggctcttcgaaatcaatcaatgcgcagaatcccgagggaggctcagccgccctccgggcctctctgcctccacaggtgatggctgtgtccacaaggaggaaaccgtcgggctgaattaaacagaaccgccctcctaagagtgtgggtttttctgccgggcgtggtgtctcacacctgtaatcccaacactttgagaggccgaggtgggcagatcacctgaggtcaggagttcgagaccagcctggccaacatggtgaaatcttgtctctactaaaaatacaaaaattagccgggcgtggtggcgagcacctgtcatcccagctgcttgggaggctgaggcaggagaatggcttgaaccctggaggcagaggttgtagtgagctgagatcatgccattgcactccagcctgggcaacagagcgagactccgcctcaaaataaataaataaataaaaaagagtgtgggttttttcctctcacttcttcattcacttttggagaaagcggggtggttgtgtgtgtttggtccccagccccacatcaccccataggtgccttttctacccagggggcttgacccagatcaacactgggtgaaaggctgacttcagaaatgggttgaaaagaccagtgatctgccttatcgagtcctcagagtcccacaggagttaatgtcctaaatcaacagtgtgttcgagccagtgaattttctaattatcagcaaactttccaaatgtaaagggtgagcaggagtagctttggctcaaggattaactttaaagttaggacggaggtggagaagggcaattgaagtttctcacagacaggtgagaaaagggagatgaaagtacacgtctgaaagtgcagcaaatggcagttttagccgcaaaaatagcccatggtctggggcatctttgggcaccatatatgaagcaatgtgccaataaataaatatatatacacagtattccgtatagcagccctgggatttgagtatcacctctatttcacagattttaacaatttacaactgaagatcagagattaacttggtcgaggtaacacatcttgcaagaggccccaaaacatgtgaggttggaggaagactcatcctaagcatttaaaactattttgtaggagagacttgcgcagttcagacggactcccaaaggcactggaagcggaaagacaaactatgagttcgtcatctgctgatataaatgttagttcctattttaccacagttttttaaaaaaaatctcccaactcaataaagtagacttgctccaattcccattttaaagtatttcagcatctacacgcacttaggattatacgcagctgtttaatttcatttacaatcggagtctcaatgccctggggacggcctcccacccttcccatcccaccacaccttggtcaggctggtcctgggactgtcctggttgtctcagggctctggccccatgtgtacattcaagtgtacatcccagagcacactatgggcgaaaacacgggcttgggtgtgttttccaggaacacgaccatctccctgctgaccaccgacgacgccatggtctccatcgaccccaccatgcccgcgaattcagaacggtaagaggctccggccgcgctcctcggggtgtgcctggcacttctctccatgacatgggaggctttctgtgattttgtaaatgtgctactgcagaaaggtgtgaattgacagcagagatggagagcgagggtaggagccagtgtgaaggaagcttgactcgtcgtgttcccctgcagaggagctgggcacgttccaagataacaattgcagccgtggctctgcacctgcttctcaacgggaggaggcattgtacagaggggaaactgaggcccaggagggtgagccaagagctgcagagccaggccccgggatccccacattaaccccaggaaggacctcgggagattccctacagagcccctggggacatttcgtgtttacccacttagggccggtctctgtgttcataaagtgatgcctgtgggagattctaagcacagaagggccagggacaagggaggcccaggaagtcaagaggagaggccggtgaaagcctccgtgaatgtctgtgaactaggtcaagccagcggtgtatggcccaggaaggacgcggagcaggggccctcaggtcagtgacctgcccctgttcctggtgacctggggagaccccagcagcctccactgctctttgtggttgggcaaagtggaacttagatttcctcatgaggcgagggagcaggtgagctgggggcggggcgtgcgacctcaggacccctctctggcgtcctctgttcctcccagagtggggctcactgtgcctccaagggactcagtagatgcgatggtacacttgtcaatctggtcatcagggtgtcctgcccaactgacccatggccagctctgagcccacaggagaaagtgcatgtcaggcagacccttgtgtcagtgaggtcccagtgggcgtggccagcaccgtccccctcagtgaggccccccagtggacgtggccagtgctgcctccctcagtgaggtctcagtggacatggccagagccgtccccctcagtgagcgctcagtagacatggccagtgccgtcctcagcgaggtccccgtgggtgtggccagcgccatccccctcagcgaggtcctcgtgggtgtggccagcaccatcccactcagcgaggtcccagtggacatggccagcgccgcccccctcagtgaggcttcagtgggcatggccagtgccgtccccctcagcgaggtcccagtggacgtgtccagagctgtcctggtcagccgtcctccctgtcaccttgaggcctcagccgagctcctctcatctggctgtgcccgtcagtctcccctcctgccctagccaggatgcccgtctcctgccccacacagtctggctctgactcttggcttccagactccccggaaggtgcagtgctaattggctccccagagactccagtaagcatcttgtcagcctcagcaccagctccagcctggggggtctcgctcagaagcaaagtcactgagtgacctgtcctcctgacacccacaagactaaaatgatctctcagaggggacctcacagaaaccagcaccttgtccatgccagctgggtatctgagagaaactgctttgttttcctgaagtcatttgaaacagcgtgcagagacatttaaactcggcgggaaataggagaagcccaccttgacccttctaattctctggccccaggtgccttattaacaagagacagtatcagacacaccagacaaaagccctcctgagcccaaagagcccaaatgtctggaagctctctgctgagatgccaaaatgcatgcctttctgataaagagacagagacagatgaggtaccatgatatggacatggcagtggacgtggacaggggagcagtggagatggagaagatggagacacacgcagttgaggatacaggcgaagaagatggagacacacgcggatgaggatacaggcgaagaagatggagacacacgcggatgaggatacaggtgaagaagatggagacacacgcggatgaggatacaggtgaagaaggtggagacagacgcggatgaggatacagatggagaagatggaggtagacgcgggtgaggatacaggtggagaagatggaggtagacgcgggtgaggatacaggtggagaagatggaggtagacgcggatgaggatacaggtggagaagatggaggtagacgcggatgaggacacaggtggagaagatggaggtagacgcggatgaggatacaggtggagaagatggggttagacgcggatgaggacacaggtggagaagaggaagttagacgcggatgaggatatagatagatgcatagggtgtggatctaaccgggtacaggtgatgcggaaacggatctagacagcgatgtggaaatggatctagacagcgatgtggatgtgatctagataatgtggctctggacgtagaaagagcttcagatgctctatctatgatcgtgggtgtggatataggcatagacatggtgaagaggagagaatagactctcctctctcatgacaaactgatcgtggctgggggcggcacgtgctgagatgtggctgtatttgtcccccaggctggtgcctgcgcctcctgcacccccgtctcctttgtgccttcttccattccctctgccactgttaggtccaggcctcactgagctctgacctccctgcctccagcctgcctctcccacacggctgccaggttcaacctggtaagacaccttcttctccatggtggcctcccaatctgggccctgccaacttatgcctcaccaacttctccaacttacccctgtacccacgcccgcaccatgcccagcccacaggatcctgccttcccagctctgcagaaccagcttctgcttatccgctaggtgccagcccagccacctgccttaagcaccatccacagtcacccagcccatcaccatcactagcaaagtcacccagacccatcaccatcaccatccagagtcacccagcccttcactatcaccatccaaagtcaccagccccatcaccatcactatccagagtcaccagccccatcaccatcaccattcaaagtcacccaccccgataccatcaccatccaaagtcacccagacctatcaccatcatcatccagagtcaccagccccttcaccatcaccatccaaagtcaccagcccctttaccatcaccatccagagtcacccagtcccatcgccatcaccatccagattcacccagacccatcaccatctccatctaaagtcacccagacccatcaccatcactatccaaagtcacgcatcctgtcactatcaccatccaaagtcaccaagccccttcaccatcaccatccaaagtcacccagtcctatcaccatcaccatcctaagttaccagcctttcaccatcaccatcaaagtcaccagccccatcatcgtcaccatcctatccaaagtcatccagtaccaccaccatccaaaatcacccagacacatcaccatcaccatccaaagccacctagcccatcaccatcactatccaaagtcatctagcaccatcaccatccaaagtcacccagacacatcaccatcaccatccaaagttaccagccccatcaccatcatcatccagagtcacccagatccatcaccatcaccatccaaagtcactcagcccatcaccatcactatccaaagtcaccagcctcttcaccatcactatcaccaggcccttcaccatcatccgaagtcacccagacccatgaccatcaccatccaaagtcttccagacccatcatcatcaccatttgaggtcacccagacccatcaccatcaccatccaaagtcacccagcccatcaccatcactatccaaagtgaccagcccctttaccatcactatccaaagtcacccagacccatcaccatcaccacccaaagtcacccagccccttcaccatctccatccaaagtcacccaacctgtcaccatcagcacatcactggcttcctcccctcagtgtgcgcctcagtctgaagtgatctcacttacttgtttgaggttctcactgctgctggccccgctggacggtcttctctcataggaaggaaatttcaccttgctctctgctggatttccagcccctaaacgaggcggggcatgctgggtgcaggatggaatgagttggggacggagtgaaccagtccagctcgtgcgtgcctccccctctgcactgcccagagcagttttttcttctggggacgcagggcaacgtctggagacatttctggatgtcaccaggggtaagggcctgctacttgtatctgatgggtggagacccgggatgccaatggcatcctacagcgcacaggacaggcccacaacaatgacacacgtggccggagacatcagcggtgctgaggcggagcacctggtgtctgaggtctcccctgtgctctgtcgctgtcctctcaccctcccccaatcttccaacctagtagttctcagacaactgcgtcagaatccgcagggggcttggtggagcacagagctcccctcagtctctggtttgtgacggaggtgggccccgagaatctttctgcagcagaaagccaggctttctgcaggttcccagtgaggaggacgaggctggcccgggacacgccactgatgctcttctgacccaggggcttttctctcccgcttccgtccctcttccctcgccggcaggtgacgttactggccttttcttttttggccctgcctcccccttggcttctcccctcttcctctcctccactcggtgcctggtgacatgcggccatcctcagagatgtgcttcggggcccgcacgccttgctcctcgcactcttcctgcaccggagccgcggtgcgaggcctcgggaatgctcaccgtttctctcccgccccccggccgcatgctgcagccattccctcaccacatgtccaggagggagccggcatcctttgctgactttcttgctgtgactatggtgctgcgtggaaaaggggccgtgggaaggctgggcaggtggctgctcagagccccacctgacacggtgacccacggggcctggaaattcactgccccgatttccacacaggtgcctgagctcctgcagagaatgcctgagagcgagacgcatgcccgtcaatttgtgctttcaggcgtcctaagcacacacgcctgctcttatttgaaccactccctgtaagctagttccactaaagagtggctttccaccctggctgcagattgcaaccacccaggaatctttttttttttttttttgagacggagtctggctctgtcgcccaggctggagtgcagtggcgcgatctcggctcactgcaagctctgccttccgggttcacgccattctcctgcctcagcctcccgagtagctgggactacaggcgcccgccaccacgcccagctaattttttgtgtttttagtagagacgggatgttagccaggatgatcacgatctcctgacctcgtgatccacctgcctcggccccccagagtgctgcgattacaggcgtgagccaccgcgtcctactttttttttttttttttttttgagacagagtttcactcttattgcccaggctgcagtgcaatggtgtgatctcagctcactgcaacctctgcctcccaggttccagggattctcctgcctcagcctcccaagtagctgggatcacaggcatgcacgaccacacctggctaattttgtatttttagtaaagatggggtttctccatgttggtcaggctggtctcaaactcctgacctcaggtgatccgcccacctcagcctcccaaagtgctgagattacaggcgtgagccaccatgcccagcccacccaggaatcttttaaaaggtaccagttgatgcccagacccctcaattaagtccagatttttaagagattttttttttttaaagctctgcaagtgattccagcacacagtctggggactaaccgctgatataaggtctggaaaatctaagaaaccactctaccccaccctctggtgaccagaagcttatgtctaccagacccagggccttcccttgctgaaacatgctgggtaaactctttgtttcttcctagcagacagcagccctctccctctagctcagaagctacgtcagcagttggttggttggttggttggtgggttggttgggttgtgtctctctttaacttcctccacttctgaagtcacctgcagtgacttggtgtggacttggtcacctcactgtccccccagcctcaggcccaggaaccatgtctttggaggaggctctcctgctggcagctggttgcatctggcatgcttggattcctgcaggtggctggttgcacctagcttgcttggattcttcccagattcacagccatagggtgggcgtttcatgaaatctccaaattccaagggctcttgacagaccacctccatcctgatcagaaggggtgatgccggttgcacggtctcttagagcttaaaactctagcttcttctctgctcctcattccaaactaaacaaattgttgcattggattattctttcaaaatactccttgccttaatgccatcctttagattttggtggctggctcctgttgtggaccgcatctcacaggtggacttcctggtttctgcctcctgttacccctcacagttatctctcccttgagtcctgctaccttccagaaaaataggctccaaacacactttcatcccatcactcccagcatggagttctccagtggcctgttggctacaggacactctccagccccccgcattgggatgtctggccccaatccaccataatgtacttgtctccaatctgctgagctgcatgaatgcccaccccagcccagcgggcactccccttctgcaaacctccaagcacattccccctctgcacactgccaatcttcctgtccccgccccaaatccaaaggcccctcctatggctggggatccactggcagctgcctaacccttcctatgctcctggacgtttggtgcaatctggagcacgctcaagccggcatttgaaataacctggaacacgtttacatcatggaaaatatggaaaataggctgattggcttccactcccttttagagctggcaagaaaaataattgatgactaaacaacctaacgaccaacaaatataaaaagtcatagcccaaccatgatcaaataaggctccagcattcctccttggagggactctgagccatctggtgtcattttcctttccaatccgggaacattctggagatcctgacatccagctaacatgggcgttgcttcctgacaaccctaccccttccattccccagtcactactgcttcaagatgcagtggaaggagataaatcagacacctcagtagcgtgagtgaaagtggggtgtgtggtgagacacatacagaggggagagggccagaggacggcgccgtgcgacacacaccattgctccttttgttcccggtttcggccaagttgtgccgcaggtgactctccaccggctgagctctgtgcatgcagggccagtattctcggccattctggcttagagaaaagctttctatattccagaatggctccaggcctcctcctcctcctattaaatgtgttttaaaagaggtcttagagcccaggcagttagatcttagaaaaagacaaatacagtagaagctggaggcaagcttatcctttccaaagagggagtgcttcctgtgttaatttgttattgagcatgatgaagattcagctccattgagactgagccaagagttgactcattcatgggagcaacataacgggttgtgagaagccaaaggattaagcatctgggagccaagactgatcttgagtggcccagaaatgcaacccaaggatcttgggcccaagggccaggaaggtttctgcagcctcctggagcattcacagaggctccctgtccgtccacttttccctctgttgctgatgtgatggctcctgccctcagcttaccagactcctcggagaggctggcctctgaattggttgaatgggcttgaagggggctggactccatttgggtggatgagcaggcccagtgcccctgtatgaggggaagttgtcttggtaagcctgtttttgtgtcaggtccccaggacaccttcctctgagtctcttgcgtgggagaagttgctggacacgcctctctggctctgtccccgccggcactgtgtgggatccatgctgttctccctccagcccttgccccacctcctggagcccttctctgcgcctggtcactacccgccccccacctccagcattaattttctagggacaaggggcaggggaaggaggagaagaaagagtccttgctgctcctcagagaagacacaggagaagaaagtcggagaggagtggggagccagggtggcaaagccccttcctgctgcccacgcaggtcctggctttctctccacccactgcaccatttccagggctgctctcatggtgggagccggagagacactgagaagaggaaggaaggaggatccaagaggagcccagcacacccggcttctctgctgcccaccctccactctgtcctcccagcccaggcccttcctaggcaaccctggcacgggtcctcactggccacactgaggccatcagcaaagcacctggcctcttcacgccttgggctctgggtctgtaaggcagtgaggctgaggttcctgggacagctgggcactgtggacttgcccagctgagcacaggcatcaggggctagaggggccctagtcccgatgacgaccgagtgccctctccacctggggagcttggaggactttgctctgcacttagggccacgcttcaagcccagtgcctcttatgaccaagtctctggggagaaatgagccctccagtgccaaatgacccaccactaaaaggccttttgaggcagggcctctcctgagcccacgcaggcacgtggtgggagatgagagggtgtgggctcacttcttgacattctgtgtgagtgaggtcattcatagggtgaggggagaatcaaggggacagagggccctctagtccccagcacttgggctcagctggcaagtccacagtgcccggctctcccgagaacctcagcctcaccgccctacagacaaagggcccaaagtgcagggaggtcagtgccacacaggttttattttttcacattattggtgtttaaaattgtaaagattttccacgttacctgtaaccatcaaaccacatgtattgcccccagttaatcaccatgaacagcttggtgtgtatacccctccatattcactgtgtttcttcttccaggaatgagctcattctctatacatcactccgtaacttgttgtttttacctagtaaggagtcatgggcgtcccaccaggtgaatacttgcatgtttgtcttcatcttcttaacaactacctgacactgcagtgtctcagtctgtctgaacttaaacagctagacattgagttctcagagtctggaggctgaaatccaagatgagggtgtgggcaggttctgttcctggggaggcctctcttcctggcttgcatacagctgccttctggctgtgccctcatgaggcagagcaagagacagctctggtgtctttggcccttgtaaggacaccaaccccatcccatgggccccaccctcaggaactcctccaaacccaatcacctcccaaggccctacctcctaatcttacccactggggatgagggcttcattatatgaatttggggtgggggtgcctcaacattcagaccccagcaccatgggaccactaatgtggcatcctgcctgtggagagatgcacagactgacccatccagacagcacagtggagcacgctctttcaacccacctgcacctgaccacagtgggcactcaggaagaaatgggtagagcgagtgaatgaatgaatgagcaagtcaaagacatgaacacatgacatctgactgtctccctgtgtgcttgtgtttcattctgatacatccctccctaaattcatctgctgagacaaaggattttaactggtgtttctacactgctttccccaagatgtggcaacccacaccccaccagcaacacctgtgatgtctgccgccctgtgtccttgtagcacctctcttaccaggtttccaaatgttgctaaactgctgggtcaaggaatagcatctgcctggggttagcctcacttgtgtggattttttcttactcctcttggccactgactgctcctggtctatgcctgttccattggctgcactgtccttccctgcctcttggccagaggctgtcgtgtgtcagcgacagaaacgttttggctgtcgtctgcacagccagtattctctccccatcacgctgggcctcgtgatgatggggggaggggggttgacatcacagagatcccagtgcattttcgacttcatcactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccggtaaggccctgctgtcgttttttaaactaaaagaaggaaaaagaaatcttgagcttgcccctgtgataaaatatatactagttaagcatttgaatctaagcatttgaaatatatatgagttacctttgaagcatttaactatatgttagttaagcatttgaatctgcatttgaagccgatacaactgcagaatctgaaaccttgtactactgtaagggctctgcctttctaaccccagggagaatagcatctgcctggggttagcctcccttgtgtggattttttcttactccttttggccactgcctgttcctggtctatggccgttccattggctgcactgtctgtccctgcccctcggccagaggccatcccaaggactttgcagttgcagggcggcatccactctggtcttcctggcccagcacctgtcctccccgctccactgtgagttgccaaggcaggcatttgtggcccctgggatgccttggggtgcctcatacagttacttgggccgctgtgttacaatcctttttctttttctttttttttttttaaaaaaaaacggagtctggtcctgtcacccagggctggaatgcagtggcacgatctcggctcactgcaacctctgcctcccaagttcaagtgattctcctgcctcaccctcccaggtagctgggattacaggcgtgcaccaccaagcctgggtaattttttttgtatttttggtagagacgggattttgccatgttagccaggctggtctcgaactcctgacctcaggtgatccacctgtcttagcctcccaaagtgctaggattacaggcgtgagccacagcacccagcctagaatgccttttccatttgatttttatcacttttatttatgtgtgatttatacatcataaaatgccatttaagtgcctattttgatgacttttgaaaaatgtgtacacccttgtaaccatcaccaaaatcaagacatttgcaccacctagaaaagctctctcttgccccctccagtgtgtctcagtccacaacggacctgctttctgacatcatccatgagatttctttttgagagtttcatatataagaaattacatggtatatgtactctttttgactcaacataatgtttttgagatccatccatgtgctgtgtgtagagacagttcatgctttgtattgctaagtggtatcccatggtgtaggttgtaccacagggcgtcttccattcactgtggatggacatttgggttgttaccagtctgggggcttttaagaataaggctgctgtgagcattaaagtacaagtattggtggaaacgtatatttttatatatttcatttcacttggctaaatacctatgatacctataaccttgccaacttttttatacagttaaacatatacttaaccgtcttccctaagagtggatataagagtctgtagagtgttccccagtctgggtttgtctgacgtttctctcacgaccagcctgggtgtggtgggttttggaaggaatacgtggggcgcatgacagccaggtaggaccacgagcttctccactgcagagttactgttgatctccttccctgctcttctttgaaagcaagtcacgaagtccagcccacccaaacacaggagagaaaaaccgaggttcgttttctctacacagatattcatttctccagcaccatttgttgaaaagatgatcttttctcccactgaattaccatgacacctttgtggaaaatcgatgggccatgtatgtgtgagtctttttctggactccagatcctgtcgtgtgaatttacatgtcttaaaacaacagcacaccatcttgactaccgtagataaatagtaggtcttgaaatcaggtactctaagttatctctggtttcttttttctttttcaaaaatgttattgcttttattttcaaataaattttagaatcagtctatgaattgcttccaaaaaaacagtctgctaggattttgactgaagttgcattaaatatacagaccaatgtgggaagaattaatatcttaagaatgttgagtcttctggttcataaatatggtctatctccccattcatttgggtttcctttaatgtttctcaataatgtgttaccattgttaatatgaagtacttaataaatactgataaatacatcactatttcatgtatttaatggtactgcaaatggacttttttttcatttcaatttccggtagtttttagtttataggaattggcttctgtatgggaccttgctaaactcatttattaggtctagtacctttttgcagatttcctgtgattctatagatgattttcttatagtgctggtcttctgacaacaaattccttctgcttttgtctgaaaaagcttttctttgctgttttgcttttttttttttcaaagagagagagagataaagtctttgtctgttgcccaggctggagtgcagtgatgcggtcatagctcacgacagccttgacctcctaggctgaagcaatcctccctcctcagcctcccaagtagctgggactataggcacacaccaccatgcccggcgaattttttaagtttttatagggacaaggtcttacagtattgcccaggctggtctcaaactcctaaactcaagtaatcctccctccctgagattacagacgtgagccaccatgcccgactgacagtgtttttatttcatcttcattttgaaagggtattttcttgccatagagaattttagtttcacagttttccagcactgtgaatatgtcttctcattgtgttttagctagtacagcttctaatgagaagtctgtgatgtcttatctttgttcctctgtgtgcaatgtgtctttttccctctggcaacttaagatgttttctttatcactggtttgcaggaatttgattatgatggccttggtgtggttttcttttggtttaacctgcttggtgttcattgatcttcttggaactttgggatcatatttttcatgaaatttggaattttttctgctctcctctgtctctctcctttcccctgggaccctaactacctgaatgatagacagcctgagagcgtcccctgactcactcacactgtttctttctttccagacctttttttctgtttgctttatttttcttagacttttccgtgacgtcttccattgcactggtcttccctcctgcagtatctagtctgctgttaatctcgttcagtgaaattttcatttcagatattgcattcttcatccctaggaattatgtttccctcctttttcgtatctcccatttttacatctcccatttatgcctcattatgtttatatttcctgtaaatgcttatacctcattataattctgtttcatgccattgtctgctggtttcctcctctctgccatatccgagtctgtctctgttgattgatttatctcctgggtatgggtcatatttttctgattctcgtgaatctagtagatcttgatggaatgctgatcacaggaatgcacgctggttcatcatctggttttgtttctcccagttaagagtgttgggctttgccttggcaagcagttaagttacttgcacatcagtttgatgcctttgagccccacctttaagctttgtgagaatggctctagagggcccttaccccagggatagctcagtcctactaagacttgatccctttggggtctcccccaaactcctggctgatcaccaaattccactctggctgtttagagtgcaaatgtttggagatgagaatgaaagcgccagggccttgaaggtcgttgcaaggatgctggcttttatgctgagtggcgtgggcagctattagaaggctttcaggagaggagtgacatcatcacatttgtgttttaaatcttgctcagggcgctgggtcgagatcacgaaagggaagtggcagcaaaggtggaggcagagaaatccaagaggaagctatttttttgggaggaggcggaggcctaggccggggtgggggccatggaggtgatgaggagcgcaggttccagcaggttctaaaggaagagacaagctttttcctaagtggaagcgggatatagagacccatccggggcttctttgacctgagcactgagcgccacggcccagggagggggttgctgcgggtgggcttggtctgctcatcagacatcaggtgcatgaggagcaggcagagtcagggcaggcggcctctcggctgtcggctcccaatggatggtgttgaagtctgggacttggtgaggccagcagggagtgagtgagcaccagcaggaggggccaggcctgagccggacggagaccgaacccatccgtgggagaaggacgctggtgacaggacaccatcgggagcagaggggaagccataaagccctggaggcaggaagaggcaaaggctggccgggtgtgggtgaggtgctgcagggctctcgcaggccagcgaagacaggcgagatggctgtgctcagagttagaagagcatcgctgggagcagaggaaagagggatttctgtgtcacctggggacccatccaggaccagtgggagatggagttgggctcattgagggaaagaggtgaatggaaggaagttggaaccagctgtcctaaggccggagctgctcctccctggaggactccggcaaaggctgctggccttgggctgtgcgggcacccagtggctgagagatcgttgccctctgcagccctcctgcaacttggatcctaggagccacaaagaggcttgaaaaataatccatcctgagaaacacaaaggctcacattaaacttcgcatcgtaaagttttgagtaaaagaacaataaggggcatttctgctaaaggtgccaggatgagaaaaagcaggaaacagtgctgcaccgccaggctctgcaccgtctctacagagggctggggttggttcaggagcattcggcccaggctgtgatctcgagaaggtggtcagggcccaggctcccgccagccctcacggcagcacgaggctggtacgagacaggtgcttcaggtgtttgttgagagctgcacacacttctgctgggctgggcaagacttccctcttcagagaggatgagcggccacacggaaggccaggctgggtgtccctccgggccagccgaggagcgctgcgcttattccgcagtgaggagtcgctggctgtccaggggagctgcattttcctagcagcgacaacccctcccacatctccatagtcacatcctggctgggctaacaccacctttccccgcctctgggtgcgtggggaccccgctctccaaataggccagtgttccaggcttttctttaggagacaaagtcggtgtcaggtagaccccccccaccccaccaaacacacacacacacacacacacacacacacacacacagctttcctgagaaatgtgtttacagaacattttttccatttggggtttgtccttaggaattcttcactctctctatggcaacaaccttccctctcccgtccatcggccttgggtcccagagccactgagccgtggcccaaggtcaggagttagctctagcgacgccgccctgagttctggcctgtaagcaaccccaggtgcccttgtgaatcaacagaccacatttccagtggcagaaaaggaaatgggagctgtttctagactagcacaaggctcagggggtggggggtgggggcagggtgcagggaggccaacgccacacagccccacacccagcctttcccaaggccctgggttcctcactgattctcagcaggtttcagtaaatgcctctaacgggcccggtggaactgtgcaatgcagaaacaccccagggttttgctgttttgctacttaaatattcaggaaatagtaaagagaagagtattatcaaaaacgtgacttttcatagaaaagggagaataggccagccctggcctgggtccacaaccccagtgtgagctgcagagacttctctggagcggtgaacagctcctgccaggaaagagcatggcacagcctcgttctccagcgtagagtagaaggaatggccccgtccacgcgaaggtctgtgttcaccaagcatcttctgtagaaaaatgctctcttcgcctgatcatgggagggaatcaaatggatagagcatttatcccttttgtgactaaaataaaggtaatagcaactacaaaaaccacgacacaggcttctcagcatctttttataacgatagtgctgattttttggaaaatccttgagcctcaatcacttttatttgatgtaagccgctcaaactcaaagagtgttgttttccagattataaaacacagatctcagctgatggcggttgacgggtgtcccccgagtgccctcggctgccaggagctggcaggggagatgcctgtgatgaggattgggtgctgtgatcacagcacgcgggaaaaggacagggcctccctcagcgtggcagatcgcgtgggtccatgggtccgtgtgatctcatgaccgtatcaaggggattgtgtctttttgaccagagcgttagggaaagcgtgctgcagtcacacgccaggacggccccccacggcccaagtcctataggagagccaggggccatcacgattttcttaggcacagcagcagttgaaccgtgctgtcacacttaacccaagtgatgacagcctcttcaactaggacagtgctgtaggggtctggttctgcttgttctcccccacattcctgcctgccctaggacccaggacctgtctctagtcacacacaccctgttcagcctctgcatctggcccccgcggagacccacaccacattctactcccctggccagagaccgagggtgactcggaggcttccagttcccagcagctttattggcgttgctgtttccatagaaggacaataaaagggggccataaggaggcgcatccgcagagtgcgtgcttgagcttctgcaagccagaggaggccggcggccggcagggtgggcaggctggctggctgtgccccacaacatgcatgtggagaggttttgggggcagccatggaaccccggagctgcccccacatgagagttcccccaggtggtgaccaaatgcatttacagtccagccgcagtccagatgcagatgcgctgtaactgtagaacacacagcaaattctgaaggcttagtatgaaaaagaatataaaaatctcagtcatttttatattgatttcatgtttcctggttgagatgtcattgatataacataaagcccaccattttaaagtgtacaacctcagccaggcatggtggctcacgcctgtaatcccagcactctgggaggctgaggcgggcagatcacctgaggtcaggagtttgagaccagactggccaacatggtgaaaccctgtctctactaaaaatacaaaaattagccgggtgtggtggtgcacatctgtaatcctagctacttggaaggctgaggcaggagaatcgcttgaacctgggggtagaggttgcagcaagccgagatcacaccactgcactctagcctgggtgacacagtgagactctatctcaaaaaaaaaaaaattgtacaacctcagtcttttttagtgtcttcattttgttgtgcaaccatcaccactatttaattccagaacatttccatcaacccaaaaagaatccctgtacctgtgagcagtcccccctccatccccttcaccccccagcccctggcaggccctgttctctgtcctgtgcattctgacctttcacataacagaatccgtggcctttccagcctggcttcttccactttgcacacggtgttgcaggctccccgcgttgtggcatatgacagctctttgttcctttatggctggatgacgttccgttgcgtggctgcgtcctgtggctgcattgtgtggctgtgtcacgtggctacgtcacgtttggttgatccgttcatcagctgatggacatttgggctgtttccacaaaggctcttgtgaatgatgctgctgcaaacgtttgtgtgcaaatttttgtatgaaagatacatggtgaaatgaggtattttgaggtacattggattaaatgagatattaaaaatttttttaaagtctagccgtcttgaaggggagggcctgagagaagtgctgaaagttcacagcagaggataccggatgctgcgggtgtgccaggctggcctgtccaggaggtccctgcagcctgggtgggaggtcccttacccactaatgggtgcctcctccaacccctgagtccccctacctgaggacttcctctgtgtgtggcatacgcggctgccccgaggtcagtcctccccagtgaaagggagctgaaggacaggtgcccagcttctttgctccacagtgggaccaatctctgacatcatcaatgcagttgctcaaagggagctcagagcgaggagtcacctgtacatcaactcaccctctgggagctctcttcccttccatgcctcaatcccccactccctcccagggcttcctgggctggcctccaaatgcaccactagcccccagctccttgtctccggtgggcttttgaggatttccaactaagaaccttagactccaagacaggtcaagccccctggcatactcatttgtcatttggatgaaatagccttaggagagctacttaaccccactgaacttccatttccctgacaaaataggaattctaatgcataccttgcatggttcttggaggataaatgaagtaatttatgcaaaatgctgagcacagtgcctgccacttggtaagcgcccagtaaatggttgttatcattgaaaatgacttagggggcatttttgaatggctaaagttatgtctctctggaattgctgaattttaatagaacaggaatgcttcctaaggtctaaaacaaaaggcggaggactggctgtgtctgccctggaagccaagttaatgctggatgtctgcgcatagacatgttgctcatgagaaataataatgctccttaataatattgtctatttcagtgcaatttcagtctagaaggctttataagcaaagccacagtcatccttacttgcatttttttgaaacaaaaagactgcagtgtataaatgaaaaataaccatttctggaatggtgtgttcagacggattccccttagagtagcctagccaacaaagacagcagcagcccttagcgtgccactgtcagagatattgatggcaaacagtaatacggaagcctgcggaatggaagtgtcctgacggcagatttgagtaaaatggagatgatgacagctgaacattgctgcacggacctcaagactgcaaacgttaggactgccctccctgctcctaggcatttgtgagaaccaggccaacccatacccacccactgctgtgtcctgcctgactgcactgaaatgcacagatcctgtgggtgcagtttgatgagttttgttttgttttttgttgtttttgtttttgaggagtttcgctcttgttgccgaggctggagtgcagtggcgcgatctcggctcactgcaacttctgcctcctgggttcaagcaattatcctgcctcagcctcccgtgtagctgagattacaggcgcatgccaccatgcccagctaattttttgtatttttagtagagacaaggtttcaccatgttggccaggctgatctcgaactcctgacctcaggtgatccacctgcctcagcctcccaaagtgctgggattacaggcatgagccactgtgcccagccacagtttgatgagttttgatagaagtgcatgtgttagatctttcaggaatcaccacccaaaccagaaataccatttgacccagcaatgacgtttatatatatacccaaaggaatataaatcattctattataaagatatatctacatgtatgttcattgtagcactattcacaatagcaaagagatagtatcaatccaaatgcccatcaatgatagattggataaagaaaatgtggtacatatacaccatggaatactatgcagccataaaaaggaacaagatcatgtcctttgcagtgacatagacagagctggaagccattatcctcagcaaattaatgcaggaacagaaaaccaaacaccacatgttctcacttataagtgggagctggacaatgagaacacatggacacagggaggggaataacacacactggggcctgttgggagggttgggggagggagagcatcaggataaatagctaatgcatgctgggcttaatacctaggtgatgggttgacaggtgcagcaaaccaccatgacacacgtttacctgtgtaacatccctgcatgtcctgcacatgtatcccagaacttaaaattaaattaaattttttaaaagtgcacgtgcatgtaaccgccaccacaatcaagacagaggacatttccatcaccctagaaaaatgtccccgtacccccttcaaggcagtcctcactgtggagtgctctgcctatttttgagtttcacggagttgaaatcatacagcacgagctctttgtgtctggactctttcactcaacatcatttttgtttgtttgtttgtgtgtgtgtgcgtttgttttttgagacagggtctcacgcctgttgcccaggctggggtgtgaggcacaatcatggctcactgcagcctcgacctcctgggctcaggtgatcctcccacctcagcctccgagtagagacatgttgcccacgctggtgtcgaactcctgggctaaagcaatccgcatcatgatgtttgtaagatccattcgtgcagttatttccttttgcactgctgagcactgcatgcctcgctcattcattcttctgtggagggacatttgggtcatttccagtttagggttcggctactagaattattgtacaagtcttattgtgggcatccttgtccatgatcttgggtccacctaggagttaaatggctggctcatatgctgtgtttgtttaacttaagacttacttgttaagtgtaagaaactgccaagctgggccgggcacagtggctcacgcctgtaatcccagcactttgggaggccgaggcgggcggatcacttgaggtcaggagttcgagaccagcctggccaacatggcaaaaccccatctctacaaaaagtgcaaaaaattagcagggtgtggtggtgtgtgcctgtagtcccagctactcaggaggctgaggcaggagaatctcttgaacctgggaggaggaggttgcagtgagcagaggttgcgccactgcactccagtctgggcgacagagcgagactccatctcaaaaaaaaaaaaaaaagaaagaaaaaaagaaactgccaagctgttctaccaagaggttgtaccattccacattcccaccagcagcatctgagtgatccagctgttccacatccctgcaacactaagcattctctgcttacattttagacattcgagtaggtgtaagagcaatcctatcttcttatagttttaatttgcatttccaagtaacttaatgatgttgaacatgttgctatgtcttattgactatttgaatgtcatattttgtgtagtgtctgttcaacaatactttgctcaggccaggtccggtggctcacgcctgtaatcctagctctttggaaggccaaggtgggtggattacctgcggtcaagagttcgagaccagcctgaccaacatggtgaaacctcctctctactaaaaatacaaaaattagctgggtgtggtggcaggtgcctgtaatcccaggtactcgagaggctgaggcaggagaatcgcttgaacccaggaggtggatgttgcagtaagctgagatcgcgccttgcactccagcctgggtgacagagcaaaagctgcatctcaaaaaaaatatgtaaaaaggattttgctcattttttaagctggcttgtattatttttgtcactggtttgtaggaaactctacataagctaggatataattcatttgtcagatatatgtggcaaacatttttcccaatttgtgatttgcctttttcgttttcttaatgaggtcatttgatgagcagaggtttttaatttggtgaattccatccaatgtaacaagtttttctgttgtggtcagtacttcttgtgtcttctctaataagttttgtttttttttttttttgagacaaggtttcttgttgcccaggctggggtgcagctgtgcgataagctcactgcaacctccgcctcccgggttcaagtgattctcctgcctcaggctcccgagtaactaggattacaggcgtttgccaccacgcctggctaatttttttgtatttttagtagagatggggtttcaccatgttggccaggctggtcttgaactcctgacctcatgatccacccacctcggcctcccaaagtgctgagccaccgcaccaggccccccaaattgctaggattacaggagtgagccaccatgcctggccctaataattttttttatcccaaggtcatggagatacattttagaagatttagagttatagctgttatgttttttcttaatttaaagaaaatttttaacaacccaatctgttgagatgttatgttttaatctgtcattcatttcaagttaatgttgtgtgtgttgtgaagtagagactgccattcattttcttccccacgctgacacccagctgttactgcaccacttgttaaaaagactccttttcccgctgaatccatggctcctttgttgaaagttaatggtatctctgtgtttgggcctctcgctgaactctgttctgcttcattgatctatttgtctatcctcacaccaacaccacactggctacgttactgtgccctggaatcaggtactctaagttctccatgtgttcttcctctgcatttgttttgactgtataggttcttttcttttccctacaaattttaggatcaacttgtcaatttcaaaaaaaaaagccatctatgactttgattactattttatttactatataatttggggagggtagtgtcttaaccatactgagtcttccaacccatgaacatgatacatccctccacttatttaggtctcatttaacttctcaaaaggttatggctttcaagataaaggtccttcatgtcttcggttaactttactccaaagtgttttctgttttctggttttattgtgaataagatttcattaattttccaattgtttgctgctagtttataaaaatataatagatttttggatgttggcgttggatcctgtgaatttgcttaattcattggttagttctagttgttgttttataggttcctataattgtccacagagacaatcatgacatctaagaataatgacagttttaattattgcattccaatttttggcttttatttcttttacttgtcttgttgtactagttgaaactgcaatacagttaaataaaagtgagagcagacgtcctcgccttgttcccaatcttagaggagatgccttcggtctctcaccattacatacgatgttagccacagatttttttgtggatgcctttcataaggttggaagtccccgtctaatgttagttttctgagagttttttgtctcatgttctttgacaaaattctttgttaacttttatcaaatgttctctctacagctactgaggtgggttgaggaggtgtcctctttttccttgttttctaatggttttgtcccataaagaggtattggattttgttccagtacctttctgcatctatgggatgagcatacatatggtttttctgctttattctattaagataatgaataatactgattgattttcaaatgttaaaaccactttgctttcctagggtaaatgcacttatatttccaggaaatgttcctaggaaatttcctggggtaaactcacttgtatttccaggaaatatttccaggaaaatacttgggaataaatgtaacaaagtatatgtaggccctctccctggtgtgtttgctttttatgtattgacttgtttttgtttttgtttttgttttgagacagtgtcgctctgtcacccaggctggagtgcagtgctgccatctcggctcactgcaacctccgcctccaggcttcaagtgattctcctgcctcagcctcccgggtagctgggattacaggtgtgcaccaccacaccagataatttttgtatttttagtagagacagggtttcaccatgttggtcagggtggtctcgaactcctgacctcaggtgatccacccgcctcagcctcccaaagtgctgggattacaggcgtgagccacagcacctggccgcttttcatgtattgctagatttgatttcctaacaattcgttaagaatgtggctgtctatgcttaaatgggatattgatttgtaattttttttcttgcagtgtctttgtcatgttttgatattggccctatagtggcctcataaaacacattgggaagtttactttcttctgtattttctgaaagattttatgtaattttggtattattttgtcctatgtccctttacacttaatgtatttgggttttttgtgtgtgtctttttaatagttaataacaatgtattttattcttgaaaatcactgagagtacattttgcattctcaccacaaaaaaaaactatgtggcataatgtgtatgttaattcacttgatttagccattctacaatgtatatatttcaaaacatcatcttgaccatgggaaatgtatctaatttttgtcaatttgttaaaactttttttttaattccaatttttttttttttgaggtggagtctcgctttgttgcccaggctggagtgcatgaccatgggaaatgtatctaatttttgtcaatttgttaaaactttttttttcattccaattttttttttttttttttttgagatggagtctcactttgtcgcccaggctggagtgcagtggtgcaatcttggctcactgcaagctccacctcccgggttcacgccattctcctgcctcagcctcccaagtagctgggactacaggcgcccaccaccgtgcctggctaacgtttgtatttttagtagagatggggtttcactgcattagccaggatggtctcgctctcctgacctcatgatccacctgccttgacctcccaaagtgctgggattacaggtgtgagccaccacgcccagccccaacttttattttacgtacagatctaaacgtatcacatgcaggtttgttatgtggtgtgtcgcacccagatggtgagcagagcccccaagtctttgttgatatggttggggttagctctcccagtctttgttcatatggttggggttggctctaccagtctttgttcatatggttggggttagctctaccagtctttattgatatggttgaggttagctctaccagtctttgtcgatatggttggggttagctctaccagtctttgttgatatggttggggttagctctaccagtctttgttgatatggttggggttagctctaccagtctttgttgattagctctcccagtctttgttgatatggttggggttagctctaccagtctttgttcatatggttggggttagctctaccagtctttgttgatatggttgaggttagctctaccagtctttgttgatatggttggggttagctctcccagtctttgttgatatggttggggttagctctaccagtctttgttcatatggttggggttagctctaccagtctttgttgatatggttgaggttagctctaccagtctttgttgatatggttggggttagctctacctgtctttgttcatatggttggggttagctctaccagcctttgttcatatggttggggttagctctaccacgttgctatttgctgtttcttgatcttgggttttgtttttctgttcctccttttctgccttctcctgtgttaattgaataaatttttgttttccattttattccttctgctgactctttagctgtctctttttgcattatttttcctcggctgttgtaagtgttacaatatgcatctttacttttttttttttttttttttacaattgatagactttgttttttagattcacggcaaaattgagtgaaaagtgtggagctcccacatgttccccccacacacagacattcagcctctgccaccgtcaacgtcctgcatcagattgtatattggttacagccgggcgcactggctcacgcctgtaatcacagcactttgagaggccaaggcaggcagatcactggaggtcaggagttcaagaccagactggccaacatggtgaaaccctgtctctactaaaaatataaaaattagccaggcgtcatggcgcacacctgtaatgccaactacttggcaggggaatcgcttgaatccggaaggcggaggttgcagtgagctgagattgcatcactgcactccagcctgggcgacagagagagactctgtctccagacaaaagaaaaaaaaaagactgtacattggttacaatcagtgaaccaacattgacatatccttatcagccaaagtctatattccacctcagaattcactctcagggctgtacattccctgggtttggacaaatatatgatgacctgtgtgtcccatcccagtctcagacagaatcggttctctcagggctgtacattccctgggtttggacaaatatatgatgacctgtgtgtcccatcccagtctcagacagaatcggttcactgccttcaaaaccccctgtgcgccacctattcatccctcccgccccaagccccagatctttttactgtctccatagtttggccttttccagaatgtcacatagttggagtcatacagaataaagcctcttcaggttttctttcacttactaatatgtctttaagattcttttatgccttttcccggcatcttagcattgaagcatattccatggtctgtatgtatcacagtttatttgcccactcacctattgaagagcatcttggttgcttccaggtttgggcagttatgaataaagctgccataaatatttgtgcacaagtttttgtgtgcacataagattttaacacatttggataaataccaagaagcacaattgctggatcttttggtaacagcatgtttagttttgtaagaagctgccaaacggtcttccaaagtgactgggccattttgcattcccagcagcaatgaacgagcattcctgccgctccacatcctccccagcttttgtgtttcagtgtcttggattttcaccactctgataggtgtattgcagtatcttcttcttgttttattttgcaattccctagtgacatatcatgataagcatcttctcatatgcctgcttgccatctgcatgtcttctttgaggtgtctgttcatatcttttggccacttttaatcatcctgaacttttcacaatctatttagaattaatactgtaccgcctcacataaaaaataaggacactgcagctatataagtctacttactcccctctcccaccacctttgagttattgtgtcatatgttttatatctgcatacattttaagccccataatacaatattataatttcctttttttttttttttttttttgagacggagtctcactctcttgcccaggctggagtgcagtagtgagatctcagctcactgcaacctccacctcctaggttcaagcgattctcctgcctcagcctcccgagtagctgggattacagatgtgtgccgccacgcccggctaattttttgtatttttagtagagacggggtttcatcatcttggtcagactggtctcgaactcctgacctcaagtgatccacccgcctcagcctcccaaagtgctgggattataggcgtgattataggccactgtgcctggcctataatttcttatttaaacagctagttgttttctgaagaaattatgaaaataaacttccagatagttttttaatagttgcctatatatttgccatttctgatgtttttatttcttctcaacttccaacttatattatatcccttcactctaaagcatttcttttttcttttaatgtttcttgcagtgcatatctgctagtaactaattctctcagcttttgctgattggaacatgccttttttttttttttttttttttgaaatgatgtcttgctctgtcgcccaggttggagtgtacaatcagttcactgcaacctccgcctcctaggttcaagcaattctcctgcctcagcctcccaagtacctgggattacaggcgcccaccaccatgcccacccaggcactccacccaggaggtggaggttgcagtgaactgagatctcactactgcactccagcctgggcaagagagtgagactccatctcaaaaaaaaaaaaatttttttgtatttttagtagagacgaggtttcaccatgttggccaggttggtctcgaactcctgacctcaggtgatccacccacctcggcctcccaaagtgctgggattacaggcgtgaaccaccgtgcccaggcaaggaacatgcctttattttgccttcattgtgaaggatgagttttcatggtgtggaattctgcattcacagtttgttttcttcaagaagcttaaagatgttgactcactttctttctggcctccattgtttctgatgagaagtcagcttaatttgatcattattcctctgtatgaagtgtgtctttcttctctggctgctttctttggggtttgtttgtttgtttgtttgttttgttttgtttttgagatgaagtttttgctctgttgcccaggctagagtgcagtggtgcgatctcggctcactgcaacctccgcctcctgattctcctgcctcagcctccaagtagctgggattgcaggtgcccgccaccacgcccaactaatttttagtagagacaggatttcaccatgttggccaggctggtctcgaactcttgacctcaggtgatccacccacctcgggctcccaaagtgctaggattacaggcgtgagccactgtgcccaggcctctggctgttttcaagctgttgatttctttcctttatctttaggtttcagcagttggactatgatgtgcttcagtctcattttcttcttatttatccttcttcatgttcattgagcttccatggactatgaatttaccttttcagcaaatttgcaaaattgtcagccattacgtgttatatgtgccattctttctcactaatgacctgtatgttagaaagtttgctgttgtctttcaagtgactgcagctttgcggttttttataatcttttttttctttgcccttcaaattgggtaatttctgttgacctgtccttgatttccctgactcttccactgactccagacttctgtaagttgatccatgaagtttttttttgtttaggatattatattttaaaattctaaaatttgcacttgactcttgttcatagatttgtctctcgagactcccctctgtttacgatttactgacgccgcttttgtttcggtgtttgcacgtacctgcaattgctgcattaaagtctcgtttgctcattttggcatctgagccggcaagcgtccagggtgtctgagggatgattttctcttggccatgggtcacattttcctatttctttgcatgtctattttttattgtagactaagattatgaataacacctaggagagacattggattttgttatcatcctctgaagagtgttaattttgctccagcagtcagttccgttactcactgatcatctgaacttcgtgcagcctggttttatgctttgttggggtagatctctagactgacccttctgtggttttagtaggaagcctgaggtatttatcaagcctctctaactcgactacatttaaactccaaactttgtctcctccacagcaggagctgaaacctctgccacactaggcccacaaacatgcgtcattcagggatccaccaaggaacagggtagtttatacagaatttgggtcccactgccatggcttcctcctttgggaactctcctttccatttccatcctctctgacaacctaaaactgtgtcatctgacgcttcaacctggaactttctgcttaagttttagccatctacattataagggcactttatagcaagaaatagaatattattccattctaggccaagtacagtggctcacacctgacatctcagcactttgggaggccgaggtgggtggatcaactgaggtcaggagtttgaaaccagcctggccaacatggtgaaatcctgtctcttctaaaaaaaattttgaaaaaattagccgggtgtggtggtgcatacctgtaatcccagctactcaggagctgaggcaggagaatcccttgaacctgggagccagaggttgcagtgagccgagatggcgccactgccctccagcctgggtgacagagtgagagtctgtctcaaaaaaaaaaaaaaaaaaaaaagaaatattccttcgttcttttataggagcatagtacttcattttgtagatgtactattgtgtatcctactgatagatacttgtgttgcttccagtcttgtttttacagcgatcagatggttcttcttaatttctcttgctacaaatgttgctgctgtgtacaacctgttaaagtccacagatggaataaaagctttggtttgcaaaaatgactcaatctttacaaacattctgtcatttgtaccataatcaattagtttattggatcaccgaattgcctgacagaatccttcctggaactagtctatggggtcatttggcatagagtcaaagcctcagacacgatgagccagagttgatttcctttggcttcacataattaaactttcccagaggattatcaggttacagtgacacacacacaggctgtcagataatggacaaagtcccagcagcgtgtacaaccagctggtggctcccaaattcaaattcccccagcggcatccgttcggttattcgtacccacaccctcccttagaagtttacccctccgccaggcgcagtgactcacgcctgtaatcccagcactttgggaggccaaggcgggcggatcacctgaggttgggagttcgagaccagcctgaccaacatggagaaaccccgtctctactaaaaatacaaaaattagccgggcatggtcacgcatgcctgtaatcccagctactcgggaggctgaggcaggagaatcgcttgaacctgggaggcggaggttgcggtgagccgagatcatgccattgcactccagcctgggcaacaagagcaaaactccatctcaataaataaataaataagttcaccccactacgggcaagaagccacacagaaagaaaaataaaataggtatctctggggttttctgaagggaaagtaagtgcagctctgtcccgtctttgcagctctaaataggaacatggtggagtagggcaggtcgggcttgacgatgtcatgacttggcctctctcagtgtcacgcagcccctgcaggttataaggaggattgagctggccaggcacagtggctcatacctgtaatcccagcactttgggaggccgaggtgggcggatcacctgaggtcgggagttcgagaccagcctggccaacgtggagaaaccccatgtctactaaaaatacaaaattagcccggcgtggtggtgcatgtctgttaacccagctgctcgggaggctgaggcaggagaattgcttgaacccgggaggcggaggttgcagtgagctgagatttcgccattgcattccagcctgggtaacaagagcgaaactccgtctcaaaaaaaaaaagaaggatagagctaacatgcatgaaccacctagaacagcacccagagcatagtaacagctccttgcagatgttacagtaccttgatctatacaacagtaaagggaaatgcatgctagctgccccagatgctgccagcttcacaggcatttttctgcctgcaaactaatcctaaggaagagaggagggcagggggagaaattgcacccagtcaaatgtaaacgatacaaaatgtgaaattcccctctctgaaaatgaaagggaaaaaactcgattcaatgcctgcccctgaggtgaacctgaaatgacaaggcagacactctctagaacttcacgtttggccaccagggtcttcggttgattttcctttcttcgtcatatctgagtggctgaaacgccagtgatctgggatagtcctttggctgctgatagacttatgcaatcccttggcaggcaggacaggccagaggaagggctcctgtgcctttaaggtcactgttaatcatgtaactttattgtgttcctgggctataaaggaaatgtcgtccttgatctgaatgtctgttttatgatgtccataaacagtgaattgccagtgactgtaccctgagtgagaacatcctcagccagttgaatagttcaagggcagttgcaggggtcaggagagagcaaaagtgggacagaagatgagtttgcttcccaggaagagagacagtgccaccccacccctcgctgacagggaagccttccagcccttcctccaaagagccttggctctcaggggttggaggttggacaagagcagaaataaaggcaccctgctcccaccccccacaatcttccggacgtctagagtgcttatctctttgggggcaagtaatgtgaattattttccctaatgcaaaaataaaaaataagagaccccttttacccttttctgaaaggatagcagaggtatttttcttttcttttttttttttgagatggaatcttgctctgtcaccaggctggagtgcagtggcacaatctcagctcactgcaacctccgactccctggttcaagtgattctcctgcctcagcctcccgagtagctgggattacaggcacgtaccaccatgcccagctaatttttttgtatttttagtagagacggagtttcaccatgttggccaggatggtcttgaacttctgacctcatgatccgcccacctcagcctccagaagtgctgagattacaggcgtgagccaccatgcccgtccagcagaggtattttttctaatacttgagaagtgtctgctaagtatgtattcaccggagggtgctcagcacctcgccctgttgctctgggttgggactaacaaggtgaaacatggctcattgcatcatattaatagcatgcaaatctaagcccagtgatgccgtgcaatggctacgatcaagggcaatagaatggatcgtgcatgagctcccaggccacacacacacgcccttgtgatgtattattccctctactcttgcaggtcggtgcttgggatgctagtgcccaagctgatgttcctaggtcacctccctcaatgcatgggtctaggggccagcatgttctattgctagggccatgtgtgcattcgtttgcctaggggagaaaagtacacattcccatcagctcaggtgcgtggaggacggaagaactgctgttgctgctagtattctcttcagcacaagataaaaaggagataggcaaatcagctggctggccaatcaaattaacttattgttacactaatttttagaatcagaattatgggtcaggctgtgctagcaatcagtgaaatcaaatttcatgtcattctgcactgggtagactcaggatttgcctgaaacaagtaaacaattcctggaagaagtgggcgaggcagaggcttgaactatccactcagaccaaggaggagtcaggcaatggcttctgggcatcgtgtggggtgggggcagcccctgccctggacacccgtgaacacggaggcagccgtgtgaacaccatgaggcagggtgtccatcctgccacccacacagctgcgtcctgcccaggaatgaggctggcagcccataggcccctccttggtccctctagaggtttgcttcattccagtacccttggttctgtcaagtgggcagggcctgggcccctctgctgcaaacccatggcccaaagcggacctgatccggcagcatctaaaaacaggacccggagaatctgctggactccaggattgccctggaacaaacctaaagtctcctatgacatgcaaacaattctgccagccccggccagcattccctgcatgtgcttatcaagtgaggaggccagcaggacttagcacccaggtgagcacacttcattgagtccaggtgtgtgcagatgagaagcagccaggagttgaggctgaagaggagcctacctaaacctgtcattacaactgattgatccttggtgtagtcaaatcttctgcctttatgaaagtcatggtatctagaggtaaatccccatcagcttggagcagcaccatgaaatccactctagcatgcagactcgggggcacttttagatattctattggttgttcttgggggacagcttcctttggagaacatgtgagttgtctgtgaatatcagcttgctctccctcggtttccatcacatggatcagcgagagttaatgctgactccccctccctcgggggcttatttgcaatctcccgatttgctcaaaaacttccaggtccagagggaccctaaagaccctgtcatgtccccctgtgaattaccagcatcccaggccattgctgggttttcttaaaactattaagacactatcaacgtgaaatgacttgaataggctttaatttttaaaattcattatacgtcctgcagcatttaggaaaaagagggaggtgtcacacataatatcaaatttggctgacacaaggtgattttgccacgaaggttgggaaggatgaacatttgcaattgaaaactgtttgttgcccccagaatccagcggtttcaggctctctgaggattccagaggtgctagagggggtaaggccacattcaggtggtgcaggtgggattcaccccttcacagcctggaggtggtgcccggagcgcaccctgtcaccccaaggatgatgacaccccagggaaggtggtggaagcaggaaggggaggtcagaggaaaactggggccctcagtgggcatccgtgatgcggaaacactaataatgccaacagcaatagcagaggcaggcagggcttacgtggccagggctgggctggtgctgtcctgagcacttgacatgcatgaaatcacagttgttttaagttctgaactcccctgggaggaaactgtggccacagcaggaattccaatgattctagggtcaggagaggaggcacccacttcctgatcagggctctgtttgtggatgcgtgggtgtggttggcctttgtgcacactggtggttttgcttctttcccccagcaaaagaatgcagattttgcattatctaaagaggcggttccgtgagcccactgtgctgagtcacatatattccatcggtgtaagtaccaccacctgggcagtgcccctggagtgttctcactgggagcgcagctttgtgtctgtacccttcctgagaatagctgacatgctggcctgggtggcgcattggccgaggtgtggctatgacagaccaggataccagcatctgccccagcactgaactgagcacaccacagaaggtgtggacagagtggcatgaaacatgacagctgcttgtgctcgaaattagatgtagccacacaaatcctgtcgtgctcaaagggttccatctccaaagtccaaaggaaaactcttccttaactgttattccattctgtctatacatttcttattttgaagcaaggataggttcacacgctgctgtaatgatgcatgcagagaaagcccactcatggcccggtttctcccagtggtgacatcttgcaaaactctagcacaatgtcacagcctggcattgaccgtgacacggtccagatccggaacatggcgtcccccacaaggatcccacctgccgctctttaatagccacgctgcttcccttccattccccactggatccctgtcccctggcaaccaagaggtctctctcttttttgtttttgtttttgttttttttttgagacagagtttcgctcttgttgcccaggctggagtgcaatggcacaatctcggctcaccccacaacctccgcctccagggttcaagcgattctcctgcctcagtctcctgagtaggtgtgattacaggcatgcaccatcatgcctggctaattttgtattttcagtacagacggggtttctccatgttggtcaggctggtctcgaactcctgacctctggtgatccacccacctcagcctcccatagtgctgggattacaggcatgatccaccatgcccggcctctggtctctatttgtatgatgttgtcaattctgtaacgttctacacatgtaatcatgcagtaggtgactttgggattggcgccttccacccagcacaaccccctggcatccatccgggttgtcgcctatatccgtggttcattcccttctttctgagtcatactccgcggtatggatggaccacggttggttcaaccattctcccttgaaaggcatctgcatcgtttgcatttgggactactacaaatacatccgccaggaacatgtggacaggcctttgtgtgaacatcagttctccgcgtacatcatctctctgccctggtgcttgcatctttagttggttttttctgtcttttgaagaacctaccagactgttttcagaatgactgtaccatttttcattcccaccagccacgagtgagtgagccgtgtttccacgggggttggcattattttgtatcccagccattttgataggtgtgcagtggtgtctcactgtggttgtaactggcatttcctaatggccgagtggctctcagcatctcttcatgggcttctttccatctgtgactttctccagtacccatctgctcatctcttgcccgctttcaagttggctggttttgttttctaccattgagttttgaccattctttatacatgctatctgcaagtctttgtcagatacgtgtcttgcaaatattttctgccacaccgtagcttgtcttgtcatcctcttaccaggatctttctctgagcgaaaattttcattttgatgaagtccagtctatccatttttctttttctggtttgtgtttttgctgtcaagtctaagaactccccaccttaccgaagaccctgaagatttctcctatcttctctctgtgttttatagtttcatgttttacatctgtggtccactttgcattgatttttatataaactgaattctaggtcaaggctctttttcttgttggcctgcggatatctaatttttccaacactactgaaacactatttccaacactattactgaatgccaccacgcctggccatatatatatatatatatatatatatatatatttttttttttttttttgtagagatggagatctctctttgttccccggctggtctcaaactcctgggctcaagcaatcctccaacctcgacctcccaaagtgctgggattacaggcatgcgccactgtgtgtggctggtattttatttataatttcagtgtctacatggtcattgctaagctttcttttctctgttgaattgcttttacatctgggtcaaaaatcagttgggcgtatttgtatggacatggtcataggccctctgtttctttccattgctctacctgtctgtctttctgccagtacctcacagtcttgattaccgaaattatgtcataagtctcaaaaataagataggctgattcctctcattttgtctgttgtttttcaaaattgtttttattcttgtgaatcctttccctatctaaatgttagaataatctctatttctacaaaaaaaaaaaaaaaaaaaaaaagtcttgctaggctttcaatgggaattgtgtaaaacttgtttacctatgtggggagaatttactatgttgagtcttccaacccattaacatggtcagtcttgccatttgtttatatcttctttgatttctttcatgaatgttttgtagttttcaacatacaacttctgcatatgttttgtcagtttgacacctaggggcatttttgagtgactgtaaatggtactggtgtttgtttgtttgtttttgagacagggtctttgtccctgaggctggagtgcagtggcatgatcgtggctcactacagcctcaacctcccaagctcaagcaatcctcccacctcagcctcctgagtagctggaaccacaggcacatgccaccacgcctggctattttttttttttttttttttttttgtagagatggagatctctctttgttccccaggctggtctcaaactcctgggctcaagcaaccctccaacctcgacctcccaaagtgctgggattacaggcatgtgccactatgtgtggctggtattttatttataatttcagtgtctacatgatcattgctagtatatacaattgtagtaaatacaattgaattttgtatgctttccaccctgcaaacttgctaaactcgcttcttagttctaggagggttgtgtttttttgttgttgttgtttgtagattcattggggttttctatgtagacaacatgtcattggcaaacaaggacagttttctttcttcctttctaatctgtttgccttttatttccttctcttgcctattgcactggctaggactcccagcactatgttaattagcagcagtgagagcagacagctttgccttgtgacagtcttagacaccaagcactgagtttttcaccattaagtacagttggctcttctgtatctgtgtgttccatatccatatatccaaccaaccgctgatcagaaatgttttaaaaacaagaaaaacaatacaaattagtaaacagtacagtatagcaactctttacataacatttacattgtattaggtattctaagtaatctagagatgatgtagcgtgtacgggaggatgtgcataggttatatgcaaatactataccatcttatataaggaatttgagcatccttggattttggcatccttgtggggagtcctggaaccaatccctcagagacaccaaggaacaactgtataatattggctgtaaggttatggttgatgcttttaatcaacttgaagaagttctcctccattcctaattttatgagagttttctcatgaacatgtgttgaattttgtcagatgttttttatgaattagttaatatgatcatgtaatttttcttctttagcctgttgattggagactacattgattggttcccaaatattgagccaaccttatatccccagaataaaccccactaaatcttgatatgcaattatttttatctattactgaattctacttgctatttcattagtgatttttgtatctatattcatgagggatgttggcatgtagttttctttttgttgtttttccttgtctgcatttggtatcagggtaataccaacttcataaaatgaatggggcccaggtgcagtggctcacacctgtaatcccagcactttgggaggccaaggcaggcagatcacttgaggccaggagttcaagaccagcctggctaacatgctaaaaccccggctctactaaaaatacaaaaaattagcctggcttagtggcgggcacctataatcccagctactcaggaggctgaggcagagaatcacttgagcccaggaggcggaggctgcagagagctgggatcataccactgcactccagcttgggggacagagtgagactcagtctcaaaaaaaaaaaaaaaaaagaatggtagtgttccctcctcttctgttttcttgaagatattgttagaatcatgttgactttttaaacatttggtagaattctctataaatgtttagaaccatcttggcctggacatttcgttttggggagtttttaaattacaaattgacttttgctataggttgtttaaattacctgtttgatattgaatgagttgtagtacctcatgcttctctaggagttggtccattttattgaagatgtcagagttatgtgtgtagaggcatttgtagtgttcccgtattatccttttgatgtctgcagggtctgtagtgatgttccctctttcattcctgatattgacagtctgtgtcttccctctaattgtttctttgtcagtcttgctagaagtttgacaatttcttattttcaaatacctagctctgttttgttgattttctgcattgtttttctgttttctgttaccgggatttctattcccctatctttgtgatttccctccttccttcctttgctatcattgtgggtttactttgctcttcttttcctgggtgctcatggtgggatcttggcttattgagttgagatttttcctctcttcaaatgaaagcccatagtgctataaatttccctctcagcattgctttagtcatgtcccacagctaagttttgtgttgtattttcatttttattgagttcaatgtctttttaattttcccttgagacttcctctttgacccttaagttatttagaagtgtgttgttaagtttccacgtgtttggagatttgtctgctatctttctgttattgatttctactttgatcctcgtgtggtcagaggacatgctctgtatagcctcagttcctttagattgggtgagatttcctgtatagcccaggatatggtcaatcttggtacatgctctgtaggtgcctgaaatgaacatagcactctgctgctgttgggtgaagtggtctgtaaatattcatcatttgatggacttctaaatttatctcaagactctgagatcatttactctcaaaggttatgtgatacgctaccttttccagacaattcctaagtgatctaaacccctgctgagttcaccaagtggcctgtaaaaccctatgatgattcttgttgatgggagccatcttcccccactagtaggtgtgggcctttcttaaggtgagggccttgagctcgcaccagttcaacctatggctgtatgaaaattttctggctgacatttttacgcttgtaccttcaagaaatataacaaaacatcatttttcttcttcttatcaagtcatagaatgctaaaggcagcgggaatctagggtgatctggtctaccctctcgtttgacaggtgaagcaatgaggtgttgcgaagttaaactgattagttttttttaattttttaaatgaaattaatatacgttaattatagaaaatgcataagaaaaaggggaaatgcataagatagagggaagcaaacatttttaaataaaatttatataaaacttataaccaaagatgactactatttttattttggagtatactctcccaatatgttttcaaaagcaggatcactctctatgactgctttaaaatcttttttttgtactttaacaacagacatgaacatttttcaaaatattatttctaatagcaaaatatcattccagatatatgtctgatgatacagttttctcatcatttatttaatgagtctccattgggtgggcgtgcaggttgtgacagttttctctgtgttaaataacactgtgatgaatatcttttgtgtacatgcatgatgatttcctagaaatgggaccctgggtcagtgcttgtgaacatttttagcttctgagccccattgccaagttggattcttgaaattttttgtttgtttgggcagctttggttttgtttttttgttttcttttgagatggagtttcgctcttgttccccaggctggagtgcaatggcacgatctcagctcaccgcaacctctgcctcccaggttcaagtgattctcctgcctcagcctcccgagtacctgggattacaggcatgcaccaccatgcctggctaattttgtattttttagtagagacggggtttctccatgttggtcaggctggtctcgaactcccgacctcaggtgatctgcctgcctcggcctcccaaagtgctgggattacaggcgtgagccactgcgcccagcgcagctttggttttatttgttttgtttatagtggagggttagacatgaaatcaacatagaagatgacgtaaacttatgactaagcctggtgtgggctctcggtgttctggggcatgagctagaggatggctggagccaggtagagaccgctcccttccttagaatgtcaccttgctgacaaggacagcgctgtgagcatccacaccttcctgtgaggtatctggcattgagcctggtcaggaaacaggaagacaagcaggttccattgagcctgggacctggaccttgtaaagccagccacccagcccagttttacaggccaggcaacaaagggagcaaccggctggacccaggcctgcctcccccgtgcagacccgccgtgagaacaccgtgttctgaattgagacgtgccttgcactcactttgtcccagtaattgcccccataaaatagacctggacactaagaggaaacttcccatatttggaaacccagtcctgcctgctttttatagctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccaggtaacgggcagctcctcggccacagcctccaccccccaacacgtgggattcgggctgcaatggcctacacatcttttcctcttgtccgtgttccatctgtctttcttctttggtttgtagagagagaagaattaatccagagcgtgctggcgcaggttgcagagcagttctcaaggtacagagtcttctaaacttacaaccagccagagatgggcacatctttctctaagagcgagggcaggccccaggctctgaggctggccttggccggcaagcgtggctgtctcacctgcctggaggagctgcccgcacggtggaagccttctgtggcttctgtaactaagccagcttggatggggcccaggaaacgctcaccttagaccaaagaccatgttgagtgggtgcattagaatgtgagctcgtgaggtcgagaatgttctccaccggctcttctgggatgggagaacaagctataagaattggctccactggaaaataagcttcctcgctgagcttctgtgtagttaggagacttccttttcatcggagtcatcccaacaatcctgacctggataccgtattttccatttctcaaactgacttctctgtggcgtcttactgcccaggttaattaaaatagtgaaaagcacagacgggtgggattttttaaaaacctttgaattggccgggtgcggtggctcacgcctgtaatcccagcactttgggaggcggaggcgggcagatcacctgaggtcgggagttcaagaccagcctgaccaacatggagaaaccccgtctctacgaaaaatacaaaattagccgggcgtggtggcacatgcctgtaatcccagctacccgggaggctgaggcaggagaatcacttgaacccgggaggtggaggttgccgtgagccgagatcacgccactgcactccagcctgggcaagagtgacactctgtctcaaaaaacaaaacaaaacaaaaaaacctttgaattgtttaactgactgggttggagcctccagagagcacaacaggtcctccgaaggtgtctgtgcccatcaggggaaggtgcggggactggaccatctcaactgcatgagcagagagagggccatgtgtccaccccagagagcttgggtccactgctcaggcccgaagaagtaaatatgcccaaccagcccagaaaatacacctcatgatactttggtgattctttcctccccatgggacatgatgatttctgaaaagcaagtcctagcatgttggcacctcagaccctcaccagcccacctagaggccttgcccatgcccacagcagggactcagtaggtgtttgcttaaccggttttggctctgagaattttaagggtcatatttactctctcttttctttttcattcctagagcattcaaaatcaatgaactgaaagctgaagttgcaaatcacttggctgtcctagagaaacgcgtggaatgtgagtgacgtttctgtttcctttttgcttctctgtcctttaacctctattcaaattaaccacttggaacggggaggagttcagtgccgaaggtaaatacaaataaatgtcttttctttgtgaaatacttgaaaattacctttgatgttaacaaaggctagcacagtgactaactaagcattttatttctattttaaaagaagcacagctcatggtataaagcattctttcagccccaaagaataaaaatgaacacacgaagccttccgcacttagcccctctgagaacctctgctgagtgtcttgtctgtgtctttttgtgtgtaaatgaagacattctctgcacactgatcggcaccctgtgggtcataattttttggaatatgtctactaagttgttatctcttggtttctgatacagtctggatgtcccctccacatctcacgttgaaatgtcattcgcaatgttggaggtggggctggtgggaggtgtttgggtcaccaggcagatgcctcctaaatggcttggtgctctccttgagatagtgagttctcgcaagatctggttgtttaaaagcacgtggcatctctctaccctcctgcttctccgttgccttccaccatgattggaggcttctcgaggcctccccaagagccaagcagatgccggcaccaggcttcctgtaaagcccacagaactgggagccaatcaaacctcttttgcttataaattgcccagcctcaggtatctctttatagcaacagaagaacagcctactacagcctccaatcaccaccaaaggaaaagcagaaaaaggactagggagccaaggagtgtcgattcaagtcctgattcaatgatcacaaagctcaaattctgggaagaaaacagcttcaagtcacccaccctttttgtcctcatccataatatcaagatcaatgcttgaattccataggcctcacaattctgtgttccactcacagcttgacaagtgaactctttgtcaatgacaaggcaaaggttaatgattaacaggcactgtatttaccaacttaggaactaaataaacagaatccagacaggataccattaagagttgcagcatcaccaaaaatatctggctgattgactgaatgtcgtcgcttttctttttctttttttgagagacagagtcttgctctgttgtccaggctggagtgcaatagcacaatcttggctcaatgcaaccttcgcctcctgggttcaagtgattctcctgaaacatgatttacatagtcagatttatacttttcaaagtgtgttgacatttctaaaaatgtatgtggtcactggatcttcaagacagtttcattttccccattgtcaacgaggaagccacagagaggttaggtaacctcaagttcactcagcaaattagaaaaataaataaagctgggactggcacccagggtcctggccgggctgctgtcacggcctgctacctgcccttctggaacgagtcacttccctgcacacctggctgaagaggaccaggcactccatgaggattccttgataacgcaggttagaaagctaaagctgcaagcaacagaaactgatcgtggctgctttcaacagaaaaggagtttttccctaaaggattttgggaagcttccccagatccccaggaaggcttgggaacagggctcagaggttgtgcagcagcaacaattccccaaatcccgtgcagagctgatgctgtgcggatgcctgtgctgccgtctctgagccccagatgcggcaccagctcccctgtactcctcactctggacctaggtcccccggaggctccacaaccacttatgcagatatcaggctgcttctccatgtcactggctacaggttcaaaatctagacagagccaggccgcgcacccaaggtctagctgcaaggcaggccccacgaagggaggctgtgagtatcctgaagctgcctcacaaagcaccacagactgggaggcttaagcatcaaaaactgactctttcacagctctgcaggccagaagtcagaaatcaaggcatgagcatgactggctatttctggaggctctgaggggccctggttccatgcctgtctcctagaaccttgtggttcccagcaatccttaccgttcctgagcttggaaggctacattgctataatctctgcctgtgtctacacgtgatgacattctcccaggatgtctccatgtcaacagtctctctcagctaggtcttataaagatgcctctctttgaatttagggcccaacctaaatccaggatgggcccatctccagatccctaatggattatatctgccaaggacctttttctacataaggtcccattcacaagttccagggagtaggttgtgaacagatctttctggaggacacaattcaacccaccacagcgagtgtttgcatttccatattctgcactgggaggctggctcagctctccaccaagccccatgtcgcagggaattctccaaacttgggtaggggtttgagccaaagcatgcaaaaaaggcttgctgcagagtccccacccctctttacggacacaaaaagccacgcagtcactacggggcgagtgtgcagatgcccgcgggcagcaggtgcctcccacctctcctcctctctccagcacctgggtttttcctcagccttccccatctcctacgccccacctggaagccagtgccagctccccccatgctcttcccggaaagtgcaaacaggcaagttgaagaggccatgtcgtaactctcaaaactcttacagagaattatgtcgcccacaacaagatgaatagtaaccctgtgtgtctttgaataactgaccctggaaaataaccatcaagccagaagaaaagtgttcctattttacctgcaagtggcaggtgagtcgaagaccactgaaggaaatggcccataggaccttcccccctagcctgttctggctgcggaattctccaaaatttctcacttctcagagggaagcatcttcccataaaaccctcagtaaatgcacatagatggcctggaaaaggacaccgctcttgacccaccgagctcaggctcactgcactgaccaaaattcctggcgcttctatgggtaaaaccggttgtgactagttgtactgatttctagcaccagagacctaggactgcagaaatgggattgagggagctcacctctctaaggagtagagaaggaggaacagtctaggagttgtggagggtaagggaggggcttgggtgaggtcaggggggactctcctcagtcctcctggctgccctcctcccctggcatgcaactcacacccccaccccaggaggcagccatgtccagacaggctgtcctcctcctgaactccacctggctttgggctcatcctccccgggcacttctggctgatggctccccactctccagcggatgtgctttagcgggaggtggccaggatgctgcacctgtgctgagccccagagattctgagttccagagacactacaagggcagcagagccttaacccaaagatgcaagagcccagacattttaggaagcttggagggcagaaacggaaagtccttttgaggagagggcctgcagctgaacctctcacgcaggccactgggtaggtgcgcgcccagcttctcagaaggtcagtcccaaccctgcacggctgccagaagctagccagatggggaaggcggccaggagcctggtccgacaccccgatgcacagggcctgggccagaggcagatgctcccatctacatatgcacacacacatataaacacaaacagagaaaggtgcacatgcactcacatatacacatgtgaaatcacacaggcatgtcaggatgtcacatatacatgcacacgtgtaagcacccaggcacgtgcagatacattcatatatatgatcacatacccacacatgcgcacacacagctgcttctgctatacatgagctgctgtgagctgttttgttttgtcttgtcttgtttttgttgttgtttgagacggagttttgctctttggcccaggctagagagaagtggcgtgatcttggctcactgcaacctctgccccccgaagacaggacacttctgtctcagcctcccaagtagctgggattatagctgcccgccaccatgtccggctaatttttgtatttttagtagagatggggttccgccatgttggccaggctggtctcgaactcctgacctcaggtgatcgacccgcctcggcctcccaaagtgctgagattacaggcgtgagccattgtgcccggccaagctgttttctgcctcttgagttaaaggattcatccactagaactggccaccttaaggccatattatattgtggtggacttgtcttaaatggaatttcctgcttcttcttaaatgtataattcctctgaattgaatataaatttcttcatttctcctcattgactttcaaagctcttcttccttttgatatacaaagtttagccttgttcgagagatctgggatttcccttacgttacggattattttgtaaacagaacacccaggctcctcccctcatgtcctggctggaggtgaaacattaaaaagagattttaaagcagggccctttactcccttccttcctggtttgtggccagggcacagggcagctctgctccatccaccctttgtccctgtgctctgggcttggaccaaaacctaaacacagcgtgggccgtggcaggagctgaccggctggggcaaagtttaacacaggccatacaaacagcccagagcctggatgctagaaccaagccttgcttttctctgtcactccggaagtgtgctctacgcgggctctttagtgaggctcctggaggaagtgttgaaacacaactctattcatacatgtctttaaacagctttcactagctctgtagccaaaggactgggcctgccaggttcccggcctcttgctggagcacagtgaggctggggaaggagcacagcacagagcctcctgagcctcggctcagctctccccgacccccagctcggctctccccaccctccggctcggctctctctgacccccagctcagctcttccccacctgccaggacgatttccccaaagccagcgtctgtcagaaaatcacccttagtttttcctgcaggtggcctgtgacttgtagaagctcacaaaaatctctttcaaagcccttttttgttgctgttttgttttgttttgagacagagtctcactttaatgcagtggagtgcagtggtgtgatcttggcccactgcaacctccacctcccgggttcaagtgattctcccgcctcagcccccagagtagctggaattacaggcagcctgtgaccacgcctggctaatttttgtatttttagtggagacggggtttcattatgttggctggacaagctggtctcaaactcctgacctcaggtgatccacctgccttggcctcccaaagtgctgggattataggcatgagccactgcgcccggcctacagtccttttaagaggacagcccggggtttccagataatactagccccacacacaggcatgtcctagggtccacacctggtcagcgggaataacaggcagccgtgggctgggctcccagccccctagcagggtccagtgggccagggagcctctgctttggtttgtggtgcgtggtctgtgcccgcctgtgttcagcgtttgaaggcagaggagcgggccatgatgggcagagccgacgtccaggctccacggtagggccgtcctgctgctgtctgcagacctctcaggcttgaggccccccgccccacaggactggcccgctcctccctctggattgaggtggagcagggctggcagtgggtcgaagaggggagctgtggaatcttccccaaagcagccgggtgtcctggaaaggccagggagtgaggaggcaggacccccggggacacaggcacacacatccaccacatgctcacctctgcctcctcctgcagacctccccgccagccccgtcatttcatggcatcttgctttctcttcattgaggaatgcacttttgcaatgttgttactcactatccatctacttggccaacagcctcttcataaacttaattgccacaaattctgcatctctgggatgcaaactagtgaagctgtgctgtgtcacccaggaggcttaattttaacatcacctcaataggtagccagggaagcggatctcggtggactctgcactgtcaatacaaacgctatgcacccatcaaaaaccatgagctggcttaaaacagagccttgtatggacatgggaaaaaaattataggtttgttgcaaactcatttagcagcaaaaatgtgatctgaactgacatgaagcccttggtatttatttatcctgctcagtatgataaatagcattttcctcgggggataaaaagaaaaacgtgagctgcgacagcagccactaacatggggaagggccgtgacctcctgatgagtgaaaatagcaagttagaaaacaacaaattttatcttttaaaattaataatagatatatagatacatagacacacacaggatggatagaagctagatagatacatacatacatagatacatacatagatagatactatatagatatgtaaatagaaagataggtagaggctgggtgcagtggctcatgcctaaagtggttccccagcactttgggaggtgaaggcaggaggattgctttagcccaggagttcaagaccatcctgggcaacatggcaaaaccccatctctacaaaaaatacaaaaattagccaggtgtggcggtgcacccctttagaccctgttattcaggaggctgaagtggcaggatcacttgaacctaggaggtaaaggttgcagtgagctgtgattgttccactgcactccagcctgggtgacagggcaagcccctgtctcaaaaaaaaaaaaagaaaagaaaagaaagataggtagatacatagaatgggtggatagagagatagaacggatagaaaaataggatggataaatagaacataggtagatacataaatatgatgaatgcatagatggatgggtggatggatggatggatggatggatggatgaatggatagatgaatggatggatagatagtatataaatggatggatggatagatacacagtaggtaggtaggtagtagatagatagatagatagatagatagatagatagatagatagataaacaggatagatagatagatagatagatagatagatagatagatagataaacaggatgaatatttagaaggctgggagtgggcagaaagcctggaaggacacacattaatacaaataatattaactgagttgttttctgggcccataggatcctagacaagtttttaaatattattctttgaagtgctatttcctacacttcctacaatgataataggatattttatattcagaaaaatgacatttaagacatagtcaatggtccatggaccttggacagagggcccagctgccctgtttgcagtctacaccgcatgcccaacccttccccagatctactcactttcagaatgtgctgccttccacgtgtgaaccagactgagctcctttctgccactgatgttgaattgtccatttgctcacgtcagtgtccacgtggcaaatccacagggcatgggtgggatcctgcagtctagacaaagccaaggagcaccgctggaggccacgttgggcttcccaatccacatgcaaacccaaaatgtgttcttgggtaccttttctgagaagacagcctgtggcatgcatcagcttccttgaggggcccatgatgctggagaaaacggagacccggctccaaaggagaatgtggactcttagtggttggacaaagacgtcccgacctcagacctcaggtaccctgtgtttccccagcggcagctcatctggactcggccatcacgacagcgaccacactggctccagccacatgcacttccggaccccatgtcctctagctgttgggtagaagaggggtggagaaggtttctgtagcacagaaacacatcagcaggaccagatccaaatattgcactctccagattcttcgtccttctggcagaaagaagcagtgtcccgggaacatgcccctacttgacccctgaccctggaaacgcctcgaaacccacccgggaggctgattccagccagtctgccctgggccactgtactgggagagtttctttccggagctgcagtacttcctttggggtgggaaggagttgttacaaactagccaaaggctctgagttgcttggtttttcctttagaaaacatttgctttttatttttagcagttattcagagccaaacttcatgaaaaggggaatagagtggtatcgtgggagtatccttttgcataaaaactaaggtgtgattacaaagtaacaaagctaatcttttttatttcaattggtttatgaaccaactctaattgaaaagccgtgcaaagctgcttgcttcatggcagcttttctggggtaaacgtgcagtcagccaagggtaaatatcttgaagtttaacgctcgctcggaggcataagctccagtttgtttttggttgaaaaatagtatcctaactgttgaggtacacctttgcagtgggactctgtaactgcccaaggggttcaccctgcctgctacctaaacagagctcattcatcaagacaggggaactgcaatggagaaagagccattcacccagtgccggctgtgcgggagaccagagttttattattcctcaaatcagtctccccgagcattcggggcgcagagtttttaaggataacttagtgggtggtgggaagccagtgagccaggaatgctgattgattggtcagggaggaaatcatagggagttgaagctgtctgcttttttttttttttttttttttttttgagacagagtctcactctgtcccccaggccagagtacagtggcgtgatctcggctcactgcaacctccgcctcccgggttcaagctattctcctgcctcagcctcccgagtagctgggactacaggcactggcacaccatgcccggctaatttttgtatttttagtagagacagggtttcactatattggccaggctggtcttgaactcctgacctcgtgatctgcccacctcagcctcccaaagtgctgggattacaggcgtgagccactgtgcctggctgcagctgtcttcttgcactgagtcagttcctgactggggccagaagaccagacgagccagtttatctatctgggtggtgccagctgatccatcaactgcagggtctccaaaatatctcaagcgctgatcttaggagcaatttagggagggtcagaatctcgtagtctccagctgcgtgactcttaaactgtaatttctaatcctgtggctgttagtctcgtccccaggcaagaagcaggtctgctttgggaaagggctgttacagtctttgtctaaactataaactacaaatgaagtttctcccaaagttagttcagccaaggaatgaacacagacagcttggaggttcgaagcaagatggagcccgctaagttagatctctttcactgtctcagtcataatttggccaaggcagtttcaactccaggaatgtgatcaagtccaagttctgctgatcctcaactttgcctatttatttctcttctgttttaagtcaacactttctcctggtgaaactgctctggaaggacgttccaatgaaaagcttttcccataatgagatcgtaatccttgctgaaaacgctttgccgttcactgcattttaatgctctggcaccacatgtgcccccttttctttttgggataaaagacgcctttgtcccatgtcctcagctggtgcttaggggtatggagcaaaaagtgggtgccagagttgagattcagggagtggagagtggggaggagcttctgccttctgaaaactgcccggatggatgcggtagtgcagcggtggccacggcacatgcctgcgaggatagagtcagttgtggctgagctaagcgcggaagtgcaggcaaaacctgagtatcggcagccagggcaggtgtggggacctctgcactgaggtatattcctccctgggagccacagggagcccttagttaccagccttgagagatcctccacattcgtccgtggtaacccccttgctgtctctctctctgtcaccagtggaaggactaaaagtggtggagattgagaaatgcaagagtgacattaagaagatgagggaggagctggcggccagaagcagcaggtagggtctgcgctggggccacgggcggccgggcctggggagggctccccgtaccagttgggctggggctgtgggctttgtttgcctaaaagaaaggctggtgcagttcggtacagttcaggcttgggagagtgcagtctggaggcagccaccctgcttgcgacctgcttgtcagtggtgtgactttcttctaacaaaagagcacgcatgggccgggtgtggtggctcacgcctgtaatcccagcactttgggaggccgaggtgggaggatcacctgaggacaggagttcaataccggcttggccaacatggtgaaaccccgtctctactaaaaatacaaacggtagccaggcatggtggcacatgcctgtaaccccagctacttgggaagctgaggcgggagaatcgcttgaacccaggaggtggaggttgcagtgagccgagatcgcgccactgcactccagcctgggctcgacagagcaagactctgtctcaagaaaaaaagagcacatattggagataggggctgggaagacgatttcacagaagaagagtcctcctcctgcagatccaagccttaggagcaatgtgtccagcttggaataagttgatatccacttttaaagacagaacaagaagaggaaaagcattaggggaggagcctcctgttgcccccagggacccggttccttgtgtgatgttcccactgggttgcattccagcgagggcttcagcactggggacacagaagtcattctcctgggaacaggcatccttcacaggcgcttcggggggcccagtgagctgtgactcgtggggaaaatgccccagtctccacgatgccacctccaaagtcagttttgtgtacagcaggactctttactggagccagggtcaggacacgtgtggatgaaccacgaccaaactggggatggaaatgccggtagtagcaaagagacggcggtgatgatgagcagagcgcatgcattgaggcacttactgtgtgcgggcgctgtgcttagtgaggggcacacaggacctgctcacacctccgggctttgcctccatgcccgctggtgccagcccagacaccacaggcatatgatgtggctcatggttccccagagtgccactgcccggcctcagtgggatttaatggggactaatggactgagaaacagccctgtgcaattgcactgagttgtctcagagccacctggcatgctgacgatcattccctgattttgaaattgagggcaatctgcttattgaggaagcgtggcaagtgaaagggtctcagaggcagaaggtgaagggaaagccgacgggcctcatctggtcccctcaaagccccgggggcctggcctcggggtgggcgcagggaggaaggccgagcggaaggaagcaggccttgtctgagccacgtgagagcctgtcctacagggaccgtgccacgtgtctgtcccatgcactcatgggctcatttggagttagggatgtctcagcccaattgacttaggggaagtcaggccatagtttgtggccatggaaagttgtgagtgaacaatccatcttcgtcatccctgtgctggaggctctttaaaggacgggagacagagtctctcatttgtgagccaaggaagagctcccaagttgcacagggacggccacacagctggggtcccaaggctgggacctggcaaggctgggacccggcttggcagcctcagacacacagcaccttcacctgtggcaccgcccttggccgtgggctctacgtggcttggttcagccctctggctgtcccttgcgccccaggtgccatggctgctttggcaggagggtggtgttccagggtggtgctgcctggcagggttcccctctgcccagagccaggcggagatgggttgcctcaagctggggctgcgggtgtagcagggccagcctttccagccccaccagcagcacgaggggaagaggacaaaaactgagttctagtcttcagcctgaaaccagactccctgaacagcggcctctgggccccatatgggttggggaactccaccgccccaaggggtgtgtctggagccaggccatgcctcccgaagctgcccccagctcctcacccacaactgtgtgtccctgagcactttctggaggtgtttgtaggatgcagcctcttatcccttaaacgactgcatttaccgcccacctacagcagcaggagtgagtggtgagacagcctccggcctcacaggtcttgcctctgccgtgcctgatgggcacccgctctgtagaaagcaaggcgagtgctcggatcacacgccgctcctggcgtggtttctggtgtgcactagtcctgcaggtcaggttgaggttgcaggggggaagattatttttatcgaagttgtagtcatttcctggggctgcgtaacgaattctcataaactgggcagcttaaaacaatagaaatgtattcccacatagttctggaggccacaagtccaaaatcaaggtgccagcaggccctgccacctctgaaggccccaggggagggaccttcccggtctctcttggcctctggtggctgccggcggcattctctgcctgcttcttcacctggtgctcccatccgttctgtccaaattccccctttttgtaaggacacccatcctattggagtaggggtcaccctcctccaggatgacatccccttaactacatctgcaacagtcatgtccccaaatgaggtcaccctcagaggcagcagggttaggacttcaacatacaacttttggggggagatgtacttcagcccataacacaccacgtgggaggataacaccgatttcagagcttgcagaggaagccgccaggaactccagtgagacatcagcccccaggtgcctgtcaggcacgccgggctgtggggggcacctgggcccatctgagtaacggaggcgcatccgcacttcccccaggagtacatttttagaacccacagcgccataaaccaaagacaaggagacttcctggtgccccgtcagcttctggaggcgacgttctcggctgacagctctggcagcctcccctgtaggtgagagacaggtaaatgggactcttgcttccaaaacggaacagggtaaaaattctcaagcgttgtcgacacattgagaaaaaacaaatccagcctcctgggctctggtctcatccccagccgcgtcatgtgccccaggccggcgttgccacacatgaaaccccttcctgtttttctatgtagaaaggaactcagaatagagacactgagatattcgtgttgtcccttttgtctttgtcaacagcagagttacatcttactcatgagagccctgtagcaatgtggggaccctgggaccagtctcagttaagctggaacttccccggatgactggggagaggagctgcaaaaggcagggtgggggtggggggccttcccgagatggcagcccagccagaggccagcgttcttgcctctgggaagagaataaaggccccagacagggtggagctagctcagccccgtgccacacaaatggccagtgtgagcctgaaatgtggagctacattcagcccacatagcacaccctggtggggcctcggagccaggggtatggatccaccagaagctgccccttgggaacagcagtggcatcggggtccggcacacagcacccgggagcaggtggccgtcccctgacactcacgggctaggtttctcctgcttttccctcaaagaggacagaggtccaactgccagcttacatttagggcaggggcaggggcaggtctaccccaggggccacggccactctggcccccagcactgtgccaggcagagagcagagcatggaatatggggttcacccagagctggggagtctgcaggagcctggggtggcaactgagggctcagcgttcatcccaaacaaatggccttgcccactggcctaagccccagagaagggggatggggaccccaggaaatgaaagcaaagataagctccaaataggatgaaaagaaagagctccatgccagctgctctgtttgctgaagacgctggttcccgtggcagcggagcgcagagagaggggctgcctggccaggcagggtcagcgggccccagcagaccctcctctgctcccagctctggtatctgcaaggaaacagcgggattcgaacagtcaaactgtcttgctcggtgaagatttccataaccctcctggggaatgcaggagacttacagagacagcacatgtgcgaatgtttacacaaaacaggttaaaagcagcgaagaaatcatcatcatgccatctattttttttaactacgcagaaaacgttcgttacttctcagaaatgtgtaaatggaatttctcgtttaatggatgacaatggaaatcatttgattggtgcattttgttggttggttttgttaatactttgctgaatctgttagcgttcccccttacacatcaaactgtggtagcaactctgatgggttttgcaagcatgaaacagagggaagggctaccaaatggatctccgtggagcggtggttatcacggggaagagacggcagcatgccgagaaaataacaccgaagcctctttttccagaaaggaaatagattgattattctagttttgaaaatagcacaggctcattggaaaacctccaaactacactgatgggagctgaagggtgcacaccgatcatgacaacagccggcaatgtccccccagtttaaacctggacacgaggccttctagatgtttttctgtgcatagataccttgttttgaaaaacaactaaaacatgcgttgtgtagtctttttttttactagtggcattgtgagcaataaatagattaaattttaaccagcgtacagctcatagattttcccagaaggccacaatcaagcactctttttaaacctaccgaatgtgctctttcttcctcgtagcgtggcattttttggcacttgctttcagtacatactgtgcatagcattcttattttcccttttcatgtcaagtttcctcacttggcataatatccgtgatgatcctcctaatggcataatagtccatcatgcggaggcactgtgctggtttaaaccgcttcccgtcttgggacattcaggtggcttctagtcggttttgtgtttttgttacagcagatcacaccacggtgaatatctgtgtgcatagagctgtttgttcctgtttaattcttggcttaagataaattccccaggatagatatgtgggcttaaaggatacgaatttctatatggctcttactgggcagtattaacttgctctcccagaagaaggggctttatttacaaatcgcaggagcttctgctgcatttagctccctgagtgcccccatagcctggtgaatgtcacacaagccaggcgtgacccccacccaccatcgtccaagtacacagggagcctgttcacttccaagcaagttcacacccatagggtgtgaacccagatcggcccagccccctggtgcactctgctgcaggggcccaagagcagccagacctcctggggcagctgctcctcattcagcctctggggaccaccctgaagccagcacactgcccaaccggaaggtggctttcctctgaaacatgcctggctcactttgccctgctcctatgtgggatacctcgataccaagtgctaaacaaaaacagagtcagacagaaaactcatctgctaacattacatgtaacagggaaagttggaaacattctaaaagtccatcactggggactggattgctaacgtgtgctatggccacaccctggagaaacttggaaaatgaagctaagctctgtggagcaacttgggatgagttcatgatatgttagatgacaaagcaggttgcagcagactgactttggtgcaattccatctttgtttaaaagtacaaaggggctgggcgcagtggctcacgcctgtaatcccaacactttgggaggccaaggcaggtggatcgcttgaagtcaggagttcacgaccagcctggccaacatggtgaaaccccgtctctactaaaagtacaaaaattagtcaggtgtggcagcatgcacctgtaatcccagctactcaggaggctgaagcacgagaattgcttaaacccaggaggcagaggttgcggtgagcaaagattgcgccactgcactccagcctgggcaacagagtgagactctgtctcaaaaataaataaataaataaaaattttaaaaagtacaaaggggcggggtgcagtgactcacacctgtcatcccaatactttgggaggctgaggcagaaggatcgtttgaacctaggagttcaagaccagcctgggtaacatagcaagaccctatctctacaaaaaataaaaattaaaatattgttaaaaggtaaaagcggccacccatgtgtgtccacacttcaaaacattctggaaagatacaccaaactattagaagtgatttccagagtatgggatttagggaaataaatgggtaaagtgaggacttcggttttcatattttggtgtttttttttttactttactcttgtgttgtttagattttttagaatgtttttcttttgaaaacagcttctaaaagagaagatagccctcaacatctgacttttttttcttttttttttgagatggagtttcgctcttgttgcccagactggccaggctggcgtgcagtggcacaatctctgctcactgcaacctccgcctcctgggttcaagcgattctcctgccttagcctcccgagtagctgggactacaggcacacgccaccacgcccagctaatttttgtattattattatttttttaatagagatgaggtttcaccatgttggccaggatggtctcgatctcctgacctcatgatcatcccgcctcgacttcccaaagtgctgggattgcaggcatgagccaccacgcccagccccaacatctgactttctgtgtgttttccaagagtctagtgtgaggtcagaggtcagacaggtcatcagggattttgcttcgagtgagttgctgctgccctgactcctctcccacagcaaataagaccacacggggcttgggggttgggtttgtcgcttgcttttgctgtgctgagggcttcaccagactgaaacagcaggaccacagctcatctctgctccttctctctaggaccaactgcccctgtaagtacagttttttggataaccacaagaagttgactcctcgacgcgatgttcccacttaccccaaggtaagatgagattccggcccagaagaagctgcagctgtgtccccagccccacgcccagccctgtggccctgcggccagaccctgctgtgtgtacgttcacatcaaccgcccctcccagccctgggccgctgacggtgcgggttactttaaggcaaagtattttttctctttgacatttgtttagcaaaagtgatcccagaccataccttcccctgcaaggacataacagctccgtgctgctgtctgcccggccccgggagctgacctgggtagacagtttttacactcaaacgttactggaaagaactttaacgtttaactgaatttttaaaaatccattccattggcccttgtctctgagcaattcttagttgtcctggcaagttttgctcttttgcacaaaagtgttcttagttctaagagaagctgtgacgttggtgaagtagcaatggcatttttgaaataacgacaaaaggagggtctcgagttgccggtcacccgctcaacgccttcagctgggaagcaggcaaaatcccggcccacctgcttttttttttttttttttttgagacagtgtttcactcttgttgcccaggctggagtgcaatggcacaatcttggctcactgcaacctctgcctcctgggttcaagcaattctcctacctcagcctcccaagtagggggcattacaggtgcccgtcaccatgcccagttaatttttttgtatttttttagtagagacagggtttcaccatgttggccaggctggtcttgaacttgtgacctcaggtgatccgcctgcctcggcctcccaaagtgctgagccaccgcacccggcccggcccacctgatttgtaatgtgctctcatgctaagattcagggggcacagcttccagagacagcagaggcctgggctaaacacaggtgggctctgccactgcctgcggttcaagtgatggcagagccttccacagcctccatgtaggccactggtgtccattagtccgtgattctatccacgcagttccaaacaatgtcctggatattgtcaggttctgggtggatttggggggtttttgtttttttcttttgatactgagtctcactctgtcacccaggctggagtgcaatggcatgatctcagctcactgcaacctctgcctcttgggttcaagtgattctcctgcctcagcctgagtaggtgggattacaggcacccaccgccatgcccggctaattactgtatttttagtagagacggtgtttcaccgtgttggccaggttggtcttgaactcctgacctcaggtgatccacccacctcagcatcccaaagtgctgggattacaggcgtaagccagcccagcctcatctgagatttttgaatggagactagtgcctttttccattggaaaatatgccccgcgcttctcaggatcctgtcccagggagccgtgaagcacagcctagatccaaaataaaaggtgtcagccctccagatctgtccccttacaaaaaacagaaaaacaaatatccagtaagacctaggagaagacagtgtgcaataccaaagcagtgttcttgtcttctgtatagaaccacagccttctgtccttgtgacagcttaacctaaagcctgatgtcctcagaagcaacccaggggcaccggccccatcagcaggcctgctcttctagctctcggcagaaaccaggaatgggttccagacaggagcatctcagaataacttcttaggtggtatctgaatttatgccaagtgaattttacccccacacttcactttattgccctttttttattattatttttgagatggagtctcactctgtcgcccaggctggtgtgcagtggcacgatcttggctcactgcaacctccccctcctgggttcaagcaattctcccacctcaggctcccaagtagctgggattacaggcacctgccatcatgcctggctaatttttgtatttttgtagagtcgggattccaccatgtttgccaggttggtcttgaactcctgacctcaggtgatccgctcgcctcggcttcccaaagcactgggattacaagcatgagccaccatgcccagctattgtccattttatcatcgggcttgttgaggtctaatttacatgcagtaaagttatttaggcttggagtacagtgaattttgacaaacttgtttagtcctgtgacctccaccacaagcgagatatggaacatttctgtcaccccaaaccctcccctctgctccctcaccctgcctctggcatccaccgatgggatctccacccgtagcattggccctttccagaagtatgtggcctgtgagtctgacgcaggtgccttagaaagagaacgggagaagctgggtgcggtggctcacacctgtaatcccaacacttggggaggccaaggcgggtggatcacctgaggtcaggagttcgagaccagcctggccaacatcgtgaactccccatctctactaaaattacaaaaattagccaggcatggtggcgggcgcctgcagtcccagctactcaggaggctgaggcacgagaatcacttgaacccaggaggcagaggttgccgtgagccaagatcgcaccactgcactccagcgtgggcaagagtgagactctatctcaaaaaaaaaaaaaaaaagaaagaaagaaaaagaaagagaacgggagaaagaggagaaatatctcagcatgcacatcactgtcacaggcccacggcgcctggttaacacggaactcctgtcctttctagtacctgctctctccagagaccatcgaggccctgcggaagccgacctttgacgtctggctttgggagcccaatgaggtaagtgcggggcttgcaggcaccacgtcccagggggaggcagctcaggatcttggacgccagtgggaccacccccatcgctcttcctccttcttgctttttcctcttctttttaaagactgaaaaaaaaaaacaaaacttgttttgccaggttttagttgaaactaactaacactttatagcagggcccaggagacttcacagcaaggggattctgtgagtgggggagacggctgtcaggggcagggaggctccacccagggctcctgatggcgctgggccccccgagccatctgctcatcctgcagaccctcatgcacgccggtggcagccccgtgctgcagaacacccctgccaggagcaaatctctcctcaaggaaggggctgcggtcagagtgctctgctctgagagcagtgtctgcaaaggcaaggcacaggcaaccggctgccccagataagtggacatgtgggattccgggaactgtgtcaccttctgcagcaaggcttgaggccaggaattccacactagcctgagtgatatgatttggctgtgtccccacccaaatctcaccctgaattgtcataatccccacgtgtcaagggcagggccaggtggagatcttgaatcatgggggcagttttccccatactgttctcgtgatagtgagtaagtctcacgagatctgatggttttataaatgggggattgtcttttgcctgccgccatttaagtgactttctccttctctgccattctccatgattgtgaggcctccgcagccatgtggaactgtgagtcccttaagactctttttctttataagttacccagtctcaggtatgtctttattaacagtgtgagaacagactaataagctgggcaacatagcaagacctcgtcgctacaaaaaaaaggtgttaaaattcctatttgctgaaaaatacaagaatggggaattttttgtttcatctcattggctaatagaccccctcttttcacaccccaaaaaatgaaaaagttccctcattgcagacctcggcctcagctgttttcaacgcaccaaaatctaaggacgttttcctgcttgtcagcaacacagaaaatgcacaaggctcctcagcaagctcacctgtgctctttgacaagctcggccgcagcgatgtctctgcaaagggcagaaagtgggctcttgcctcttggcacccctgaggccaggctgctgacacctggggcactgccctctcctaagtgaacctcttttcatgtgcatggtctcccagcaggagaaaaactgcagcaccagccagaaaagcaaagctccagcctccactccccagctcagttcacccaagagcagcaggcggccagtcccaggggctgcactgctgcaaacctgctcaaaacctccagccgccacgtggcaacttgctccccagctctgagagtgcaggaccggggcgcagagacgacagaagaggctttaaatatgcagaatgactgtctaggtcaacgcacaaaaggaaagggccccaggtgtgggagatgcaaggggtgagagggaaagctcagaagagacgtgttggagctgctggcctgcagcagctcccagggtccctgcacagctgctgagattgggcagagcaagtacacagcaagtagacaccgcagacagttagagcacactgactcctgctcccagcctgtgggcaaccgccgcacctcagcatcatgtagaaaaatcaccatccccaaagtcattttgacctcagcctgctgggaggaagagccaagccaggggccactgatggcaaagcacctgcgtggaaactggcactcgctgtcttttctgccaccttctaccagggaaccctttgagcacgggccactgtgactggggaggtggggcttgccccacgaagctgggggatctgtgtctccataatagaaaggccacctctctgtcctctgatcacagagtggattcacagctgctctcggggctggcaggtgggcaaggcagacagctcccggcagctggactcagcctctgggtggcatctcccacggcccgtggctcctgcccagcagatctcaagggcactccaggagaccgatgagggttccagtgcttccaagaagtatctagctgcctgtgtgtgagaatgcagagatgcccaagacaggagccttggcctctggcagatctagggatgccaggaattttggagtgtgagtggcaaagagggacaactaaagggacacacatgaaaacagcccactcggccccacaaaactgcatctggccacgcatgaggcacctggcactcagagaacgtcagggcgcctaaaagtgatcacctccctcccttccagcaggggcgcccccacttttctccgagtggtttggcccagtgtcctgcccatcacaaaccagacagaggacatgacttcaggctgctgtgtcctcccatgtgttagggcctccgagggcccagggctgtggcccgtgagcgtggcctgcctctatcctccgagggcccagggctgtggcccgtgagcgtggcctgcctctatcctccgagggcccagggctgtggcccgtgagcatggcccgcctctatcaagtgcagagctggaaggctgcaggagcctcccccgtcatctcatgagtcccccactcacgaccatgcagcccactcagaccacgacctgccgccacatgcgggaactgctggctccctcgtgcccgcccggggctgaggactgcacgtgcagccacagatgcatccggccctcctgccccacagcctctatgaaggccacataaatggcaccaagtgtctctgtctgccgatcagcatcccctcttggcttcacagcagacgcatctgcctttcaggactgccttgaacaacatctgggctggtcaggtggagagcgaggagtttccaggttgcagcccctatggtcctgagggctggcgtccaggatggtgggggtccagcagctctgggcagcgaggcccctggctgggtgatccaggtggcagctgaccagtggcctgggagccagccctcctgtcctcacgtggggccccatctccaaaagccagtgcagtgccctgcacattatccaacctacatctgtactgtctccccaaggaaaacgagtgtgtggttcacgtgctttaaggacgtttcccaggtgacattccaagctcccatctgtggccgcaagtgggggagtttccagttttccagatagattttctgccatgccagagaaccctccgcctccttcagagccatctcatcaatgcagtgatcgcaagcttcgatttacaaaaactcgcctcccttgcagcatttccaggtttcacacacagcgtaacaagtaaaaatggatttttgggcagcacgcctgtcctagtttgctgaggctgccataacaaagtaccagagactggggtggcgtcagcagcaaaagttgattcctcagttctggagctggaagtccaggatcaaggtgctgccaggttcggcttctccggaggcctcggtccctggtctgggaccttcttgctggggcctcggtccctggtgtgggaccttcttgctgggacctcggtccctggtgtgggaccttcttcctggccagcaagatggccgccttcttgctgggtcctcatgtggcctgttctctcggcacatgcatcccaggtgctcttcctcctctaatgaagacactagtcccatgggaccaaggcctcaccctgactagatggaaacttcattacctccgtaaaggccccgtctccaaatagccccactggggtcggggctttaccatgttgacctggggaagggggcagttcagttcgtaacatgcccttttgggaggagaaagtcaggcaatgagcagacacaggcaggaagccacgccgggctccagcagggatggcccagtgccctgtacaggcagcaggcagctgggctggaggtgggccctgggtggaggacacctaccaggtgtgtctaaactgcccctttcctacacatcttccttcgcactgggctcgccacccaagacctgctttttccagaaagcaaagcctactttggtcaaactctcatttttaaaaatcacttcatcttttcctccctaacttaattagctccaaagcactgagctgtattgaaatagatcaccacaatgacaatcctctttgggactgaaaacaaaatctatttcaacttgaacagggatattgatagaagacagggctccatgaaaaagggttaggaggagccgcttgctggggcaggggccgcatctgggcactgcagttaagatgttaaagtgtcttcggtcccagggggccgcagatgaacacagttcagcgtttctggatgtaaatcgtcaaagctccttcgatccccagcctcgggcaaggaaagggcctttctctctgtgatgccacctgtgctcaggtgtgcactggatggaactgtgtcctagacccctcagctgtgatattgatccgctgagattgtttttcatctgtagaaatcaataaattcctttttggtgcagtgttttgtgaacgggtgcactctctcacccggtcgctgtcctaagaattctccttgacttcggaactggccctccacgccccaggatccacctgccaggagacccccagtgtgctctcaaacccccacccatctgagtggcctggaaaggctggtctgaagacctctcttcccatgtctgccgaccaggctttgctctccagggactttctgggagggggagaacccacctcctgccaacggccctgctggcactccgaggacagcagagggaaggaagccaggggctggggagccggccacacaactgcccagtgcctatccttctcctgtgcccacagatgctgagctgcctggagcacatgtaccacgacctcgggctggtcagggacttcagcatcaaccctgtcaccctcaggaggtggctggtgagtgccaaacccgccttcggttcttcctgggcacgtggtttcatccagttccacaggaatggagggaatggatcaccagggcaccttccggatggcactgcgctccctgtgagcagaggtgacatttccccgggagttctgtgaggacactcagcctgtctctgttcctccttccaccaaaaccttctttacgcccgagctactcctgctctgataagcaaggagtagcttatcagtgagactctgccatcatcaagcaaagcagcatgtcctaaagcagcggtgtgtgggagcgtgtgtgtgtgtgtgggagcgtgtgtgtgtgtgagagtgagtatgggggtgtggatgtgagtgtgtgtgagtgtggggtgtggatgtgagcatgggggtgtctgcatgtgtttgtgagtgggtgtgtggatgtaaatgtgtgggagcgtgtgtgtgtgtgagtgtggggtgtgggtgtgagcatgggggtatctgagtttacgggtgggtgtgtgtgaatgtgtggtgggagtgtgtggggtgggagtaggagtgtggaggtgtgtctgtgtgtgtcagtgtggatgtgtgcatgtgtatatctggatgtggggtgtgtctgtgtgtgggtgtgtgtgagggtgtgtgtgcatgtgtgtatctgtggatgtgaggtgtgtgtgcatgtgtgtatctggatgtgggggtgtgtgagggtggatgtgtgcatgtgtgtgtgtggatgtggggtgtgtgagtgtgtggtgtgtgagtgggtgtgtgcatgtgggtgtctgcctgtgtgaatatgtttggcagcaggtttttttaatgaaatattgctcagaaccaaatattaaaagcctattaaaggtttcatggtgactggggacccagagctccctcttggagtctcccctccccccatcccctaactttatgccccactgtggctcctcagacacctccggggagaccccagtccttgactgcagggtgaaacccctggtgggagctctgtccccacacctgccccgggtgccgtggtgtggcccgctggacgttctcagggtccctgtgtcacctcattggtacctgtggtaaacctggaacactgttgacctctggttgggatgagggtttggcagagaatgttcaaaccagcgcacagccttctgggtggctttgggaggagaggtgggcgggcccaggcacagggtgactcggaccccctgcctcccgcagttctgcgtccacgacaactacagaaacaaccccttccacaacttccggcactgcttctgcgtggcccagatgatgtacagcatggtctggctctgcagtctccaggtgggtcctgcccgctgcacacccagacctctactctcgggggtcagacggaggcccccttccagggagcggcagccccatcccaccaagagagccacaggcgtggggtccccagccgctccgcccctcctagggacgcacccctgcccaccgttgtcagtcaccccatgggcgaggctgctcctaggattacgagagcaggtgagtccccgacctggtcacccccccaacccccacaggcaggccgatcctctcccaccatgccaggagatgccagatggctgcaggggcctttgtcccccgcttaccactcacccaattccaccccccctcaccccatcccaccctccgagtgaagagagcaaacacctacgccctgttttccaatccaggagaagttctcacaaacggatatcctgatcctaatgacagcggccatctgccacgatctggaccatcccggctacaacaacacgtatgtacaggattttctctttttttccttttaaaaggcaccctggctactggagggaacctgtcagcccaaccctcagagcagttcccagatggagctgtcaacgacggcctcccagcccccaactctgcctccactgacacagctcctggcttctggactttgcccagggccttgggtctccccggagtaggaactttcaggattatcaaaccccaggggctctttcccactcctgtgcgggcctggcttcaggctcaggtgcacggcagatccctggccccgccggcgccttctccaccccaggcagggagcaacacctgtccgcatgcagggatgggggctccacacccccctctcaggagctcgcctctccctgggcaggctcccagctggcttccgcagggaaagcacaggcaggagccagaagagagcagaagagggggagaagagggactgcagagggacaggaggtgggagtgaggtgtccctcgtggggccagggatcagaaggacagaccgttgctccactcctgcctccacaggcacagagttccgccccatgtggcggacaaggtccaggccatgggcttgggtctgtgtcctcagtggcgcagcagctctctctgttgaactgtgtgtttgtgtgatgtcatcacatgcctgagagctctgctgccatgtgtcagcgcctagtgggttccgaggtgtggctgtcagcgctcctcccggggccatcaccatgcacacccatctgttccccttttgctcatttcacactcacagtggccggcacagcacaggtcagcagaggccttgaccacagcatcccagtgaacctcagcctcgttctgcccacctgcctctggcacctggtgacgtttgataatttcacaagaggccgtgatgcctcagggcctgtcccagggagcatgccgcttcctcagaggtgtctgtctggtgggactgcaggagcatggggacgtgcagttgcaggggcagctgagcggcaggagggacctcctggccaggccagggcacaggcagctcccccagcccccacggcaccttctcctgactctacttgctccacttacatggctgggtgttgctcccccgtgcaggtacctggtgagggcgcctgagtctcccctcactctctccttgcctcccaggtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacaggtgtgtggggtgagggccctcccaccggagtgggggcacattcagggacagagcagcccccactctccattggctggaagctcccagaagctcctggccacagcagtgccctggggacccaagggaacccctccctccttcctcacctcctccagggcccagagtggagccccaaaaagagggtaccctcgccatgcgcacgtgcatcccactgacctgcacttcccagcctgtatttaattcagccttcactggctccctttgagataaatcctttgtccctcttccagcccaagaaactgaggcttagcaaaggtagggagcctgcccaaggaggggacaggccctggacagacacatctgctgcatccaacataggagagctgccccctgccccataaccccagctgctgtcacctgccacccacagcccagtcagcccccttccttttatttatttttttttcttttgagacagagtctcgctctgttgcccaggctggagtgtaatggcaggatctcggctcactgcaacctccacctcctgggttcaagcaattctcctgcctcagcctcccaaatagctgggattacaggcatgcgccaccaagccggctaattttcggtatttttaatagagacggggtttcatcatgttggccaggctggtcttgaactccagacctcaggtgatccacctgcctcgacctcccaaagtgctgggattacaggtgtgagccaccacgcccggccaccccttccattttagataagggggctttatgcctctcagggcgtgatgggaggagagtgagaggatatctgcgtgagaggaagatgacctggtccacctgccccagacaaacacctccagctcaccgaaataacgccccattccacacgggaattcctcatcaaaccctcactctctgacatttgcaggggagggaagctctcggagtaaaccctgggagaaatgtgttgggttgaatagcagcgtccttcaaacaaggtccacctcccgtgaatgtgatcttatttggaaaagggtctttgcatttgtacttgttaagatttccagataagatcagtgtggattgtctaagggggccgtaaatccaaagactagtgtccttggacgaggagacagagtagaaaacagcccagacacagaggagaaggccgcatgaagacgcagtgattggagatttgagtgatgcagccccaaactaagggacttcggggcccccaggagcaggaggagacaaggaaggaccctcccctggagtcttctttgagagcagggccctgcccacactttgatcttggttctggcttccagaactgtgagagaatgagtttgttgttttaagccgcctagtttgtggtactttgtgtggcggccccaggacactcacccagggcaccgtcttctgcggttccacaaggcagacctcagccattcgaagtctaagtggcttccttccagaggcagcaagaaagactgcctggacttcagcactgggaagatactcaccaccctccaggcgtgctgctgagcctccctttatcagagagcagcagcctcttctaccatggctttccaatttgtctacgcttccaggaagttcaaagcccagtgtaaaaaactgaagtcagtgaagcatttggggaagctccgaggaagcagcatgctccctgggacggggccctgaggcatcacggcctcttgcgaaattgtcaaatgccaccatgtgccagaggcagaggtgggcagaaccaggctgtggttcattgggatgctgtggtcaaggcctctgctggcctgtgctgtgccagccactgtgagtgtgaaatgagcaggagaacagatgggtgtgcatggtgatggccccgggaggagcgccgacagccgcacctcagaacccactcggcgctgacatacggcggcagcgctctcgggcctgtgatgacatcattgcacaaacatacacaattcaatagacaatttacagtcattattgaatcactggttcccagtacagttatctcccctttatctataggctctctggcctctcctccatgtttgtgcccctccccaccctgcaagcaggtgccctgtgtggctacgataagctgtggcaaatcttcgtctgcagtaggtcaaggagcaaccgtgaagagagaacgctgcatctgccactgctaccccagtggggagctcctccagggacaggacctggggaatcaaagcaagtgaacgccccttagtgtaggcctcgtcccactgagccatgtcggagagcatcccgcaagagaaggaggcggcacctgattggaggagcagccgctctgcacaggggatcgttctcgtgcccatccaccgtggggacacaccagcattggcctgcttcaaatgcttcactgactgcaaaatatgactctcctctgggggtaaaattagttgtcccacttttttaaaaatatattttgtcatggaagatttcaggaataactgaataaatgcttcactaataacacaattaaatgtttacaggaaaattgaataattcaagatacaagtgatccccccaaaaaaatatatatatatacagttgaaatgacctagattgatgggtttgggttttgtatctgatgcttgttgttttattttcttggaagaggaaaacatcatacctggcacagagatgtgttctgtaaatgcttgtggggtgggtgggtggatggatggatggatggatggatggatggatggatgggtggatgggtggatggacaaatggatggaagggtggatggatggatgggtggatgggtggatgaatggacagatggataaatgggtggaaggatggatggataaatggatggaagggcagatggatgggtggatgggtagatggatggaggatgaatgggtggatggatggatgaatggatgggtttttgggtgggcagatggatgtgtggacaaatggatgggtgatggatgcacatatgaatcggaataagagatacatgaaataatgtgtgcagggggctcagtacacagtaggcctccgctgaataattgttcagactatacccgtgttaacacgttgttctctcgctatttagggaatgatcacattaatcttggccactgacatggcaagacatgcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagagaataaaaccagctctcccatgaaggcacagccccagcatggcactctgaaagcccacctatgtgggggcaactccaacacagctcccgctccccaagccagcatcccccaccaggcccacaccatagcccagcacccctccataaccaggacaaggtggccagagaaggggtagggggcctcccccatgagaaggtgcacttaggttgcccagcatctgccttttggaaaggacaggcactgggcacaccaaggcacacaaggaccagagcacgactcatgcctggaatccagcactttgggaggccacggcaggaggattgcttgagtccaaaagtttgagaccagtctgagcaatattagcaagactccatctccacaaaaaaagaaagaaaaataaaaaaatcagtgcatatctgtggtcccaactgcttgggaggcagaggtgggaggatcgctggagcccaggtccaggctgcagtgagccatggtcgttccactgcactccagcctgggcaacagagcaagggtctgtctcagataacagagagagagagaggtgcatgagaactgccctcccggccttcagagagaaagctggttttgtggagccttgtctaagcatcaggtgcacccctggcattcttactctgaaatttgattatctgtttaaaatcaatagcatcactttccacctccagagaggttgaaagatagggaactctcggctcaggctgaccttctaaccatccagtcccagtaggtagagtcattaggactcatcgctctctggagctgaggtgcagttaattcccaaagactgtgcgagaggatgggagctcccgcaggcaagggctggacagcaggcaaacctccccaggccagggccaccagaagccccttccctaagagggaaacagtcacatagagcggcttcctggcaagcaagtttcttgctcctgaaaaaccaagggaaggagggaggcgccgccttgtcctctaagatatgaggaaggcagagatggacctgcagtcaggggtgacccaggccccgccgatgccttcctcctctgaggtgggaggagaggtcagggaagagacggggaggggcaggatgccagaggatcgggtgccaggtggtcaggacaagtgaacccagctgaaggtccccactcccaccccacccccagccttacacactgcagctgtgcagaccagaggcaaagcgaggctcagagcccagggttccgtttatcccaacgacctgcaccgcggggtcagatgacaagcagcacggccaggcatcgtctcactgctacggagccccagacggggctttatgaacacgggtggaggacagaggttggggtaaggtctcgggggaaaggttctgattcaaaatgggccccaatagggaggcctctgaggatagtgcgggccagcgtgggaggtgtgaggtgcagggagtgtggccggcagggcctgggaccttgaccttccccagagacactgctgccctggccctgccctaggtctggtgtcgggacagctccactgaggccggccaggcacaggctagtcattgcctctgatctggagccggactccacagaggagtcaaagaaaggcctgaatggcttcctgggaactgatagggcagggaaaggaagggcgaccacagcaggatcccttcgaggtcctgccgaggttggaaggcaggatccaccaagcatcatgcagactccgagctgaactgagctgctcctcacctagtcacgttccccaaaccagcaggtgcagcccgcagcccgggggcatgtgcctcagctgggctttcctgtctaatcagcttcagagcctggatggcaaccaacactttggtctggaaacctggtgattccagacactcatttgtgcccggtgcaggcagggccacgggacgccagccctccacctcttgtcctatggcgacatccgggctagtttgggtggaagctgctgcattcctgggcctgccctatctcctcctgaagctcctatggcatgcccaaccctggccaagctgagacagagctacctgtcccctgggaagatgagcaatgcacccacctagggaacagcagaaaatagggggtgaccaggcacagggcagtgcttcaggggatatcacctgggctggggtggccagaaaggctggaaggaggggacccaaacaggaccttgaaggttcattctccattgagaagggagcctgtcctccctgaaggcagccaagctcagttgcatggtccagcaggtcctccgtctcttcctgcctgtaatggcaagtccagacccgagcagcagcagcaggcccgtgttctacctcctgttacctcaattccaaaatctcttctttcagctgaagatgattttgataaaatgctgtgatatctctaacgaggtccgtccaatggaagtcgcagagccttgggtggactgtttattagaggaatattttatgcaggtaagagtcttgcagagcaatcaagcctccagccactcttattagccccacttagtaagggtttgcgttaaacgagcacgcctgggtggtcccgcatattccccgggctgccgacagttcagcctccagaaagccttcagggtaagcgtacatcagaaacaaaataggttataatttgagacctgaaagacagtaacaatccagaaaagctaatactctaaaactgtcacctgtcactgctaattgagccattattacaagcagccttgtcaaacaaattgcctgaaagtcaagaagcaaggactgcagaagcaggagggggcccaggagggccgagacccagcaggtcagctcacacagatggccacggggaaggtcggggacatagaaaaccaagccagctgaaaacaaccaccaaatattaatacaacagcttgatgaaccctaggagaagtcgggaggctttctgcaggacgctgctgccgtcctgggatacatccatccaactcacctctgcctatctctcaggtcggtcttcccagctagacctgcacgcccagctctgtttagcactgaagatagggtcaccttctccttgttcttactgagacacatttgtggtgtggtttggttggttggtggttaactggcgcatcttgtctttctctgagaacagcgatctggttatggggcatttctgtctctaatgtcactgtctgctgcattccctgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaaggtgagtaactgtcaccacatgtcacacttgcttacactcagatacatgcatgcacacacaggcacacacacatatacacatatgcacacaggtacacacagacacacactcatgcacacacgtacacagatacacacagacgcacatacaggcacatacacatatacacacacgcacacagctacacacaggcacacacacaggcacacacttgtgcacacaggtacacaggcacacaaatgcacacacacggcacacacaggcacacactcgtgcacacacatgtacacaggcacacacaggcacacaaatgtgcatgcaggtacacatgcacacaaggcacgcaggtacacatgcacacaaggcacacaggcacacacaggcacacaaatgcacacacaggcacacacacacacacacatgcacacaggtacacacaggcacacaaatgcacatgcaggtacacatgcacacacaggcacacacagggacacacaggcacacataggcacacaaatgcacacacaggcacacacatacacacatgcacacaggtacacgcaggcacacacgtacagaggcacacacatgcacacacaggtatgcacatgcacgcacacaggtacacacaggcacacctgcacacctgcacatcctgagcagcctcttccccggctgtcgtggtgaccgctgtccctgttccatccagagcctgctccccacagcctggcccgtgaccccagcatctcccactctgtgctgcactccctgccttgccttgctgggccctggggggcccctcactgccctcacccatcgctgccggccttcaggaccctggaggcagcactggctgtggactctcctgtccccactctgcgtcccagttcctcacctgtggaggaacccctgagctctgtgccctcgagctgtgaagcccctgtccagctcccagtctcaccgcacccagccaccgagaccttgctccttgcacacagctcgttcctgcccagctccccccagggcctctgagctgcctgtggccccctgccaaggcccccacctcaaggcacccccagcatgtccaaaacaggcccatctcttgttccccccggggatctgggctcacagcctcacaccctccgaccttcctgggctcctacgctgcgcatccttctgctctagggcatctcttggagccaacccacccacttcccactcccaggaccctcagccgggaggctgtcagctcctttcccctgccccgtgtctttgtaagaacctcccaacctgtcccccaccctcatctcacgggcacgggggacacaggaggcaggaaggggactttctgtaggacctcatggagggtgatgagggccagagacagagccgcagtgggtggaggcagcagagccggcacgagggtgtccaggagctgggactggcccagaggtttccgcacggagcacctgacacctgtttttctccgacgtttcccattgccttaagaacgagggactctgaataaatccgtgtgtctctcccagctcttccccatggttgaggagatcatgctgcagccactttgggaatcccgagatcgctacgaggagctgaagcggatagatgacgccatgaaagaggtaaaacacactgagaagagcctgccttccttgcggcaagcaggcacgctgccctccgcactcccgactccagaagcttggacgtgccaagcagggcaccactgaaggccccgtggacaggcacacgtgtaccttccatcagaaagcctggctcagtaaaattagggaatgcgatgagggaaaccaaaactgcattcgccaagaacacgtcaggtctcagtaccttcgagggagtttactggccgtgcccttcacaagaatcacaactgtcacccacacctgtggacacccaggtgtctttgggtgtatcagccgccgttagagcatctgggacccctcagagtacagtgcctggcctggccccagggctgacttgttcagaggaggccatggggtagaaaggggccctcccctggcacggggacaaagcgaccacccacctgccagctcccgggcccagaacacacaccggcacctctcaggggccagggagcctggggctggctttaggttgctgctggatagatatcattttggaggaaggggtccaggtcacagcctcagggcccacgcagtctttctacggattccccacggctgtctgctgtcctgctgcccatggtgtggcctctgcccctcccagcctcctgcctcctccctccagcgcccccaggcagctagaacagtcttactactcctgcagggtttgacccctcctggccttggccggtgttgcctctgccacccccgctccccacagtgccactgaagcaccctccaaggcccgtcagtcagggctcccctagttactgtgcccaccaccccgtcttttctgcctgggcgctcctgaagcccatgtggcccacaatgcccttttgagcactgagccattttccaggcgtagccttgggttggtctcatctccctcgactgacggccccgtgctccccgtgcccacacccgcctggagcgccatgccaggcacatggtaggcgctcagcaattgcttaggagtccactgaaaatccagaccagctgccctgacttctccagttgatgtctcctactggaaagtcacagaaaggtctctaaacctctggaaggctgagagcacttatgcagagggacagatgtagcaagaaggcttcccccactccacaaccccgcaagagagctgaaggggcttctgcctctctcgtgggccctccgagagccatagccctgatggccttgagtctctagtcctgagccctgctgcccagtaggggatagtagggttccttaaggcctctgccttcccccctgtcagcccccacaaaaaggagagacacgccaaagaggtgaaaaggccaagcccaagccgcaggctctgcacacaccaccagtccccgcggctgtggtggctgcagctgggtgagctcactgtccaggccccagatgaggcaccaagggtagcgggacagggtatgcagagctgcctctgaaaagcccatgtcaggagtgcttgggctcagaggggctggggaccacaggctttcacgttgcagcacctccaggcaacagaagctgctgggagagaggcagacactcccctgctgtctcctgctccctgacttggccttctctgtactctgttccagttacagaagaagactgacagcttgacgtctggggccaccgagaagtccagagagagaagcagagatgtgaaaaacagtgaaggtaatgcttgctctgctgaagtggcatctcagcgcatacaatgattctgacaaaggacagaaggaaagaggaaggggagaaaatctgaattttggaatacctttaaatgaatggaactttttttttttttgaaactaagtctcgctcttgttgcccaggttggagtgcgatggcacgatctcagctcactacaacctctgtctcctgagttcaagtgattctcctgcctcagccccctaagtagctgggattacaggcatgagccaccatgcctggctagtttttctatttttagtagagatggggtttcaccatgttggccaggctggtcttgaactcctgacctcaggtgatccacccacctcggcctcccaaagtgctgggattacaggtgtgagattgcgcctgaccaaatgaatggaaattttatttcttgcaactaatcattagaattaggctcttaaggctggtggctcatgcctgcaatcccagcactttgggaggccaaggtgggcggatcacttgaggtcaggagttcaagacccagcttggccaacatggtgaaaccctgtctctactaaaaatacaaaaattagccaggtgttgtggcgtgcacctgtagtcccagctacttgggaggctgaggcaggagagtcacttgaacctgggaggtggaggttgcagtgagcccacattgcgccactgccctccagcctggagaacagtgagactccatctcaaaaaaaaaaaaaaaaaaaagtgaggctcttaaagaaggggaacatgctttagttaatagaaaaacatcaataattagcatatgtatcacttataagagtaagtactttttaaaagtgcaattgaagtactgaaaacttttcacaaatcacgtgtttgctttatatggctttgagcattttcctctgtacttgttgatactagtcattcagctcacggggaatgcagagcagccgtttgttcacctcataataaggtcacactaatggccaggcacggtggctcacgcctgtaatccaagcactttgggaggccaaggcggcggatcacgaggagatcgagaccatcctggctaacacggtgaaaccccgtctctactttaaacacaaaaaattagccgggcgtggtggcgggtgcctgtagtcccagctacttgagaggctgaggcaggagaatggagtgaacccaggaggcggagattgccgtgagccaagatcgcgccactgcactccagcctgggcaacagagcgagacttcgtctcaaaaaataaaaataaataaataagccgggcgcagtggctcatgcctgtagtcccagcactttgggaggccaaggtggacggatcacaaggtcaggagatcgagaccatcctggctaacacggtgaaacccttctctactaaaaatacaaaaaaaattagccgggcgtggtggtgggtgcctgtattcccagctactcgggaggctgaggcggagcttgcagtgagccaagatcgtgccactgcactccagcctgggtgacagagcgagactctgtctcaaaaaaaatataaataaataagtaaataataaataaggtcagactccatctcaaaaaaatataaataaataaataaacaataaataaggtcacactctccatgtctaacagataattcaagagatagtgcatcaagcatgcaaggctcagggcaggacaaacgggacatggctcataagaggagctgcaacaggctttggcatccaacacacctggttttgagtccaggcttgccaattacaagccgagagatgtgcacaagtgtcccagcctctctgaacctcagagccccagtctctaagccagaggcaataataccattgttactgctgttttagtgattaaacagtcaaagtgcttgtctggtcccgatgaagtgctcagtcaatgttgccatttaatttttaagtcagttcatatttttcagtgggtcagaaaagagatcaatattgttttactttgtctaaatgtgttcagcaatatatctgatggcctctttcttttaaaatggtctgtgtgtcggccgggcacggtggttcacacctgtaatcccagaactttgggaggctgaggtgggcagatcacttgaggtcaggagttctaaaccagcctggccaacatggtgaaaccccatctctactaaaaacacaaaaattagccagctgtagtggcgtgcacctgtaatcccagctacttgggagccagaggcaggagaattgcttgaacccaggaggcggaggttgcagtgagccgagatcacgccactgcaccccaacctgggcaacagagcaagactccatctcaaaaaaaaaaaaaaaagtctgtgtataatcctgtaacgtttctgcgactgctggcacttttttttttccttcttttgtgagacggagtctcgctctgttgcccaggctggagtgcagtggtgcaatctcggctcactgcaatctccacctcccgggttcaagcaattctcctgtctcagcctcccgagtagctgggattacaggtgtgtgccaccacgcctggctaatttttctatttttagtagagacagggtttcaccatgttggtcagcctggtctcgaactcctgacctcgtgatccacccaccttggtctctcaaagtgctgggattaaaggtgtgagccaccgcgccctaattctaacaaaaacaaatcagtcatcgtttcccttcttccaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggggacaacacacactgggtgctcatgtggaggaaggctggtgacttcacacttaaatcctcagataaggaaaagagacacatgtattcagcacgtctgagggtctctatctcgggaggagagacggccctcccttcctgcctttgttttggtaacaagcacaggggacattctgggtggcactgtgtccacacaggggacccagcccccggcttgttcatggtcaggctcttgttgctgggacagtcgcacccctgagctctcactgagaccgcccgcatgcggtggactcctggagacccgatttataaaaagcaaggaaaaggctgctggctgtgtcccctgggctgtgggctccatctcccctgcgctctagagacagaaccacctcccgaagcgcttcaccctacagagctcacctttaaagccactggcgtggtctgagcttagtaaacatttcatttctgttttgggtcactttccttggggcatttgtttccttttggtgaattccagaatattacttcccaccttcaaataattcattttttacctgtaaaattttccatctcgaatccagccgaatacagataagggaccttgatttctacaccccttcttgtttctgcttttgtttttcatttgaatcctattaaagccaatagatatggcaacgttggcaaaaatagaagcaaaacgtaggcgtgcggatattgatgccctccaccttcctgccagcctctatgggggatgattacctgctctcctcatctgtaacaaggctctttcaacagcaccttcatctgctacattacttggaatgcacatctcactaaacggtgcccctcatcaaactccatacaacacttccttgaattttactatcataaacagaaacaatcacatgcacacacatggacatgtatacactcctacacatcagcacacttcctctggttctaggctatactgcatcctgaaacaattaaatgactgagatccattaggggaggcatctagagagcatctactgttttttttttttttttgagacaggctggagtgcagtggcgcgatctcggctcactgcaagctccgcctcctgggttcacaccattctcctgcctcagcctcccaagtagctgggactacaggcacctgccaccacgcccggctaattttttgtatttttagtagagacggggtttcaccgtgttagccaggatggtctcgatctcctgacctcgtgatccacccgcctcagcctcccaaagtgctgggatcacaggcatgagccactgtacccggcctgacggcatctactgttagtcctggttggtgtgcagccagcctggtctccatgcacgggacccccagaaagcccaccaacccaccctcctgtcacacagagcagtccctgaggccccacggttggaggccacgtccaccctggtcagcctgcacacccagagcctgcccgcaccaggaggcagccacacggatgagctgaatcatgggctgcatgtggcagtggaggctcaggacaagacagatgtgcctacggccccggagagctctgggtccagcagcagaggcgttcccccaggcctgggggcatgcccagca

SEQ ID NO: 16957 - DNA, 156895 bp, Human
  misc_feature (1)...(156895): n = A,T,C or G
gaggcccggccagcctgcggtgggtgggtgacatgtggcccggatctgcccggggcgcctgcctgtaagtgggcccagcagacaccccatggagccgaggcaagccgtcccagctgaaccggcttaagctgcaggcccacagagtcatgagcagtgaagagaggttttcgccctctgaggtttggggtggcctgttacacagaaatacacacaacgtcctcaggcacgtatctctttaagaatgtgtcccgagaaggcgtcccaggagtcttgatttttatttagccgtccacggttgcccctttgggtgcttcgccttcagatggggtgaagggctcacttgttagctggctggccccaaagacaggcttgttttccaccaggcagtgactgaagccggcagcctgctgcataccgcgggccttcccctgacctgtccgggactgcgggctggcggctgacacctgcggagtgcttaccgcataccaggctcccaaacttccatctgtgttcgtcttttaagttttgttgttttccagagtcggagtctcagtgttgcccgggccagagcgcagcggccatttataggcgcggacctcggcctcgcacaccacagctccagctctgagacacaagcgacccgcacccccccaccgcccagccccagcctccagactggctgagatcacagtgtgcgccaccccatccctggcttgcgatggtctcttactccccactttacaagggaggaaagaggccgagggcagagtgggccgcctgaggtttggaggccagggctagtacaacctcaatttgaccctggaacctgccgcttcccccacccaggtgcgggacccacccgcttgtccacacctggctctgcccaccgcccccggctgctcctctgggctcaggtcgccgcggtcaggagctgccaagtttgcctatcaaactttatcttcgtgcagagaactgcagcctggagctggttattccggtcagtgaaaacgttgcatttctacatatgcttatcatcatctgtgtaaacatttcttggtataactgtggaacagtcagtaaatatagataaatcgaagagtaggtctattgcatatgctataaaaaaatgcttttactatcaacctaaaacaaacaaacaaacaaaaaaaatcaaacaaaaccaccatcacctaaacgttggtaactggagcagctgctagtgtcagtgcggactaaacaggagacggcgggaaccgtgtccagccagggtcctgggccgcgacctggttctcccggagtctacagtgaggatgacgggcggggagagggggccggcgggacccgcgtgtcccaggcaactccgggagagggagaagcaggggtggctcggcgggggctcggcgggggctcggcgggggctcggcgggggctcggcgggggctcggcgggggctcggcgggggcagcgcccgctgcagggaggagcgcgggggcccgggagcctgggcagcaccgcgagacgccacctccgcaaaacgcaaacgccaatcgccgggcgcctgcggtcccagctaccagggaggctgaggcggcaggatcgcgtgagctcggaggtccaccgcgctccagtctgggcgacagtgagaccccgtccccaaaacgaaggcgggcagagtctcctcagccgcgctcgggcgggcggcgccgcgacgccaggccggtcccgcgctctcgccccacgctccggagccgcccagccgcggtctctcagctccggccgcgctccagccccaacggccccgcgcccgtccgccgcaggtggtcgtgagggaggtgccacagctccggctgcccacgacagacacgggcgccccagcgcgcgcacgtccggcgtcgctgcgccgcccccgccccctcggcgtgcgcgcgcccggcgggccggcgggggcggggagggggcggagccgccggcggcggggctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgaggtgagggcggcgcggggccgcggcggctcgggcgggcgcgggctccggaccccgcggtggcggcgtttatgtaagcgccgggcagggactggtggtggggccggagctgcgggccgtcccgggagcggagggcgcccgcggagaagcgagggtgccgcggcaccgcctcgcacccaccctcctgggtcgcccgtctgctccggcgctcggctcccggaggaagctgcgcccgggcggccccgcgtcccctcccgagggcgccgagtccgcgtgggatgcgccgcgctgcgccgcggggagggcaggtgcgccgggacgaggctgcgccctggggaccgagactgcgttttggggaggggacggtgtgccctggagatcggaggctgcgctggggacgaggctgcgcccggggaccagaggctgccccgggtacaaggttgcgccggggaacgggaggctgcgttggcaacaaggctgcgcctggggacggtaggctatgtccctggggagacgctccgcccggcatgggacgctgcgccgggggacggcaggctgcgcccgggatgaggctgggcccgggcaggggaggctgccttgggaggggacgctgtgccacgggagtggagactgcgttggggacgagtctgcgccctggacggtcctgcgtgtccttccgagggcgcagtgtccgcgcgggatgctctgcgccgcgggcggcccgggccagggaagttcctgcgggtgccgggcgtctgcagcgatcgggagcaatctggggcagttgggggcccgaggtgacttttgacgtgttcacatcagaaggaaaattattgcgtggtggatgggtgcgagggaaggtgtcagattgggctgtggacgctgaaacgtgttggagtcccgatttacacgctggaaaacctaacctaaaacgtgttcctgtccaggtttctatgtcggagatctgcaccgtggtgtttagttcccagttaatatttttggtcagcaggtttgggctgttacttctgatacaggcattttacttccttcttactaaccattattgcattccgttctcgaagtataacgaaaagtggcatgatatcaaacttgtttctttaacgtttaactccataattaagatgatagaaccgtagtttttttaattgagaatacaaatatgtatttaatcctctttgtttcctcttaaattttgccgtatgttttattgcttcgaaaggtgccacccagagctgcattttccaaaacgctaggttgtcttaagagcagttgtttctaggagatagaaaagctaattgtcttttgatgaccatcttttccttggggttgagactgctgtatcctttttgcctgctgagggtttcccagaggggaaagggagaaggaagaaaggataaaagcttggctgatacagttccttcttggataagagaattaactgtctctcattgcgcggttcctccggaggacagggtccagtatgcatggacagccacaacgggggctcggtaagtatttgatgagacaggctgagctgggtgcctatatcttgcctgtggtggagaggatgaactcacacagactctgaaaggaatgcattgtctgtgagtgatgccctgttagatgtctgagggttcctaagactgggtatatcccactacatctacatcacatttgaagctgtagttggaaaggaaaaaaggaggccctcctgcagggacaggggcttaaaaataatcgatccagctctgagaaattgatgacacatgtgtctctggtgtgacgtgctcatgcagttgttactgggaggccaagggggaaggattagctatgaagtgataacatcatccacaaaaaacatcttggctcagaggctaatttcacttcctcgtgaatttatgtattgtaaaacatttgaattcttttagatttttggaataagaatttttttaacttctatttgtccagtgaatgcataaaacaaacttaatccatttgacaaatacttgtctgtggcctgttatgtgctaggccttccctgttttaggccctaggagatacagtacttaacaagataggtagagatcaaaaatgcttctggcataaagcagtacatttgtattgatagatttaaaaagataagcaagcacacagtacctacagaaaggtaaagcctcattccactccatccctgggcacttggttcaaaggctgcacccaattgtgtattgtcctagcaggagtcaaagtgtgtattgtatatgttttaatatatgacaaaccttgctatagtgcatattcttacacgtgggtacaagcaaagcctactaattagttattatcaaaatttcttagctgtaagttttacttaagaactgggttttattcccttgaatgctgtgattagctctgtgatcaaacaatataattcaaataggaggtagttaactttggaaagaaatagatgaagttacacatttaccagcctataaaaaagtttagcaaagttatcaagcttagtttgaaaccaaaaagctcagagaggtccaattttattagaaaactcaatggtggccgggcgcggtggctcacgcctgtaatcccagcactttgggaggccgaggcgggtagatcacgaggtcaggagatcgagaccatccttgctaacacggtgaaaacccgtctctactaaaaaaatataaaaaatcagccgggcatggtggtgggcgcctgtagtcccagctacttgggaggctgaggcaggaaaatggcgtgaacccaggaggcggagcttgcaatgagctgagaccgtgccattgcactccagcctgggcaacagagcgagacgccgtctaaaaaaaaaaaaagaaaagaaaaagaaaactcagtggttttctgtgtcaactttctaaaataggaatttctaaatctgtaatttggtgtgatggaaatggtgttaaaaaaaaacccatattattttgtatgttcataatatgtgaggtaggaaaagcaaatgggaaaattaaaaattgtccagtgaaatcattaagattccttccttattccttgagtgacttttctttccaagttgacagctttttatctggggtgtggacagggacagcgcagtagcccacagaggtcttcgtggcagggcttaccgcaccttccatttgcagagttttgcttcatccatagcttgacagctgttgggctagggccattaatatcaaattatcacaattttttttttttggtagtttgattagtactgcttgctgcacttttccacctgtatgcctataagatgtcctaggcgtacacaaagaaaagtgactttggttttaggtttaacgtctttgtgatggaacaggaagggggatgaaagtaactctgagataccttgtatttttattggaagtacagtgaaatggaagctctacttgcttctagtttggtgattttggaacctggttccatttcatttgcttgttcatccaacaggcattcacccatgcatcctggcccaggtactgttctaggtattggagattcaggatgagcctgatgaggagagttcctgccctcaagcggttcattttcttgggaaggaggagagcagtaaacaagcatttggtgtcctaactgcttcaaagggcaaatgaggcagggtaggtgagagaaggtcaaataggtggtgaggatggagtgagctgggctgaggtcacggcagcagcagcctctcaggcacagggaactctcgggtgaaagtccctgagcctccttgtagtatggtggtcacctcagggaggccattgctgccagagaggctgggcgagtggtaggaagtgagatgggagtggaggagagctgcatcttggagcacacaggctgtggtaaggaatttagattttaagtttgatgggaagccttaagggagcctttcttccttccttgcgaatgacatgatctgatttatctttaaaaagtaccactctggctgttgggcttacaatatgccaggctgttttaagagctttacatatattaattcatttattcttatgacagtccaaaaagtaggcattattatcattattcccatgttacaggggggaatacctaggcacagagtggttaagtgatttacccaaggtcacacaggaagtggcaatggcaggatgtacccttacctccttactgcagcttgctttttgcacctccactactgcagactggaggaggaatatcagcaaggagatcagttagacttttgtgaaagctgggtgactgtaccggcacctcagaccagggcggaagtggtgagatcagattcagcctactgaatttcagcatttgtaagatgccatcatttttaagttgcatcatcatttcttatgctgctaacaaagggaaaatgtagccaactagattgtgacacaatgctttcttgttacccagcattcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaagggccagatctggaggacgagggttgggtcattgtgcagctacttcctagatgatcttgagcaagcagtctaatctctgtgcttcagttttctcatctataaattaggaagaataaaagcaacttgtcagggttgttgagttgctaatgtaaagtacctaaaatagtacctgactaacagtatttaatggggcttactttgcttattatttttatgattagttatctgagtagagaaaggtgaatatggatggaaattcaaggtcaggttcaagaagaggttggggccaaatatgtaaatttgggagtcatttgcatattgctgatctatgaggcatacagtatggatacagaggagcaggagatgaggaatggcctgggagcttttggcaagcggtccacattgggagggagggtctagcaacgccattgaaaaggactctgtttgaagaaggaagaaactagtgagagtctagtggcctggaaaccaagacaccgaggggttcttttcttcttattcttcgtgggctggagagtttcctattggctttgataagaggtggttgtgagtgaccttgataggtttggagtggtggggagaggaaacaaatagagtagaggtgggaacatcagtgtagacgactctctagaggagttctgttaaaagggaagagtcatgggatggtggctggaggggacatgggtacaggaagtttttagttgtatttttaaatgagagcgatgatagcatgttatgagctaataggaatgatccagtagagggaaacatttataatatgccaggaaagaggataatgttggagccaagtccttgagaaggtgagagggaggcaggaagagcagggatgctcagctctagaagggaggcgggacttcaggagggaggcaggacttctgcacgtgggagcctggactcagaaatattcctcaagacatgctgcccttttgaaaggaggataggaaataaatcatggttttgtcctcagtcctaaaaagttcggaatctcaccctaggactcaggatccagcttcttaccagcttgtgctgaacatgccatggggcgtacttacggaaagatacatgtggaaatggaattttttatttatttaaaaaattcacttttctctaaaagtattgttacctggaggttggcacctttattcaccaaattcagtactcagaggactagaagactcggtgcctgatttgtgcttgatttgcctagctgggaatttcagttttgcatttaagacgactccctcaccaaccctacccccagaggaaagcaggtattgttgctttgggcctgttgcatgtatatgtttatgttccactgggtcagcagcattcagtgaaacacagttgcctgttaacttggtaaaatatcttaattgcatgagttttgatttgtttttgtgattatttgattttttcaggtttggagtttcagaacacccatcttctcagtagttcagccaatgcgatgaaatgtgaagaagccttccccagcttccttgcattctctccatcatctgtgcagtggagagtagttcccactgctgtggaaacattttccctttgctcttttctctcagggcaggctttcctgagtgcctgctctgtgtgagtcatcgtgggaggatgcggtggagaaggacagggaggaggtctgtgcttctttgaactgacattctggtggagaaactaaacagatcacagaggcagacaccgtgcctcacaactacacacggacccggcttatgatggttccagtaacaatttttgacttgactgtggtacccatacagtcattctgtttttcacttttggcatagcattcaataaattgcatgcgatattaagtactttgttataaaataggctttgtattagatgattttgttcaattgtaggctaatgtgagtgttctgagcaccttttaggtaggctaggctaagctttgatgtttggtagggtaggtgtattgaatgctttttcaggttaggatgtcttcaacttgcgatgggttcataggatcggaactccaccgtcagtcaaggagcacctgtgctgtctttatcggcatgaccgaggagacagggctgaggtagatggcatcaagagggtggctcctggtggaggtatgatgttctgggaaggcctctctgagtgcgatgtggtacgctgaggcccagagggaaagcatgagctcatgtcaggaggggggacaacagccttctggctagaaggatagcctgccagagagcctgcttattagagtggccaggataggaccagaaccattgtccagtcaggggctaggaggtgaggctgcagagacacaggggccaggtcctgcagactctcaagagtgcaacaggaagaatggaggcctgggttggcactgttgccatgatttagcggggcagaggtggcagaactggagaaaagagagcaggtgtgaattcttggttgtgggcaatagatcaggtcttggagacaagggaagtggagggaccaagaagggctcttggagctctttggatggtgatgatgtgatgatgccacgttccagaggatctcaggttaggagtcttcaactagagacctcattttgtattgggttctgtttgagtctgcaaagcagttgtcatctaatatgtgactagcagaatatttgtttgtatagatacctctcaacttacgatgaggttcataacttaaatatattgtcagttgaaaatgcatttaatacacctaaccttcaaaattcaaagtacactttctattaaatatgtatcactttcacaccatcataaagtaaaaaaatcataagtcagactgttgtaagccagcgtctgtctgtaccttcccacggcctacaaaatttgtaatgcattgtttgtaaaacacagacacgtgcatttaaacttttattaggtagaactggctcttcttcagggtccttgtaattaagtcagttattcctctcatgacattcttgtaggaggtctcattacccctatttatcagatcagaaaactgatgctaaggggctcagtgacttcctaggaaagctggataatgtttaacatttattaagctcttaccatgtgtcagacatggtaaagtgagtttaatctagtttaatcctcatgatgatcttaggatgttgctattaagggtcactgtcatcatccctttttactgataacactggcctggcttacctgagtagcctcctaacagatctcttcttccacttctggtctccttcagtctgttcttgaccagcagtcggatctgagcctgtacatggaagacatcacgtcattctcctgctcagagtccccctgcggccttctttcctgctgtcccttcctgccactcagagccctggctccagctgtcttggggcctatagctagccctcacttcagtgttcatgcaccattgtgtgctgcgtgccctgctcactgttctgtttatttctgccatctgtacccaccactaccttcctccccacacagcctgcctggccagaatgaaagcctcaggaaggcagggctattgctctgaatctgtcctgagggctcggagcaatgcctggtagatagacacttgtaagcctttgctgaaggagagaataactttaacttactttttctgttggtagtaagtagtagaacctgcattaagtttatctgcttctgaaaacgtatgcttttgctgcctccctacactgcccccccatcctattgtacttggtgaatcagtcatatatttatgccccatatgtctgtgttatctccagatttccacacttttctatgtagaatagaaacatttataaaacattcaaaattgttataaaaccataaagtttgacatagtaaattatctgttgaaaacagggaggccacatcctggaaaagtagctctgtcctgccagcatcattttaaccccttttggacaagatacagttgaaatgcattctctgaaataatacttataactacatcttgacagaaacaagaatatttcgaataattctgggaggattcaggaaaaggcagccaaataaaatgaaaaaatacatttgattcaactgtggaggcttaaaggaattacacatcttttttgtttttttgcgacagcgtcttgctttgttgctcaggctagagtacagtggtacaatcatagctcactgtagccacaacctcctgggttcaagcgatcctcccgcctcagtctcagcctcccaggtagctggggctacaggtggatgccaccacacccggctaatttttgtattttttgtagagacggggttttaccgtgttgcccaggctggtctcgagctcctggactcaagggatccaattgcctcggcctcccaaaatgctgggattacaggcggagccattgcacctggccaaaaaagcatctcttataagctgtttttggtgaaggagcaaacaggaaagtgtcccagaatttgggagatcaggattgtaatcccagccctgcttctgaacaggatggtgcattctcttcatgcctctgctgcaggctccttggatgtagaatgagggcagttgaattgcttgttgccgaggttctctccatttctggaagactattgtaagtcagagtcaaataatcattcattcagttgtccaataaatactcatcatagaacctatgtgtagtcctgtctaatggtaggtggtgctacgtcacttcctgccatggctgccgaggctcacgcgaggctggcacttggcagagagtcctgtcccttcttttgactcagtaactgtggaaagaggtgaggtataggaagggagggcctaggccttaggggttaagcgggcttaggaggcaggattgagagaggtggaatgatggattcagagtccaagagaaaacgtgaaactccaggggattagaattgatccctttctctgtttcctcagtcttagggggactagactgtgttagttgtcttgaattaaattgagcaggggttgtttttcacttctgtaagtccagagtttatcataagccaccagaggtaattcagtagtagttaatatttcattaaccctcacttctaaaattacaaagttagaagtggaggtctttaacatatatatcagtcaggctggagagtaagttggaaagttgcattttattcctgtgtgtttacttatggcagtgcacataagcccagttttgtttctttttctttgattagtaacagttgggcacaaggtgtccaacccacccagtgttaagtcacttagagtgagttgatttccttgaaaaaaggaatcttttcaagaatgtaaagtggcttctcgtagtcttcgtgaggctctggagtcagacacaatactgggttaccctgggaccatgtgcagtgagcccgggcttctggagtcagacacagtacctggttaccctgggatcatgtgcagtgagcctgggctgccggatgccgctggtgggccctctgccagctgctgcatccccaagccctctcttgtgtcattgttttcccttttcaggaatagtttccactagggacctgctccctcaaatttctatcatttgaggtgaggtttcgtgttggttcatctgactggccgagtgcaccctggctgtgagaacaggaaatagaattctggcttttgtcttagggatatccccaggtagagagaggagattcaaaagatgctggggagctacagacgtgacctctgacctctacatgaagaatggtggaaaacacttactacttagtgttaatctacacatttcacttggtttagacctaagcataaatagtgtgaagtcgatttaaacagaggttacagtttccagaaacttcagcgccgtggctgcagttaaacagcaatgattggactctttacgtctactccattctcgatatgaatgaaagtagtcacatcaaatgcatatttattagtcttggtcattttgaatttgagtcctttacatactatgtatgtatgtacccaggagcagagcagggttaaaagtgacatcttctaacttctactctggaattttttccctctgcactttttgttgtcacgtagtagatgttttcacccacatgcaggtgaatgagtgacatatttatcttgttacatagtgaagctttcaattctttaattttatccctctaatgaaactgtgaggaattgattctgttgacacagaaaaggctggtgtcacatgaacctaaaggacgtcattgagcatgtgcctctcacgcagaactgacatagagcctcccgtgcagctcaccttgaattctccatgcacgaatcagccataggcacgtgttatgtgtggcacaggcaagaagtgcctgatagattttagttctgtttattgctggaagcccttgctgtaggaaaaggaaggttttttcctttcctggacaatgattttgagctacggtgtagaatggaaaaggcaggctttgatttgccagacactgcttgctatgtgtgaagccgggatagggcggtgctgttggacagaagacctgccctgtgtgccttttcacactgcattgagaatttgtctagatgatttcctgggcttattgattgttgaaggaaacaatgcaaattgcaagttatgatcaaataatgctttgagtcttcacctttttagaatgctctgggaaaatacggggagaaaataaaccataggaaaggcattttgaggcggttttgttttgttttaaacagctgccatgaaatgcaccctctctaagaggacaattcagtgattttctgaatgtctgagttgtgcagacatcaccactgtctagttcttgaacactcctgtcacctcaaatgttccctgtgcttgtctgcagttgattcgcgcacccagcccagcctcaggcaaccgctcaggcagcctgcctgctgtttccacatgtgccttgcagatatttcatgggaagcagctcatgtcctgtgtcatcgtttgcatcaggctttcacttaacatgtttttcgggttcatccgtgtgttgtagaacatatcagtagtttgttccttttagtcgtattggcgtagcgtgttcgtttattccactccagcgatggactttgggttgtttctgcattctggctattatgaatcacgtgactttgaacattagcaagcatgtctgcgtgtggatgtgtattttcatttgtcataggtagattcctaggagttcgtaggagcttcgaaatggagtttaagacagaagcctttgtttgatactgataatgctagcaagggccatttatttggcttgctcttgaagtctgtctctgtgatgtgcattgtgcttcttgaattgtatgagcctactataggatgaaatatggttataatgtcgagcagaagctattagcatttcttaagctgaccacctgtgttgtgcacactattaggtcctcagcagatgagttcttaccgggtgtttgatgttttccccccacttatcagaagaggaagtcggtgaagtacggttgggcatattaaaaccacattcagcctacaacaccacagaaacacttaccctttgacccagcaattctgcttctaggaatccttccagaagatagacctccaacaatgtgaaaatacattcggaataacctaaatatccatatgcaggagagggttgagtaaactctagtacagccacacaaccacatccactgttgaggatgacctctgtgaattggtttgaggtggtttccagggcacgtggatgtgaatgaggcaagtaccaaagaacatctaaatgctgcccttgatgtgagaagaaggggatgcaggaagacacacgctccctgcacacttgtgcagaggagatacaggagggcagagccagaaacaaaagagatggtgactgcagagggccaggggacggaggaggagtgggtgccaggtcataggtggggtgcagagggcgagggggcagggaagtggagtgggtgccaggtcataggtggggtgcagtgctgctctcagtacaccttttagtgtggcccagctcttgaaaccacagcaatacttcatatactccaaagtaaaatagatggttaatatcagccaggatgtgggggacccaaaatgaaatataagcggaaaacacacatctcactgtagtacaaagcggcagggccacagcaaagggggtggaaaggaaagtgttaaccttatttgggaaaatgataatgttgactggattctgtgaggctgaagagaactgtacaaaatagtagtaaatttttttctcagtgttaatggtgagcaatgtgaaacgactttatgtgtatgtggggattgaacaaataagcagaatcgtagtggataatgagagccaggtttctcactgtcccaggaagaagttacaaatagcaaaaggaagatggcagagggaggccgtgctgttggattgggataggtgtcagtgtgactctgtggtctttaatagatgcatgtacagcacaggagtaaacataggtgtacgcgttacatgcatgggttagtgatacacctacatatgcatctcctagccttgtccgttgggaagacctagaagcaatgacctccagcaacagggagcacacctaaatatcagttgctgataaaaataagcagggctccttgcagaagatgagtctggaacctctgatgatgctggaaataaggaagtggccaaaatggatggggtgtgtcagagggcacataagcaacctggaggagccccatggccaaagcgggtcaatttgagcaaggaaatgagtaatgatagtataggtgtataatctataaaacaaagtcagtatcactactgatacttcttatattgatataagaagaaattgaaaaaataaggagaagggacatctcttcctgacagaaacattccaattaattggtgtaggagcagtgagaaaatagaaaatcgccttcaggcggcactatggaaatagttacttcaggtgagttccgcgggaggatgctgattagtgggccagagtttggagagaaacaggatatttgcctagtctcgaagtatctcttcctcaagttatttatttattaaaaagggaaaaatagtaactttagaatggaggaagccagcagacaccacgtcacctgggcgatcaagatcagcatcatctgatgagacaagttgcatcatatgccgccccacaccacatggcatgtgctctgtcagggactcctgccacaaatgcacaatcacagtctagtcatggagaaatgtcagacgctccagtagagggacgtcctgcaaaatacctcacctcatcagtgttcctcagaagtgtccaggtcatgaacactggaaacaccgaggattggtctaagcttagagacctgatgactaactgtggcctgtgattctgggcagaatcctggaacagaagccggtattggtggagaaaccaccgaaattcagatgaggtctgtggtgtagccaattgtattgtgccagtgtttattttctgatttcgatatatccttctcccagctcacaacatacaggtctgtgattgatacatacttctcctcatgctcacaacttacaaatctatgattttagaggaagctgggagaaggacataggggaattatctgtactatttttcagccttcccataagcctaaaatttcaacataaaaagttgaaaaagaaacccatggcagaatatgatgggagaatggcagaaatggcaggaccagcccctgtctctgtttcttcccatgtgaagctgtttacctggtttatcttggtctttggatttggtcgattttttttttctaaaaagaaattttaaatatagtcaaatttatcagtttttttcctttatggcttttgggttttgaatcctaagaatactttccctactacaatactcatatttttctttaatttcttctaatagttttatattttgtttttcacatttagcatattgatctatatgaaatttgtttttgtacagtttgaagttgggatattttttcaattggctaatcatttgcctttgtcattgagtagtctgccctttgcccagttatcagaaatatcacctttatcactactaaatgttttctttcaatgatatttcaaattgcttattattcttgtgtgataaagtgattggtttttgtatgttgtgtccacagcttgtcatttgtgtctcatgttttctagatggaggatccttttgggaacatgcgtcttcctttctaagctttgtacttcccctgtattaattggctaggacttctggtactgtgctgagtgtagtgtttggatcatagtgatggctagcaggctgcatctcgttgttgtctttgacgtgaatgcttccagtatttcatccttaagtgtgacattactctagttgttttgtacataccctttatcttgtctagcatgttaccttctcttcctggtttgtccaaaataatctttatcatgagtggcagtagaattttaccatatgtgcgtctgttgaaatgatcacgtggttttccctccagtctgttaatatagcaaatttcattaatagatttcctgatattaaacattcctgcattctggggaaaatcctgtttttaacacagtgcaaaattaaaattgctatttattttaataccttctattttttcaaaatgagtctctccccagccctacccctagtcttttcatttttttcatgtagtttacatgctgtagtagctacatagtggtataagtgcttaacacctggcttttggtgggaaggaggagtgggagtgtatggaaacccctgatttgtagcatttgccaatttccaagttataaatgtccctaccgtgccctatttcaagctaccgatgagctgtcaactggtttacaaaattcctgaaaatgtgacagtcttctctcatgaacaggtataagtataccagtggggcctgagtgtgcagcctggtgactctcatatctgtgtgcactcacacaaccatcactgggatcaacccggaggcttcctggtacctgtgcagctcagcactcctaccctccccaggaggaccccggttctgacctctctccacctttgttctcacttggggattgaataccttgtttattttcacgtcatccttgttttctcttctgtgcacatgcagctctacgttttccccccaagaactgccttggccacctcatttgtagatagcgaaatgcagggtttgtaatgatttttattgaaaaattgagcatctgattattattgtggcactggctttattaaacaatgtaggttctgtgataacttttcttaaatgttgggcattgctgccatgttatattcatgaagttcatcagcttcatataaactgacgtttttcattcatgtgtttatgcagtcattgaataaatattttttgagcactttggataccaaaggtttagcagtgaatgaaataactcagtccctttcttcacagagcatatgttctgctatgtctttaagtcacgtgttttttctatttgaccgtccttgccaattttcccctaactcagacatccacttgtctttgcccctggtattatcttaaatcaactctaaatcaatccgatttcttccactgcttcaatgctagttgacgtttggcttaactgcttatataattatttctgcttttattgaattcttatgatgaaaaaacagaagacttgaatctgatgatttttactttagaaaggttaatgatgaaagtgttgtaatactacagtttggtgaaatggcactttttgtgttgtgtgaactgtcatcacttaatgaggagcaggagatcagcttacagttttctgctatagttctggacatcatgagaccttattccccaccagcatgatctctgtctatggctcagagggagagcaatagggatatggggtgctattcacagccttgcctgggtgactgtgtcttctggcagcttagtggctcccaggggcaggatcctggtcaccagcatcctacagcattgccacatgtttgctcatgctctggtgtcctgtggagtagagctccttgttctcctgtggaccacagtccagggagagtgggggtttccctgtaggaggaggagctggaagactccagatcgagtttaaccgtgggctaggctgcgaaatttggatgcaggccagtggacctcagaaatccatctgttcatctttctgctaaactgatttggatttctgcttttttaatcctttgcaaaattaatttgtctttaatatgaaaatcagtgttttatttttagtaagagaaaataattctattttatttatttggaacaatttaaaagaccctagagatcaacatccttcctctttcatttcctagaggagggtgtagaggagcagagtgtgtgacaggcacagtgggactgacctttgcttctgggcctggattaccatgtctggagagtgatgctttggaggaagtatgggtcacttcgctcctgggccgtcggttcagaaggtgcagccttgcccggagctgaggtccagtgctagcagcacattccctttccttgccctgagcctgcatggcagccttcttcatcaactggaatctctgttgaggatggagaaaaatctgtggtccttttgtttactgggtgactttctgacctctctctcttctcattctctctactgcattacaactgtttgatgagagagattttaaaaatgaacataaacaatttttatggaaatatctgttatctattttttttatatagttataccattggaatttactcttaccttcaggtaacagttgtgaggaccaaatcttaatcctggtaggtgacctttaaatcttagaatcaggaattcggctttagtcaaaagttaactttttccttattattgtgctcctgttggatttttaaaaatggatacattctatttattggtatttacaagtcacttgactagactgatactaatagtatgacacaggaaaaacaaaaacatctttctgtaaattttgaagtaatgaacaatattagggattattccaaaacagagcagacaaggcagaggaaaaccagtcaagctctttatagcttaaatctaaccctttacctgaataataatttaaaaaactattttataaatcaagcctcccattcctgtaaaataggagtaattcattatcacacatttttgtacctttaatttttttttttcttgatggagcccaagtcttaaagatgtcaaaactagtatcatgttccattttctaaagtcgaggctatctcagtcccatttctatagccaacagggtaatctgttactaggccctgaaacccttctgatgagtctcagcttataccccaccccacccccaaatattcacacaataggcacagtgaaaaccaggaaattagtctctgaaataagcagcctccccaggaaggaagcagcatggccactgcccattctgtgcctggacctcgccccaccggcacttggcttcaggaactggactgatccaggcactttgctggggtgcactttggcttttctcaccagttcccagggcagcctcgggtaggagtctcgggtaggagagtgttggaggccctagatctggggctacagggacttttctcacaactccaggcgagggcacaccgggcttggctcttctaggtctggcgactgctcccattggcaggtgtccacaggcctctgcctgacgtccttgacaagaggaagagaggacccggctttctgtgggtgccgagccctctgggccacacagctgctgttctctgacttgtgggtttttctgccgcctcttgcgtttcatgctgtgactctggaactaggtcttaccctgtttggagtgaaggttcggggtgttgggaagttctgtcctcttctctcaggaagaggccctttgactgtgtgcccggaggaggcatgggtgcatcttttctccagggggctcctcaccaggggtatggggagactgtgctgcagcctcaggaatgtcagggtgaagaggccctggaggctgatgcttccggccaagggcttcttctggattttcaaataaagtcccagaacagaattactttatgttttaatttcaggcaaatgtctctcatctgcccttttaagtacattaggattgggtttttcgaccctgcacagcacatgggggctcctcagagaagtgtctgataaaataaaattaaataactcgctttttagcacttcgtttttactggtgatttgttagtcattgattgaggtgattgtgattgatccaattatttgtctgcccatcctgattgtaactttttttatttacaggattttaaaagatagtttcttgatcttaatgttatatttaacgttctctttcataagatggttttttgatgactttgtgtttaaaaagtgagggtcttttgagaaatagaatatatcaaattatttgttcagaaacattcaaaagcattttttccaactctgcaagcagttgtctgttaaagcaattagcgtgtacccaattagagctctgttcaagatccctcactgataacctctgtgaggctgttggtccgtgtctttatcaagcagtagtgtggcttcccaggtactgtcagctcattttggacccaatactagtttattgcctgaaattacctttaaactggaaaatcttcaagtaaaatttttgagagtttttgattaatcccctaggatacttttgaatgataggttttggggagatacatttggttgttttggcaccactaccatcagcctcactcacgtgctgccaggcgccccgccagatcagggaacatcctctgtacatggaagcagccccgagcactatgtctgcttgtgtttctgctctcaaggtttctacggccctgcacgtgggccctgctgaggccccagactgcttcctcacacagctgacctggtgggcttcctgtccacacagctgcccttcctgtcctcccatccaacctctcgcatcatgttgaggggagagaggggggcaaatgagacatggtccttgctttcatggaaatttctagtgatgcagatgtctgtatatcaagtactcacacaagcagatgtaaagtcataactgtgatgaaggaagaccaattgaggacctccatcagccgaggggcctggacgctcactgagaggcgaggtttgcactcagtctccttgcccaaagctggcagcctcattctgctgcccatgtgctgggcaccttctccactatcacgacttccttgacatttcagtctgttctgttcaagttttggccttccatccctctgaaatgggtcttgctagtcactaatgatctgtctcttgttaaggtcagtggcctgtatttcgtcctggtctcaatcagtgtctcaacaggactgtacagaactagccaacctcttggattctgtgggcagtgccaccctggcatccttctggctcagtcttctgtgcaggtcccccagtcaccaggagccctgcaggtgcagcctacctgcccccagcccaggctgcgctccctgcttgctctgcgtgtgatgctccggcctttgccgtgagctctgacacagtgcagcacagacctgcttgagctctggatcccctccccaggctcctgtccatcctgccccctttcagcttcctgcagtgaccattgcctggaactcaacccagtgttttttctctgccccctttttctgttagctcttcccccagtggtgtggggctgggacaggggcctcacattgtcgtccacgtttcccgaggcttctgtctctccatcccgctgtttcagggttctgcatcctgctgtttcagggttctgcatcccgctgtttcagggttctgcatcccgctgtttcagggtgcacgtttccttctcgggcttggctccttgggtcatgtctccagcctgacgttccagctgagaggtggtgaggcaggaaggggtgtctctgcatcaggaaagcgataaggagttcaggaaacccagtgtctctcattggctggaagagtattacacggctacctctggttgcccagatgcctggggcagggtctgtgctcgagaaaataaggctctgtgagtaagggtctcccacagccagatcaacaaggagctgtaggctgtaagtcctggttcctgactgagggaggcctaaaaagtggggctgttggggctttatatttagcacccactttttaccctctcaaattccagaccagttgagagagccgcacacactgtagataggcaagtggagatcagatacaggctctgttttagataaaagcaactggagaaagtggctgactggccaagcgggtttgctaatcctttatcccaaattagacaaacttcccacctagtaacgagcatggctgggggcaagccccttccacgtggcaggagaagaaaccctagcactttggtgtgggtgcgcctagcccaagaggagaggaggaccggctgggctaagcagcccatttcctccttctagatgcctccttctgcaggaaagagtgcgtgagttggattctgtccacagggaacagaagcgcaagggacaagtgccccctctgctctgaggaagggttttgcatatctcctgttggaagtctggaagctgggcagtctcgctccctgcaccagctgtgccggccctgcctgtcttcctgcaggtctgggctggctgctgtgggcctgtgtcctcaacactgccctgccctgaggctgttggagggacagccccagtgctcccccttcatcatccactctcctttccctttagtgtttctatctctggatttgtttctggtgagccttccctccagaaggaactgctcttgtccccatgtacttcctcgaggcctccctggtcgttcctaggggcgatcatactatagaaagaacccatcattgtcacccagaagtgctcctgagagatgagggaacctctggggaagccagcttgggcttcgggaggaattttctcctctctttatttttattttatttttttgagacagagtctgtctctgtcgcccaggcggtgcagtggcactgccagctctgcctcccgggttcacaccattctcctgcctcagcctcctgagtagctggaaccacaggcgcctgccaccacgcccggctaattttttgtatttttagtagagacggggtttcaccgtgttagtcaggatggtctcgatctcctgaccttgtgatccacccaccttggcctcccaaagtgctaggattacaggtgtgagccactgcgcccagcctttctcctctttttaaatgttctcaagtagcttcctcttcaagtccggtttctttttcttgttttctgctgggaactagatgtagttcccctccttcctcagcagcaccctttaggtacgagacgggtggggttggccctttccattctttaaggagagtattttccactgtgagatggtcacataccttctctttggtaacaggacaaaagagcaaatgctggaaaaactaagcttatgagctttggggaagcctgatgtgcaaatgagggaggctaacatgattttcgggctactggattggtgctcactcccaatttgaaaactagtcaggagataccgaggccctgtgtgatgtggtacaaagtataaggcgttggccatggtagagaatcatgatttttttttttttttctggaggtgggaagccattgtggttgggggcatgaactcagagttgtgccgtggaagggtccctgtggcaggagaacaggtggagagcagacgccgaggggccgctgtccaggcaggagtgatggagcatggctggtggggacttcagacacatgtgcaaggttctgaggatgcctgggtgctggccatgtggcaaggtggaaggcagtgcctatgactggacagctgggagggagcccactgtggtgatggggagggtagactagcaggtctgtttgggtatgctgacttgggggcactcaaggggagctgtcagggaggccattgggtggaagcaattccagagacaaaccgctgctccctaaaggaaaaggagagtgcctttgcctttcaacctgagctccatgtggtcctctggcccagcctgctaggcagcctcgccctgctccccactgatgtcacacaggtgtcacaaaatgaacatctgaaaccagagcttcattttcctaaatttcctagcctttctccttacagtgaacgtcaccaacacccacccagctgctggaaacctggcagtcatcctagccacctcgctttccctcaccgtcacacccagtcccctcaaacatttgtgcctgctgtccctgcgttcgcttcccacccgggtgcttgcctttccacgtctccctgctgtccagcagctggcaagtcattcctgccctgtgcttgcaggctccacggacccaccagggcatctggaatacaactgtgacttcctcctcaccccacggctgtgcttgacccggctcccatctgtctccagatcccttggagcactctcccaggtctgctgcaggcccatggcctcctcccttggaccactctccccgtctctgtctaggggctgctcacagcttcctagaagtttcttgcctgggctttgcttattcccagctggtggctttccatctgtgctcttcctctgctgacggccccttctgccccagctcattatatgaccgttgtctcccatcccgtcccgacctgcctgtttatggaggcatcctctaggttctcagtggagggtgcctggcccctggaacaaaactgttgagtttgaatcatccccaccctgcctcttcctagctgcagtgctgggcctcagtttccctatgtgcaaaatggggacactcaaacctgcctcattcccgtgaggattacatgattaggtaaagtgttcgtggcagtgtgggggatggcgagtgctaggcaggagctggaggctgttctctttgggctatttgcacacatatgctcttagcctcctttcgagcactttcctcagccttcaatcttgtgtatatttgtgtgtgtttctcttttaggagagagacttctctggcattgactggacaactgtcagagcttatccttgacctgagctcactgcctctgcctcagaattgggggtcaggttattcttagtattctaggtttataaggccagacagagtccttcttccctgtagagcagaaatgacccctaatataggagcatattgttttccctcagcagagcaaatgcttcagtagtagtgttaccagcagacagatggcgctttagaggtgacatgtgatagatgcttgggactgaaatttagccgtggatcatagcctgaatgggattttcacgcatgtcttccctctcaggatttctcttaagggttgttgattccacatttctccttgaggagggggtggtggtagggctggtgaccggggaactgtaatttcctgtgggagagcagcaatttcattattcctttaatgaagctatagttgatcatccttcagtgcctagtatacagcctgttaaattagggtcttcggattgctctgcaagcctttttaaaaaaataatttacaggctgggcgcggtgggtggctcacgcctgtaatcccagcgctttgggaggccgaggcgggtggatcacttgaggtcaggagtttgagaccagcctggccaacatggtgaaaccctatctctactaaaagtacaaaaaaaaattagctgggtgtggtggcgcacacctgtgatcccagcgagcaggaggctgatacatgagaatcacttgaaccttgggaggggaccactccagcctgggtgacagagcgagactctgtctcaaaaaaataaaaaataaaaatttacaatttatgttaaaatatgtcattttaagttatgtaaatccaagcataattactgaacacaaggctcaatccaaaacatgcacagtaagcccgtgtgaagtgttcacatgctgttctgaggctggctggatctggagtttctgggagtgctctcttgggctggcacgtcttgggctgtgggggccctgaagccctcctagatgctggacattggtgtgtgtgcaacttggtggtggtgttggggttactttccagaagctactcaaggcttagtctcagtttctatctaaagatatttatatgggaagtattccaaatgtggatttataaagataacacatggatagaaatagtgtaaaacttgtgtgaactgaaccagccaagcttctagtcttccctttccaaaactttcctttttctccccccgtgttaaagatttaaaaatatatgtttaaaaaggtcacttttaacttgtaaaaattattcaacatatacagaaatttaaaaagcagcattgcaggttatgtgagattatgtatgtctgctctttggaactaggttgaaatgatagctacaaggttctttggaagaatggggatgtgtgggtgagagtggagtagacaggctgggcttactaactaggcttgcactggcccccgtcagtcactgttcccaagtcaaatactgcattgcactgaacaccagagcagcagtgcatttcctagagaactctgcaaggctacaggtggcagacttagggagcgcttgccatccctgcccttcccagctctacccagaacaaggaggcctcgcacactacctggtcatattttgacttcatgcatttaatgaaccaaactaaaggtaaatattttcttttgattcccaaggcagacttgtgggtacccaagttcctcagcccatctttaactcagtaggatgtggcatctccattgaggctcttcatggaatccctggaggtgaaacctcggtgtccggttgctccaaaccagtgctggtgggattcagttttctggacccatttctgggtgaagtcaaggaatggaggcgggcggctgtcaagcgtctctgttgctcaatggggcaggccagtcccagcggcgacttagaggtggctggctgggcgtccctacaggagaatgggccacagggccagcggggccagcaggatgagcaggcctggtttggggtatgggccgcaggcgtggagctcgatgctgggcaggggcctgctcactgacgagttgccacccgggattggggtaggggtgggcgcggtggtctcgggctctgagcggctctgcaccggcaggagcaggactggcagcagcagcagcagcgccagtgcggatcgggccgccatggccaagcgctccggctcgtcccgtagcagtgccgcggcggcggccgctgccgggagtgtctgttccgcggttacgcggggtcctctccggtcctgtccagtgaggtcctgacagctgtaccctggcccaacccctgcccacggctgttaacgatcagcctcggggagcaggtgtgccgccacgcgcgccgtagcgctccggagctggctctgcgctcacgtgctcgctgtgccctgcgcgcgggcgggccgtgtccccgcagccccgcgcctggcgctgccaagctgcccagcgggctttagcaggtgctgaaatgcccgctgccagtcgccgagtgctgggtgcagaggatctctccagacacctaggctcccttctttcgcggcacgtgggaaaaactcctgaagtgcgtgcacagagtttttgttttagaggctttgacgttatgattaagtatacctgtgatgtaacgaaaaccttttttaatgcttctcaaaagatttgctagcgtttaacatttacctcctgtactggagtttaaaggaagcgttgcttcttaagtaatcagtgatccttttgcttttggaaattgtaatgaacttcaccatcgtagagctttaatatttctttcctgaagcagaaagcatgtgaaattttctggatagtgtatacttaatacgcaagcttttggagtttttgaatgctgggtatgttagcacaccagtcttgctgactattacgtgggagatgagtgctgcttaaaattgtgtaaggggtcagtagttacagtggtggacatacttttgccagacatggtttattttaaagtgaacatattttgtgcttatttatttatttgggacagggtctcactctgttactcaggctggagtgcagtggtaatcatggttcactgcagcctcaacttccaggctcaagtgatcctcccacctcagcctcctgagtagctgggactgtggggctacaggcgcactaccacacccagctaactttttttattttttgtagagacggagtcttgctgtgttgcccaggctagacttgaactcctggcgtcaagcgatcctccctcttcggcctcccaagttgctgggattacagatgtgagccaccatgcctggccaatgtgcttattttaattctaaatcagaatttctataattatcttccttaccttggtgtctgtctgttatcagcacaagggtttaaaataatttttgatttcttggaagtaattacgcaggcagttcaatgggagaaggcactttcctcagcacatttggggtgctgttgtcagaaagaaggggatggattcaagtcagcaaaaccagctgtaaccacaactatattttttaaacatgtagctgcatgttccataaaacagcatataaaaaatagagtgagcattctttattggagaaatagctgattctaggactgggcaggaaataacacaagtgccaggaatgccaaggaaatggcaaggaaatgccgagaaacaaacataaccacacccacatcaatgggtggtgtcaaagggacccaggagccaactgaaagagctcccagtggccaaagctggaacagtttctacaacaaaacaaagtagtattggattatagcccagagataaataaatatccatgagtccagactgacataaataaatgactgataaatgaggagaaaagacaaagctccttttccagcacaattccagatcatctctgcatctgctgtatctgctgtgtcttccaggaggtggagcacaacccttaccccaaggcaagggctgtgcagagcaacttccttccagagaggacagcatggaagtggggcggggggctcaacccagcaggggccaggtcagcctcacagtggtcagtcacggtgacagggtgtgcctgatacagtggagtgacagtgggccttcacctctgggggcttcatccccaaactcagtcccttcctgtaccatgagaaaaacatcagacagatcccagctgagggacagcttcctcaacagtcaaaaaccaagaagagtctgagaaactcacagccaagaggggcctagggagccatgacatctcaatgtcacgtgggatcctggacgactgaatctgacgaaagtgtggatttcagttaataacaatgtgttaattaatactggtccgttaaaccagcagtcctcaacctttttggcaccagggactggtgacaatttttccatgggccgaggtgggggctgggagaatggtttggggatgattccagcgcattacatttattgtgcattttctttccatgattacattgtaatatataatgaaataatcatacaactcagcatcatgtagaatcagtgggagccctgagcttgttttcctgcaactagatggtcccatcgggggtaaggggagacagtggcagatcatcagacattggattcttataaggaatgtgcaacctagacccctcacatgcgcagttcacaatagggttccagtcctgtgagaatctaatgctgccactgatctgacagaatcagtgcaagaactgattctctgaagcccagttcctaacaggtcatggactgttacttgtccatggcccaggggttgggactcctgtattaaaccgtgctcatgtaagatcttaataatagaaaatgggtgtggggtctgtggggcctttctgtcacatctgctcaatttttcttcaaatctaaaattgttctaaaaataacgtttactttaaaaataagtgttttttcaaaaacacttttttgtgtccttatcttctgctccaaataaataattatcctgacttttgtgtaagtggttccactagttttctttgatttcttaactctgtctgttacccttacacagtatatcctttggttttgaaaaccgagtagtcagggcacacttatcgaaccaggccccaggggtcagtgacggttgatctccaaggggttcacttttggggaggggggtccctcctggagcagtgcgttcagctagctcgtatactttttcacaagtgtgttctgttcccttcagcggggtaggcctgctaccctctccttccacttgggcttcccctttcttgtctgtctccttgtgcctggcagccttgggtatctgtgatatggctgtggttagttttggtgcagtgggatatatttatgtgctgcagtcacttctgtgaagagttaggtgctgtccgggtgctgtcagcttggattccggagttgtcctgtgcagtggaggctgtaaaggagcattgtcagggaagagaggctgttgctactgtacccatttgactggggactcctgggatagagtgagttccaagaaagagcagggaagaattgggtcagtggagacacagtgggggtcagggcatggacaggccgtgctgcagcttggagatacaaagaatgagggacgaacccagaactggaggtgtttctcaagaacagaatcttcaaaggttgagatgaaactcccatcatacttactagcaataacctctagcaaagttgaggtggtctgttttggctaaataaaatggacatagcattgctgggcccctgtgaagggctggaagcagggaaatgtcagcagtggcaagcgtgccctctggggagtagggaatttccctggcgctggcaggcagcccatgctgccgtagatgtttcctgctgtcctgggtggcctcacacagagcagctccacacctgctctttgaagttttcttggggtgcctgctggctacaaggggtctagatgtttatgacactgatataaagtctctgtgcttcccttggggaaatgctcccaagtatgaagcacccaggttctgagaacagagttggataaaaaggttgagttggagaaacttacctaacagggttaaagtggagacaaggatggcatgtgaagctttggctttacttcccaggtgatttttctgttacgcttagcatgcatcattgctgcttcgttgttttgttttgttttgttttgttttgtttttttagatggagtctggcactgtcacccaggctggagagcagtggcatgatcttggctcaccaaaacctccacctcctggggtcaagcaattctcctgcctcagcctcccaagtagctgggattacaggtgcccgccaccacacctggctaatttttgtatttttagtagagatgaggtttcaccatgttggctaggctggtcttgaactccagaccctcagatgatctgcctgccttggcctcttaaagtgctgggattataggcatgagccactgcacccggcctgcttctttgtattttaatatttgtgtattttatgattttctagagaagcattggtttcattttggcctaagtatgatacaagaggtggaaggctggtttctctgtttccttcagctgctcctgactggtcctcatctgttccttctcagatcacaattaactgaatatattttaaaagagaaaactcgtaagtgccctaaggaaataaggaattattttgaacactaaagctaaaagcattctaacattgtgttgcttttatgttctttactaaatttgcttcatgcacacacacacatatatgagtgtatttctcagtatgcagatgatttcaaggactggcttccttcgtgaaaacgtattgttggttgcaagaagataggggactggaaacatgattcgtctgtctgtagaggtgaagttccaagaagctcaccactgtccagtctttatgcttatgaacttgttgagtgagttctttttttatagtgtacccatgtctaggaattttggctgaaatcagcttctttgcttttttaggctttttgctagtgatagtgttgtctttgttctgtaaaacaactgtaaaggaataccaacaatctagtgcagaaattcttttgtaagaacaagctaccctgatgtcatgtcgtgttttaggactgtttgcttctcaacctgatgaagttgttcttagctgtttgctttgttttctcatccacagcagtattcctttctttgcctttatgcttgattgcaggcttgttaaatcccgtgggaggcttttttttttttataggtcctttctctacttggctatgttgcctgctgagtttaaagcctttttatgatatttaacaaagccctctgtgttcagcgtgggttgtggttgtgtttaatgtttcaacctagactcgtgtattaagtacagatatcatctgtcacttaacttagccttgctctcagtgtgtttatcatcatgtctctaaggccatcctaaatacgtgacctggagagagagggggtggctaggccaaatgctgggatgcctgcactccgtttcttagccgtgagtctgtgcttggaaacccacgagaactctggggagccacaggccttggggcttttagctgtcccccttttctcttactctccggatgagtgacttgggaacttccgagcaacttaaaatatttagctcactttactttaataaaccatttttagtgctatctatgatagggtccttccagtgggaggtacacaaatttaacttaactatagttaaacaagagccagaaaggtaaagaaggtattgttgagaacaaatacggctggatgcacttttggggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaaatacaaaattaatatgcaaacgtcaatgttattcatatatacaaaaataatcagaagatattatggaagagacaaccccattaacaatagcaacaacgagaaaatatttaggaataaatgtaatgagaactgttcaaaagctaagtgaagaaaacaataagttgagaaagacacagaagtcgccttgagcaggtgaagacaccttgttctcggttaagatggcttggctcattaagatgtcagttgtcaggtaattttcaaatttaatgtgatgctaatatttgaaagcaaaaagactcagcttttttttcttgggctggacatgtcgattctaaaattgaaatagcatgaatacctagaaaacttagaaaagaaagagccaagaaaaggagaatagctctactagatattaaaacatactacaaaggctatatggaaaatagtgtggcaaggttgcatgaagaaccagacagaccaatggaggaaataagcccatatatagatggaaatctagtatatgataaagatagtatctcagattgttgggtcaaagatagattgttagagtcaacgttcttgggacaattggactccattttgtaaaatacatcattaggatttatagcttacaccacatgcaaaaataggctgcaagtgggtcagagaactcagtgtgaaaaaggcaactgttccagtgttagacacaaacatggttgaatattacctatgtgttgggaaaggcttttttaaaggcgtaactcaaaattcagcttcaacaaagaaaagatggatgaatttgactgcattccaaaatactgcgaccagcctgggcaacatggcaaaacctatttttacaaaaaatacaaaaataatttgggtgtggtggcacacacctgtagtcccagctacttgggaggctgaggtgggaggatcacttgagcccaggaggttaaggttgcaatgagccatgatggtgccactccagcctcggtgacagagcgagaccctgtctcaaaaaaaaagtaacaactttgcctgaccaaaaacaaaacagaaaaacacaataaggtcaaaagacaaaaataccaattgtgtgaaaacctttgtagcatatcataaatgttttaaaagttgagggagaagaaacccgaaattctaggaaaatgggaaaaaggtatgaacagacacatatgcacatatacacgtacataaacatggcccatacactttaccaagataccatttcttacagatgtgcaaataatcaaaagtctcacttgatagctatttctaataatgttgctatttctcatgtacgtgcttaattggaaatggtgtattaaataaaggtgaagaggcagttgccttttcagcttaaaagagcattaaagtttatgattgttaacttctaaatttattctcagtgtgctttgaaatagactttataacaaaagcagcactaactctccctagatttcctaggaagcaggtaccaaattcttatgcacctgcatgcacaggctgccaggatgcccccgctctactgtggattattctaggctgtttctccttccttccaaccaccacacccacatccctaaacctaggggtttaaatttaggtaacacacctagggcttgttaaatttaggtagtttccacacttcgaccttttttcttaggatggctctgtattcattatggatttcataagtcacatggctggaaggtacctgatacagattaaacacagaatttagttaggatagcattctgtctttgaaggctgtgtgattgcagcccaggccaagccaggcagaagttgggtcacttgagcagggccctgcaaacacacctgaaggaggtggcattgctaggactctacttttggggctgaatcagcagaggcaaaaggactgagtaagtccttgctgaggatggcacagctctcagctacagagctaggaccagaccaggctctggggttcatgcgggaatcaccagtctgcgctgctgcctcctcctgtatgcgtgtgtgtgtgcgcgcgtgtgcgtatatgtgtgtgcgcgcgtgtgcgtatatgtgtgtgcacgtgtttgcgcgcgtgtgtgcgcgcttgtgtgtatatgtgtgtgcgcgcgtgtgcgtatgtgtgtgcactgtgcgcgcgtgtgcgcgcttgtgcgtatatgtgtgtgcacgtgtgtgcgcgcgtgtgcgtatatgtgtgtgcacgtgtgtgtccccatgagtcctgtggcaccaccgagttgtcatgaatgctttcgtttaacgagtcaggagcagtttcccattttgtaggctgtttttctgtgacctggattttaatggcttggtcaacaggtggaaaagtatccacctttccttatcagtctggaggctggttggttttttctgcgtcgcctgcgtcaccacttcctgatgtcagcgcacggggctctgcgcccccccaggactggaggctccgtgtagatggagacttttgtttttgtcccatcctcctggcatgtagaaggccctcaaatacttgttgaagaataaatggacgggctttggtattttataacctagcaatgcaccttttggttgtttccaggtttactattaaaaccaacgtcttgatgcccctctttctggatgcttttggtgatagagaagccaaatcacgctggttttaagcaaaaatcatgtatttgctcctgaaattttcctttgaaaactttctgtatgcggttgtacgtcagtatgtggttttcagccacactgggaggcgcctttctctctctttttgtcgctatagacattagtggaaagccacaagtagcgtgggggctgcctctagtcacgcttcagctgcaagtgcggtgtgagcatctatttttacctcacagtcctcgctctgaaaaattctgaccacttttatttttaacattctgctctattagctgggtgcagggaggaaggaagctcaaattagtcagtttactttgtatttatttttacttgaccttttcacttccacattttgagaagaaaatgtgagactctttcctctgcataattttcttccttgaggagaaaccattttcagtcatgcttggaaagaggtggagataacctcagggtagcatgtttagcgttttccattcacgaaacaaaccttaaaatgttcatctgtttattctatgaaataattagtttcttatttcccacgaatttgaaaaccagtacatttctgtgccaagtaatggctgtgttttcttgaccatccggcaagtctctacctgggtgtggtgacttggggaccgcgttgtcaaagagccagtgaggcgggggtgtggagaatttgtttgccctttgtttttcacttacctttttctgcaggaattgaactaaacaattgctactgacaatgatgtattttaattcctaggaggttaaactcctcacctagaacagtttgattaataaacctaatctatttaagcatgtgtcaatccttttggaaattgtaatattcaaggacttgctagcatttatggctctttaaatatttctagttatagttgctgtcaggattcatttattttgattgggtaattagttttttaccattattttaaaaactaataaacattttaatcagatctcatggacagaaagccaagattcttgtgctgcttcctaaatgcagtgggcgcatctctgtcagtttttacctgctggaaggtactcctgagtgctgtgctgagctctgcccatctgtccatcctcttgggacactcatccctttcccattctctgctctgtgaggggatggtgctagtgagagctcaggtcgagagggctggggtgctccttcgtctctcagctcatcagcagtgacttggaagacaatcagggtctacctgtgttgttgagaagcgttacgcaagcaggaaagcgcacaagaggaaggcgcagctgagtgaagcattgcagagcccgccaggctgtgccttccacccaggccagcacacggagcgctgcagtccctgaaggcttcctcaggctcctcctgttggcgtgggtgcctgccactgacctctgtgggtgacaggtttgtcactggagcttgtatcctgcaacctgtttgtttgggcgtgcctgtttgtttgtttttaacgttttaataaactttattttttagagcagttttatatttacagcaaaattgagggacaggtacaaagatttcccgtatgccccctgcccccacacaggcacagcctcccccattatcaacatccgtatccggagccgtgtatttgttacagttgatgaccccatgttgacacctcattacccagagttcatggtttccatgagggtgcactcttagtgttggacgttctatgggtttgtacacatttatgacgatatggatccatccttacagtatgcagaattgtttcattgcccttaaagtcctatgcttagcctattttttaactatataaatgcagtcaaaggatgtgtttttgtgtgttttcttttgttcagtattacatgtgtgatgagacttgcctgtgttgttgcctgttcgtttttactgctgtacatagtactctgctgtttgaccatatcatatattcattctgctgacgatggatagttagacggtttccagtttggggccattataagcaaaactgctctgaccatactgatacatgtgttttggtaaagaagcacaggtgttgctggggtggatgggctggctgtgagcacacgcacttcagcgtgagtgggtgatgctggcatggtgcctggttgggcactcaactgcctgctttcaccacactccccatgtggcatcaactgctttggaagtttctgtcttcttaatttttaccattctgggcaggtgtgtgtggtatttttctgtagttttgattctcatggacctgcttactagtgagattgagcttttgttacatttcatggaattctggactctctgagatgcctcccaaagtgcccagctacagcctctgtcatcagggaaggagcaggtatgggaatggtgtctctgcacacctcatgtcttgcctacatccttcttcaagaaaatactggttttccccctgaaaatgatagaaattgactcatcatttttgagtctagctcaggtgtcttttctggaattgccttttttattcggtgtaaagaggcacagggacttcatatctgctatagatgagtgaaggttgcctagacatgcacacaaggcccttggtggacttcccctatccctggggctcctcataacccttccctcttctcttccctggactttctgggctggggccagggcttggggtcgggggtgagccttcctctcggtgtgtatctctgtgtagagttgcatggtgagattcggcttctgttctaaatgcagttgggtggaaataaagcagggatggtcctgagtcacccacattcctcttggtcagtctgccctggtgtgaggagctggcagcctctgcagacctttggtcccacttcccatttgggggatgtaggcttgtgttataaaataggtgaacatgtgatttactgatttactgcttgaacagggacacttttgagagtgaaagggcctgcaattattaatgaccccaagatgacatgtgataacgaggaagttctggggagatcaggtcatgatccccagagttatgatctcaaagatggagagtgtcatagggaggatgcccctctgtgagttgtgaggggccacgtgtgtcctgtgtacacaggccctaaggggtgctggggccatgtgggtagtcataggaagatggctggagttgggaggcagaatgtttaagtatttcactcattgactaaacttagttgagttttatttgtctgtgaaaagggaaatctacttgccttgcttgcacgcctttcctagggatattttggggactaaaatgtgatagtgaattttaaaatattggttgaaatggccaggctcggtggctcacgcctgtaattccagcactttgggaggccgaggtgggtggatcacaaggtcaggagttcgagaccagcctggccaacatggtgaaaccccatctctactaataatacaaaaattagccaggcgtggtgttgcacacctgtagtcccagctactcgggaggctgaggcaggagaattgcttgaacacaggaggtggaggttgcagtgagctgagatcgtgccactgtactccagcctgggcgacagagcaagactctgtctcaaaaacaaaacaaaacaaaactatatatatatatgtgtgtgtgtgtatatatatatatgtgtgtgtgtgtatatatgtgtgtgtgtgtgtgtgtgtgtgtatatatatatatatgttgacatgtgagtttttcagtttactctgaactctctccttgtctgttttttaaagcatcctgaaagggagtgtctgtacagcgtcacctgttaacagccactaggaagctgccctgagagttggacctggccgagctctctgatacttgagcagccctgcccagaggagcctgtgcagcacatgagggttcttcagtattggtcggtgtttcgggagcccttacaatgaatgaacacagctgcagcccagtgacccctcttggacaagtgcggagatcagttttagctcagctgctttctgaatgtttcagatatttcaaactggaagtcacaagtagcttttacttttgcaagcagtctgctgttatgaatagcacgtataagaaaatttataattcagttagttaaaaatatgtttgagcacctgttaaagcaccagaattcttttataaattgaggaaagccatgccatctaacacatatgcggcattaagtgttcttttaataaatattatgcttagtagacatactctacataccaatcagaggttgccatcctaaaccaaaactacatatccagcacattctgatattaggcggtggcttacaccagggaaggcttggaggttgttttggctcctaccctttaaaaggcttaccagcttttagatggagtcatagataagacatggatagtaacagaaaggaagcatggcttatcagctgtgtcaagtccggacacatgtatccccattcacattgctgaactcaggaagatatccaagcaccattgtgacatacttgtccacagagaccgcagataaccccagcaccctctcagagtggtgccttggtgtttttgttcataaagccttgatgctcaggcccatccgtcatcccgggcaggtgcgtagcctgtgtggtggatgccagggtcaggggagggctttgcttttgcagagtctcgaggcttaggctgaatgtgtttttaaaggtccgactatactgaaacaaacattaaaaaatattcaacatcacttaatttttattgcttaagagcttatctggctctcccattggctcagtaatttggttgctattaataacgttgttgaggttgtcatcgtcaccttaacattgtcatcatcacctccagtaatagctaacatttattgagttcttcctccatgcaggaactgtgctgagttctttttctgcattattttattcagcctttgctgcagccatctgcagcaggcactgttactaaccttctcctgccagagggaacgcttgagatgctgcagggtgacagtagcctcagagccagggggctgcattgctggatcttcaagcaggcaaactgccaactctgtgttcataatcctggtcatgggctcgcactgacctgtagagagctggatatggggaatggattggagagcttttatttgaaacaacagcaaagtggcatgatcttttgggaatacactttttcaagtcatgtatccactcacagacaggctttgtgagcctcttgctttgttaagggcccagggaagattttaaggcgaccaaacttccagtgacaaacaatatttgaaattagtctattcctttaccccagaaatgcagaaatacatggttttggatgtttgacctcattggttggtgggcatgaggaggtggtctgctttggtgccaatgaccgtctgtgagtcacagagtgagtgaatgctgagccgctgtgatgggaaagctctctgctgagttggttcagtctgggtcacagagtgagtgaatgctgggccgctgtgatgggaaagctgtctgctgaattggttcagcagtgcacctgcttcctcacggggcattagccggtcagggcgatgtctctggatcactcaacttgtccctgacagagcaaggaataagaaacccagttagattgtctgtatcatcagatgccatttacatcccagtcaaattagcagccagatcactgatttcttataggtatacatcttttgacttcagcataatctcttcccctttttctgcatccttgggttttaaaggatgtttactatgtaaatgtttaacatgtttactatttaaacttaatagttgaggtagcttttaaaatttgtgtccattaaacccaaggactcttgcagaagtcgtatggtttttcttctttcatctataatgcatgtaaggaattattcacttgctctaaagttcaaatgtgtgagtttctggtgctgttacataacacgtggtattgtgggtcaaggggagttagtgtctcacctaaaatctggggccatgatgtcaccacattaaatagtagggatgtttgctcatcttttaagggtatttcttccccctgcaaagcaaaatgctgaagagatacatatttgttaattaactgatttcaccctcgtcatccatcctctttccataaggaactgtatgttgcattcttgctgagtgcagactaagtcctttgtgcaaggttgggtcatcctggggtgaaaaggtaagtgctttcggggatgctgattaaggtggtatctgctgtgcctctctcagtgtccccagggcgaaattcctcaggttacagtggcaggaacagctgcttgagctcatttttgtcttctgaacaggatcagtcttggaattggccttttctccatcttcagccccagggtggggctggcctgggtagggcctgcgcctgtgcttgctgcgcagcagcacccctgcgtgccttcccttgcctcggctgctaagtctttggagaaaactctacattgccaagcttcttctgaaagatttaattttttatttagaaacagtatgcttattacagactgtgcagactttgcagaaatgcaaaactaggaagagacatattagtccctttgcatagaagcaacttttgttattattttgtatgtttcctttgtatctgtattagtgtgttctcatactgctaataaagacataccaaagactgggtgatttatgaaggaaaaaggtttaacagactcacagttcagcatgactgagaaggcctcaggaaacttacaatcatggtggaaggggaagcaaacacatcattcttcacatggcaacagcaaggagaagtgtccagcaaaatggggaaaagccccttacaaagccgtcagatcccgtgagaactcactcactatcacgaaaacagcatgagggtaactgcccccatgatacaattacctcccactgggtccctcccacagcacgtggggattatgggaactacaattgaagatgagatttgagtggggacatggccaaacaatatctgtgtcttttttcatgtatatgttttttttttcttttctcagcataattgatatactgtggttactctacctatttgtgtaggcctctcaggtcattgaaacaagatgttgtacaaattagcagatgacactggcgcatggaggaatggtttgtattttaattttcactgtataacattttagtaaagcttttactggaaatgttttctacccatatcctcaggaaaccatgtgaagtagacagccttgcatttcctggattgctccctcgaaggatgaagggagcagttctatcagatgctcttcccagcctccttctccagggagacctagccgctgctgttttgagtttcctgggaggacatcccccaaggactctctggcttgtccttgtgaagttggtttgctttttgtgccagctttttaggcttacaaaatgttgtgtgtgtgtacataggaaaaatatggaagggtacgtacccactagtttgtgtcagcactggattctggcatatataatagatgaggagtttctgttatgtatatgggatttctgagatacacaggggttttctgtgcacatctctctataacgcagctgtcccgtcacatcctgcatgtcagtacaggtagtgccgttctcttcgtaggactgtgacactttatctttgttctttcacagttaaaaaaaaaaaagcttctttaaaattctgactttatataactaacgcaatgctcatgctacttcacttgttacaagaacatattattctgtcctatagatgtactgcagttatttaatggatcagctattgataagggggcccttttaatgtaactattttaaaaaatggaagtaataccagcacatggtaaaaaacacattgcagctcatgaatgggtataaattaagttggagatttcctctttctccctccccaccccatgccccgtttccagaggtaaacaatgtacagtttgtgttttcttctcttaagttcttcttgtagtcaccattatagctttaacttttctgtttgtgagttcatgtggaagtcaacagtgccttcacactctgagttttgatgagatttatattgacaaggcttaaaacatttgtagtgtttcccatctatcattaggctccctgtgcttttcctgcaagtgtagtctaaacattttaatataagaaaagtaacatttatagtattatgatagtatattttgccatagaaccaagtggtatgaaatgtaattctgcctcaccaaacctttgccaataaaaggagaatattcagatggaactcccagtttctctttaggtgtccgctgtttctagctgcctcagttgccatggtttctcctatcccatggtgttggtttcttggattctatttttgttttgctggagcacctccttaatccacttccttatagaatggatggctgacagacttcttaattcacttccttatagaatggatggctgacagacttcttaattcacttccttatagaatggatggctgacagacttcttgggtttttgcacgtaatgttcaaacatgcaattactttgttctcatacttattgataatttggtagggtctagaattctaggatcgtataattttccttttgaaatcagaaaatattctctattattttccagagtctagtgttgttaatgagaagttggatatccgtttgatccttgttctactgcaggtaaacatcttctactctctccttctctccctccctgggcttcatgtcctgacggtttgatttttcgttaccctaaacccggatctgcttctcttccagcccgcgtgcccatattgggatcaccccttagaaaacctcaggctttctttggagagcgattctcaggtttcagcccaggaataaaagcgttccctatggctcctgcttcttgggaagacccctcacctctgttgtcttgctctgcagtttcctctgctctctcgcatcaacctgctttcgtctgccttatgccctaaaagccctggcaggctttcttgtgttctgctaaatccctctgtaaatttttagcaccgtgcactattatggttcattcaccaccaaaaagtaccttttctgacattttaacagagctctgggaagaatggagagaagatatggtgtactttatcaccatttttaattaaaagcccttttaattaattaatttagaggcagggtctcgctctgtcacccagggtgaagtgcagtagtgtgatcgtggctcactgcagcctccaccttctgggctcaagcaatactcctgttatcagcctcttgagtagcttggaccacagtcacgtgccacactgactgattaatttttaaattttttgtagaggtggggtcttgccgtgttgcccagactggtctcgaactcctaggctcaagccatcctcccaccttggcctcccaaagtgctgagcacaccactgtgcctagcctaaaagcctttttagatcactctcagtggcaaaattagtgccttggtcacctttaccagtagctgttcttgctctgcagtggaaatatcactcaacattatcaaagaatcgggatgaaattaaatgaaccagtttaggtacttttgatacagaagttcttatgagacgtgttgttctttactatgtaagagtgtggccataaacttaaaaatagctgggtaactttgttacacttgccttgatggtgtgttgcaagttagttaaatttcatatactcttaatcagcacatcaccaacaaataaaatgttactgctgcatcagaatttagaggaggttctatacatctgtttcgaaataaagacggagatgacttagggtacttataagttgttgaaaaatcatggctcctgaaactatgaattgtcatcgtggtatatacccagacagcccacattaaactgctgtgaacatgagaaaacggacatcgaaatgataaaagcaagagtgttggtaattgaaatccattataaataaagctgtcattggtaacgcacgaaatgctgtttctgaggatgaggactttgtggcccccacgtgggcgcattaccaagctttgcagctctgcacaggagcctcccttcttgatactgaactagacctctataaagcctagtaacacctcaggtttaggttataaatcttaaattttagtgccccgtaataattcacttcgtaggttaccatggactagcccttagttgcactgagaaaagaaaggctatgaaattttgttggtgaagtgccaaagaaaggattgggttttgggtcatctcacagcccatggtgagggctgtctttggcctctaccgcacggacaagtttgcatgtcagatgttggcacacttgtggggtattgggttcttttgaatatctgattaaatccatttacattttcgttagaaaaattcatctgtgcatatgaacgcatcatttcatatatgatttcacacttctcattgtcttcctgaagcccattcgtgaactgtcgattgaatgcctgctctggagaggagtgtgaagctgcacttcttccgtctcctcctggcactcgctcaggatcctcacaggtgtggaaaacactctaaggaagcctgcgaaggccagatgtctcccttttgccttctttggttctgttcatgatggccttatcacggacacactaggaccctctgaggacaccacccctgccaccgcattgctctgggggcaacttccgagcttattgtcttcctccagcaagggcaggaatgtggagaagctgtgtgtgctgggcctttactttcattattggcgacaatgtttgttttcattttatcagctttctttatcctccatttttttatcttccacaggtagtgtatattttgagaacagcgtgaggtttattctactaatggaaatttacaaaaataccagtttgaatgattgagaaatctaagttaaagaacccttgaatagaaatgtcgctgttcagtgcgttgatcgattctcacatctgaagccagctgtgtattcttggtatgtgtgtattcaactcaggtgtgacctactgtcttttatatgtccctggatttaaatatgctaattttgttatgatttttgtgtctacatttgtaaaagccgctgatagttcatgtctggcacattcttgacagattttactaccgagattatactgggctcgtaaaacgagtgggggatgttccctgtttttttgttcgctggaacggtatgtgtaagctttgtgcttttcctttattcagccagtgctttcacatgctgcttccttttatagccactcttttttgctacatattctttctctacaagagcacagttcttctggaatgtgtcccttaggattaactatctcaggtgtgatttgtgtgaaaacatctttattcttattgtggaaagactgttgttaggtggggagtttactttcccgtctgcacattgaagatctcatcctgctccactactggtctcttccctgggccctgggcatccgctctcagcctgactgtccccctgtgctcccgcatcatttctctgtgctgtgtctgggttcatgcttatttgtatttattctgctgcgggttagttggccgaatctgtttctgtgagagctcccatgcttttggtactttctgtctctcgtgtgtctctgcactgctttctgggttattgcttcggttctactgcccagtttggccattttctctttaactgtgtctaatatgctgctaaaacctgtccactgagcttttagcgttagtcattatagctattatttctggagggtctctctgcttccctgtcctgccaagtccaattggtcattcttagtttacctgtttactaactgtttgtatctcctttagccgttgttttctgtacgtatatggtgtgtttgacttttccagcatgttcaaggctgttttcccagctgtatcccctcctctcgggccatcaactttttgttccccattgttgctactaattcttaggactaataaagcacttcaaatggcagctactgtcaaaaattaggaagaaggcttctttgccgtagcagcctccagttgattactttctcttgacctgtactttacttgccacgagcatatcatgcctctgtacttgctgcagtaattactgtctcgaaacagtgaaatctcatcagttgcccatatgtgtttaactgcacacgcgtgcatagtcttggctttatgcgaggtagaaaatgagagtacttagtttttggcagagcagagcctcaatttccacagtctaattaaattataatgataaatatcactttaaaaggaaacagttgcttcgtttaatcaatatgattattactggcacagcaaatccatcaagtgctgtgaatgataaatgtgttttaatacaacttgcagtgtacttgctgttggtacaaggcatgttaaatcctcagtggtccctcttttcatagcattgctgtggcactggcatttccctttgttaggagatagtggggtataaacccattgtggaaaccccttcagcttgacaaatttggagtcatgctattttcagaagaggatttcctgcgactaggagcagtcacccagagaaagctctggaaaggtggtggtgctggggttgaagatgagctgctggcccctggcatgtcagtgggcggaggtgggagacgtgcagagctgcctatcccacagtacttccctttccccatccaccctttcaggtggctcactccccaccagtttcgcaggatggctcaaggcaaatggagaaaacggcacaggttgaaactcttggccgtagcttgcgagcttgcctcttagcacctccaaccacgatctccttgaatgtagtctcctcagtctctcttttttgtgtgaggaatataaagtttctagttgccttttcgcataatctcatagctcttctgcacctgtggttccttagctcttatctgagaccgtggcaggcagacagctggttgcagtggttggttagttgtttcatatggttgatcatacagcagctacttggtcccattgttattgatagtattgtataaaatcagttgtcattgctggcatttttttttgttctgttgcctgattatttgttttctaatacatttttattgtgagatacctttcttgaacatggacacatatataagagaataattttaattgcatgtccatgtaactctcacccaggttaaatagacactgtgtacctcacagtttccttcatgctcctccctgatgataactccccctcatccatatgacacatctaatatatactacgtgtgtgtgtgtgtgtgtgtgtataattaattataattattattattttgagacaatgttttgctctgtggcccaggccagaatgcagtggtgtgatcacagttctctgcagtctcaacttcctaggcataggtgatcctcccactgcagcttccagagcagttgggattacagacatgagccaccactccgggctaattttgtttactttttatagagatggtgtctccctgtgttgcccaggctgttcttgaactcttgggctcaagcgatccttccgcctctgtctcccaaagtgctgggcttacaggtgtgagccatcgtgctggcctttttgtttgtttttgagacagtgtctcactctgtcactcaggctggagtgcagtggcaggattatggctcactgcagccttgaactcccaggttcaaacagtcctcccgccttagcctgctgagcagctgacaccacaggtgcacaccagcatgcctcgctgagtttttaattttttgtagagatggggtttccatgtgttgcctaggctgatcttgaactcctggcctcacgtgatcctcctgccttggtctcccagagtgctgggcttataagtgtgagccactgtgtttggtaatatcctatattttgaaataatactgtccttttctttttaattttaccatgtaagaatgcatccccaatcaatgtagttcagttttgcctgtgatggaactttatccaaggggagtcatcagtatattcttttgtgtttctcttgatttattaatgaagtggattacataaatcgattttcatacattaaatcatgtttgcattcccatcataaattcatcttaatcatgtttgatcgctttaaaaaatattattggattgagtgtgatcacattttgtatacgatgtttacactgtatttgtaagattgacttactgcttccttttcatcttcacagaagtgtcttgttgaatgttggattcactttctagagaagccatctagtcatggagtgttctttccaggatgatttttgtttactgactataatccatccctccctccctgcattccttccttccttcccttttcttctcttttctttttcttgagacaaggtctcactctgtctcccaggctctagagtgtgatggtgcaatttcggctcactgcagcctctgcctcctgggctcagacgatcctcctgcctcagccttctgagtagctgtgactacaggtgcacgccaccacacctggctaattttctttattttttttgtagagacaaggtctcactatgttgccaggactgatcttgaattcctgggctcaagcagtctgcctgcctcggcctcccaaagtgctgggattccatgcatgagctactgcatctggcttctaattctttaatgtttgtagttttgtcagattttctgtttcctcctgagttagtgttaataagttgtatttcttttctttttaaatggtgatgtgtgtgtgtgtgtgtgtgtgtgtgtgtgtgtgtgtgtgtgtgtgtgacagggtctcactctggttgcctaggccggagtgcagtggtgcaatctcagctcactgcagcctcgaccattcaggctcaggtgatttctcacacctcagcctccgaagtagctgggatgacaggcgtgtgttactacgcctggctaatttttgtatttttagtacagatggttttgctatgttgctcaggcttgtcttgaactcctgggctcaagtgatccacctgcctcagcctcccagagtgctgggatgacagacgtgagctaccgcacccagcctaataagttgtatttctcttggagtttcttcatttaacctaagcttacaagctttttggaataaagtttataaagcctcttactatatttttagtgttgtcagagtttaagtgataattccattttggtttctcttgccgcctgatgacccattcccaacttagtgacataaacaacaatcactttattaatgctcagccaggtagcctgagtgtctggagctctgcttctggctgtcagctgtggctttcttggttcttctcagtgtcctgtatgagaaggcttcttcagtgaggtggctggctcccgcctggggctgactagacatccttctctgcatgtagcccctgtgatctcttcagagcatctgagttggctccccagagacagtgttcccagaaataggaggtggaatctggcttcctcttcaggtgctggtctggacctggcagtaccacgcctgctgcgttcaatgggccagagcagtcacccgcctgctgggactcattgggggaagtaagatcttcccacacaaggacaggagagtcacattgtggccatcaggccttcctgccctccaattcaattccaaggctggttaatttgggctttttctcttgtgttccctttctgtgtttccatgagtcttgccagagatcactggttcactgcattgtcttttcaaagaaccaatgtttatctttgtgtacctgccgttatatgtaattaatacaggttgaatttcttactagttccctttttctgttttctttgagcttactttgttcttctctccctgacttgttcaggtaggcactctttaatttttttactcctattctagcttgagcaccgagctataaaggtccctctgatgtactgctttatctgtgtgccacacaattctgtacataatcttttctagttttaagttctaagtgttttctgttttctcctgtgattattttcttttgtctatggattatttagaagtgtattgctgaactctcagacatatgggactttctagttatacttggcttgttaatttctaggctcatggtattacgatcagaggatgagctctgtctgatttcagccacctgaaatatgttgagattttctttacggctgggatatggtctatttttagaagtggctcatgtgtccttgaggagctgatgtgtgatgcactgttaggagcagcgtcttgcatgtgaccgccatgcagcttgttaattgtgttgtgcagatcttccatctctccactgttttgttttttcagccgctgtctgctgtctctgtcacctgctcctctccactccctccatgacaaaaagactccggtgtttttgaccatcttttattgcgcccctactgtgatcttagtcacggggccaagcactctacatctgttcctccatttaatcctcacggcaccatctgcggcgggtgttccttgtgtcctcgtcctgtcctcataggagcaagcctggaaggggctgagtcactgttcaagtcacacgactgcaaggctgaggtctagggtggtggcctggacccctctttcctggaagccatgcttttcctgaaaccccttgcaatactcctggcaagtatggcagttttacctcagttggtatgagtgtactcaaatgggaggcaaccattctcacacttgatgtttagactttgcagcttccaaaacccactctgcatatcacctgctccctcctcaaagtggctgggcttcccatgcagtttcccatcctgcagacggcccagggaggtcagatttcttggccaggcttgcagagttggtgggacatgatgtgggcactagaacccagttctgtaaatcttggtttcatgtcctttctgctgtgtttttctttctctgtttaggcggtggactttttggtgtgtaaagcttctagaatggattttacttctttgtggctctttggattgagggaggggctaggtgccatctccagagaagcttgttcagctcatgctcactcggggcccttgctctctgcccactggggaggggctgtggtggagctggattcggactgagtggaggcaacgctgaaggtcagaggccaacgtccttgcacttcttgacactctccacccaggcgtggtgattgggaccgctggggagggtgatttgggagcttgaatctggtgtggggatgatgggggtcattgatagtggggacagttctggacatgtggccctcattctctgtgctggacaagatgactctgtgacctgtaattccaggctgatagagcattttcagtgacagcccatttgacttgatggtgctagtgcaggacacaggtgagcttgtctctgtgtcttaggtctgtcccagcagacgagctgacgtgtgttgtagatgaatgtcagctggtcacaggtgggaggtttggaaggtagcctccaatctcctctgaggactgcagcagcgaccggggcagcaggaacgcattgtgatggcctggccaagtctgcatagcgagagtcgagccactttcacgcgcaccttatcccacacttcacctccttcctccaggttcccactcagaaacccgctcacccctggacacacctcccagagacttctctttggaactctgcaatggagaaacccattgcagacttccccttcttttggatatcagtttgcttttcaggaagaaaattttaatactccatattgaggttttataattatattagcatgttgaaacattttctctaatggcttgctggttgaaaacgctttcacacagagcagaaactagatggagatactgtttcacaacctctgcttcagaagcagaggtggcctgtagcttccaaacccgggcagagcacgtgcagggatggtgcgtctctgtatctggactcacattcacatgtgtgcatgtgtaggggtgtgtgcatattgaattgtaaaaaagatgagtacgtgtgagattctgcctgagactccagtcctcagtgtgtggcctggtgccgctgatgccgagatgttgggctggcagcgatctgcctccgtctgtcacaggtgcctctacctgctgcaggcagacggacggagacgtgatggattgcgcatatcccctttacagattcggaagagtacatttaaaataacttaaatttgtatttagaagacttttcatggagagtatttattgttatagagttcacttctgaaatggtgacaaagcttttgatactgaatcaaacaagtgtgaagttaccgaatctctctgttacacagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggtgagtaaaaacctgtaaagatctgatcaaatctgactggtagaaatgcctttttcttgatataaaccgcttaattaagccttttggcttgcctttgaaagatgctttattgaatacttcccggcacagatgatctgttactgttggttgatttctaatcttactgcagccttagctcacccatgagtccctcctgcttgttctggggtggtgcctgctgccctccagtggcatgtgtggcacctgctgccctccagtggcatgtgtggcacttgctgccctctttggggtcagttcaccatttattgagtcagtgcttcatgccgggcactagacttggtgaaagccttttaccatcaattattattttcttaggagtaattaaaagaaaattttcctgtaatcccagcacattgggaggctgaggcaggcagattacttgaggccaggagtttgagaccagcctggccaacgtgacgaaaccccatctctaccaaaaatacaaaaattagccaggtgtgatggtgcacgcttgtagtcccagcctcgggagactgaggcaggagaatcgcttgaacccgggaggcagaggctgcagtgagctgagatcatgccgttgcattccagcctgggtgacagagcaagactctttctcaaaaaaaaaaagaagaacatttctttagtacttatttttggcgactatctcatgattcagcgtctgcttttgagagaagttgtgacaaatactaaaatcccagtaaaattagtatggtgtcagattaatttacttatgagcagctgagtgactaactcaggaagtccagttgtacatttccagggaagctttttcatgggttcagatgagatgaggggaaagagaaggtgtcagagggctgctgctggctggaggaacgcaggtgtgctcctgtgtccatttgctctgtggatactgacgagcgcccactgggcctcagatgccctctgggcatggcagggaccaggcgctcgcttggcagctctcatgtgagccgctcactggacacagccgtgctcccgcctgggagttcgggatggcatgcagagctgtggggagggagcggtcaccagggcgtgagtgtggacagatgggagtggctggtgcagagccataggtagggggcggtcaccagggcgtgagcgtggatggatgagagtggctgggagcctaggggggacgccgtctttggggagtagagacacacccatgtctgactactgggttttgagtttgtgccagcaaaggtcctgcttgccatttctgtctgtaaatgtcaggaatttcaggtaactggttccctagcgagacctttaaaggaggctttatcttcaaccgatgctttttttgggggggtacacaggcagtccaagtatgggaaggtcaaaatcaggtcacctttatcatggcttgtgctgtgggatgggattttattttcagccacagcgcttcttctagcttaattagtgataggaaatcagcttctctgtaaccagaggttattgaaagaatgaggatcccagagttggaatgagtctgaaagagacgttgtggtttaatattgctaagttaagtgtcgatttgtgactacctatttttaacatgccacagaagtaaaacattgcattaattatgccatatatgtgaaatagcaagtatttttatataatataactgtgcattggagaaatgaattatttataatcctttgcaccaataaattgttcttaaaagcatagaaaaaataatcaggccagaaggagatatctaaagcatgtgctgagaaagcaaaactgaagagctggaaattataaaatattacgacatgatgagtcatatctcctcctcctgattctgtgttactaaatgctagctgcgaatagaaatcgtgtatttcctttctttcataaaataagagctaatttcggcagcaaacagtttggcgtgttattcttttcccttttcagggtggtttaaataaaaataaataaacatgaaagattttggctggaacatctttggaagcacggccgtcctcagcctcactgcactgtctggtttccctctgagcctccctcccgggtcctgccttagtgctgtctgtgccgtgtagccacaggtcgcactgcagggctgtggggagttatttttagtttcaggcagactcactgtttttgcctttctttttgcttgaaaagactgaagttatttcttgtgtttttatacatgagattatcttctgaggctggaacatcttggggggatacaatagatagaattcctatagtaattcccctgcgcaagaggaattgctgaggagggcttcgggaaaccttgactcttgttgaagcctggaaagctttctcagtctttctcattgccaccccacaccacatcttctttttgtaacaaatatttattaactcatctttttattttaaaatgaagttcacagaagatattaccttatataattatagccatataatgttaaaaagcagtgtcatgctgaaatgtaatataaagagaaactgaagatacataataaaatagttttctatgccactgtatggacatttaggcactgctgctttcactcggatcactgagtggtgtgggcctgtcagtgcaggcagatgtggggtaggtactgagctggtgacctgaaaaccataagcaatagagctgagtggcattactttctgaaatggtcaaacctgaaggaagcagtgttcagtcttccctgtctctaggtagtctctgtatttctggaacattgagtgtatgttaaaagtatagaaaaatgcattgtgtcaatccaaaactcagctgggctgggcttagagaattatgagcagcctttccacctgcatggaagtccttttgtgcaggacagttctttgtttccggggtggccctgctccctccaggaggtttaggagtgcccatgtcaccatgatgcctacgccacttctcatgttgctacctgttgctaccaccgggcatcgctgccgcctcctgctctgtgcacagtgtggtgtggccgcctgaccgactggtcaggaactaaagttctctcgaagccttgactgaaaggagaagtgaggaggggcatggagcccagtgccaagaggcagctgcgtctttaggggctggcacttttcagaggggctcttggggccagaaggaaagagccgtcattcaaggcttacacagcgtggaggtgccctccctggggtgtcctgtgtgctgacctctgtcctggtgcctggcggtgtcctggcgcagagctccgcaagcctctgcggggctcttctctgtgtggaggttctcgagatgggcagtccgggtggatggtcaggccaatgagggccttcgaatgaagcacattattgtaaggatgctaattctggatcctcagatattgtgacaaaaacttgacatttttcttccttcaaagtaatttattgactaaaataaccaactgagcaaaggtgatgttttagtatctaaatattccaaaagattactgaaattttaaagtaaaaatttggccaagaacgagaagtctctgaatgtgcttttctggcatgacccctgtcaccaggaagctgtcagtgtggtgttgggcctgattgattcgcatcagctcaggtggcgtcctattggaaggtcggcagtgggagagcagctggccaggtcagaggattcatttctgtctgaagctttgtgaggaactaagatggcttttccagtagcctctgtcattccagagagttttaagattgcttttatttgttcttctaccctggaactaggaagccagacccaagaaatgtatccacaccaggttttgcccatagtttttaaaaatgttgaatttctttaacttgaggccctcacaattttctgggcccccataagttatagaacagggaccaggcctgctaccttgtgggggctgggtgggcactggctccccagggcacagatccttcctgtgggtgggcttaggggatgtgagggattcactttcagatgtgacactccagatgtggggttggtggcacattttttttgtccggttacatccaagtaaaaaggaggacaaattcttactgaacctatgcagtaaactccattgtcaggaagagtaaagtgtcttagcatgagtgttcctgaattctgaaagttcaggagagtaagatgttacctagagagtgttttatttcagctttgaaagcagagtctactggatttagggctagagatagacgaagaagaaagagaaggggcttctttgagcgcacattagaaaatacaccataaaagaaaataccgacaatcttccaaagccacagtcagcgtttccctgccagctcctccagtcttccttccttcctgtctgctgggtggcggctcatctgtcaagttttcacagtcatgtgcttctgggcgcaaagccctggtgagcccggctcgtttccctggtggaatcggacagttgtcgaaggggtgtcagcctctgttcagaagcctgagcccctgattctgttccttgaagtgtcaggagttaaggtgcctgtattgagcaggggctgccgttgcttctgactgagggtcctcttcaggcccactggctcttggcagagctcagttccttgtgaccataggcctgtggcgcttggctcctggagactgcccatagcccctgccctgtggccctcttcccagcatggcagtttgcctctcaaggcgtataggcagggtctcccctcttcctttcctctctgacttctctcatccttcaggggtttacctgatcaggccaggcccacccaggaaaatctcccttttgatgaactcagtcagctgatgagatgccttaattgcatctgtaaaatcccttcacctttgccttatgtaacactatatcccatcatgttcacagttcctcccgcctgcaaggcaggggagtgtacaaggtgtgtaccccaggggcaggatgctaacactgcactgactgagaaaagaatttgtcttacctgtacctgacaggtgtgtacctgaaagaggtgtgtgcccgacggtgtgtgcgaccgatgggtgtatgctcgacagtggtgtgtgcgcccaccgggtgtgtgcccgacggtgtgtgcgcccgatgggtgtgtgtgcccgacagtggtgtgtgcgcccgatgggtgtgtgtgcccgacagtggtgtgtgcgcccgccgggtgtgcgcccgacgggggtgtgtgcccgacagtggtgtgtgcgcccgacgggggtgtgtgcccgacagtggtgtgtgcgcccgacgggggtgtgtgcccgacagtggtgtgtgcgcccgacgggggtgtgtgcccgactggtgtgtgcgcccgacgggtgtgtgtgcccgacagtggtgtgtgcgcccgatgggtgtgtgtgcccgacagtggtgtgtgcgcccgacgggtgtgtgcgcctgacaggagtgtgtctgacatgggtgtgtgagcgcccggcaggggtacgtacactcggggtgtgtgtgcctgacgtgtgtgtgtgtctgacatgggtgtgtgcacctggcagaggtgtgtgcgcccagcagaggcatatgcctgacagaggcgtggcttagtgttcagggtccatagtacatgaagaatcctacagatccctatggacaaggcagtacagtagaatttggggcaaaagacttgcacagatttttttttttttttttttacacaagatgaaattgaaatggccaatgagcacaccctcattcatccagcgagcattgaggaccccctagaggccaggcccatgagtgatgaagatcccgaggatgaagacgccttgccagccaggtcagtgggtgatggcatttgtggtcaggggcacccagcaccacacccctggctgccgttgacagctgggtgagtcccctgctgcctgggcagagccacctctgcagatgcccaggtgggtctcctggggcagggactggcaggctgtagcctgtgagcagattctgggacctgaaagctaaggatggtttttacatttttaaggagttataaaacaaacagaaaaggaagaatctgcaacagagaccataagtggtctgcaaagccaaaggtttatagaaatgggcagacctgctctaaggggcctgcttgctgatggggccttgtctggattgccagttctactaattctggaattggaagttctcatggaggactgtgtgctgggtaggatttccagatcccaagatgctttggctgcattcaaacccacagggcagagagagccctccgccctgttccttggcagaggcctccacactccgtgtgctgaccggcctgccagaatgacaacaactgtcagctgtctgcatcctcctggcaccccttagtgtggctgcatactgaggggagttaaaaccataaacaggtggagaatatctccttccagggaatctcagaggactcagtgatttaagaggaaaagaccaaactgctgctttcagcaggaccactgtgtgctgcctgcctgtcagtgcatacagatacggggtcctgagttggtgacctcaaaaccgtgagcggtagatagacagagtagcccctaatgaagcagaaagactagaagagacaggacctaatttaggtcgaaaagcaaagtgaggcctcagaagatgaaggcagagtgcgagaaaggctttctggaactgacaagtctgccatccacatttcgaaatgtattagaaaaattggaaaaaaaacatacgaagtgtagaatgtcagcagaaaggtgtggccacagtcaagagggccctctgtgggtcctgtggtcctggactgcaggtgggcccagtggagactgtgctgcccctcaccctccccggtgggtcctctgtgatgggggtgggtgaagctgagtgctgtcctgaaaatctgaccatgcacagcccctttccaaagacccttctaattttagaggccgccagcagccacgggactaggcagcatcagagcagggacacaatgtgagtcatatgcgcctgtgttcatcctgtggtgtccctgggcccatgggggtgggagggatcagagggatcggagggaggggagtaaaaccaggggaaggagtggaggaccacgaactccctccccttcttggtggccagctgctgtgaggactcgctctcttaggacaggtccactgtctctgagctctggttctggcctcctgtcaggtgccctcgtgcgggaatgagtgagggacagcagggcaggctttccaggcttccagcaagctctacatgatgggtggggagaccctgctcttaaaaacatgtggacccttagcattcttcttcctcagacctggggcctcagcctaagctgagatgacagggaagaactacagatacaccagatttagggaaaataacgtcaagtggtgcagacaagtggaactgctgcttgtgaagtgggctgtggagtcgtgatgtttgctacgcccggcaccatgtttcagaacctgtagcagcgctcaagagagaatcattcctttaacaacaaacatgtactgagcccctgtggggaggcactgaccgaggcctggggacaaatgtggggacagaccagtcctgtggggacagctggcgggggtagaaaacagtagagctgccccaccagccagcggctgctgggagagcaggggtgttcccgcacccagaggaggcaccctgccgctctcccccaggttgcttggtgtgtgcgctgcagggagaatcccgcccccagctggtgtccacaggggccagggacactggtaggtaggtgtggaacaagggagtttgtgacttgggattgttttctacttaaaaaataatctgagtaaagcttggtttaaacagcatcaagttaaaaaaattcctaagaagtggttggattcccagtttatatgtggctttaaggttctgaagaagtacacaattaaccacagaagtatgacttgaatagataagaatttaacaaaatacacactgttgggtgtaaaatcataaatatctgaagttcttagaaattggtaattttcttttagctttgctgtgctctgagcatgactaaactaaaagtaatgaatccagaccttgaagactggtgtgtgtgtaaaaggcaagaagtgagaagattcacgtgtagatccaggacaatctgaatttacttctgttcagtagttcccaaaggctttttctacatggagggactcggagtgacacagcagctccctcttgtgggcagattcccctgtgtaaggtgctggaggctgaggttccagcctgcagccgcttgtgatcctgatatgtggagagttctggaagactgatgactgctgacccccttcttaacctacgccatcgccatgctggtggtggggatggggctcttggccattcctgccccttggctgcccttccttggtctgagggtacgtgggtggcccttcgggtgtgccaggagctttgtgctttagtgaccaacagtcccctgatgtgtgaaggcccatcaatccgatttaaaataaaacatttgaagtctcttcagaggacggtgtgaggatgtctgcgttcagtgatggagcttggcctctgccttgcccctgattgaggctctgagggttcagatacagtctctgcccactgcatgtgaacagcctggtgggtgtggaggggaggaagcctgtgatgatggtggcactgtgaggaaagtggggatggaaggaggtgtgcccaggaggcagggcaggagagttcatggatgtagggttgcagcaagtctggaaagctgggtttgttttccagggagatggcatgggaggtgggcaccccaggcaggaggggctctggatatgactccagaagcctggtgggctggaggggagggagaggctgggcctgctgggggcaggaaaagggcagacctgtgcttaatttcaatttctatgggagtgatgccctcaaacttagaagggcttttgatgagaagcgatagagtatagctcttgccctcctcagtggcatcactgattttttaaaatgcattttagatatttgtatttctatattaattagtattaggattggctataagtgacagagatgcaacataataggagcttaaccaagagaaagggctgcatcctgcacttgctattgtttgatttatgaactttagacattaactgtgcactgttagttcacatggaggaggatttagctccgtgacgtttctccaaccttcttttcctgtatcatttaggattgattctgggtgaaggtcacagcatgactcacagtatcttacacaccttggatgtatatacgcacttcttatgtcgtaagtaatccagagggaggagtttgctagagctagtccagagttcagccatcttagggctctgggtgagtatcgctgcagtacagcagcagcagctttagacaccacttctgtgtttaaggcaggaacaactgagaaggagcaggccgtggagctcttgtctattccttttgtcagagacattgtggaagccctcagcatattttcacctgtctttcaccagaactgtgtctttctccttggcaagaagtgtgttttgtggccagctttagtcacaaaagagacagaaaatgagcctttcatttttgtggcacccttggtagaggggtaggggaaagggcttcaggacgagcactggatcagcttaccaagcctgaaaccacgccccctgctggtcatcctagagactgagtggcccatgtgctcgtggcctgtgggccctgggcggcctctcagtttcctgcatggaaggcagcagaagcacttatccggccctcagctcctcggtggtgtcagtttgtctgacctctgtcagtttgttgtcttcttttttttttttttttaagacagagtctcgctctgttgcctaggctggagtgcagtggcacaatcttggctcactgcaagctccgcctctcgggttcaagcgattcacctgccacagcctcctgagtagctgagactacaggcgcatgccaccatgcctggctaatttttgtagtttttgtagagacggggttttgctgtgttgcccaggctggtcttgaactcctgggctcaggtgatccacccatctcagcctcccactgtgctgggattacaggcgtgagtcactgctcccagccttgtttgtcttctgtgttaccaaagtagaaaacttcttctgttctgtaaccttggttcaatcaaagttccaaattcataaatggcacttatattattatgacgattgctgaaagtcatgccacagtttaatttgctttatacttggatttggtatacttgattttttggttctgttttctctttttcctgatttccttgatttttttggttccgttttctctttctcctggtttccttgattttttggctccgttttctctttttcccatattcttgcctggcatggagtggtagagcagagtggggaatggagttgagtttggatccagcggtcgagcaagtgtctcaactcccatgctcagcttcctcctctgtcacgtggggcagggaaggtgcctgtcgggcgcagcgagcgtggtgagtggtagtgtggggccgcgtgcgcccgtgggccctgagcatcagcacttctgcctctccgtgttctcttgttgagagggaccactgcctttcttatgctatcgccagccttttccagcttattcattctgtttcttggaacccatttaattcattcttcttgaaatatgtgtattttctattttatttcaaattgagacttacctttcttatagaatttgttttcttctgggatctcttgatttttttaaaattggatttactgaggtaaaatgtacagacaataaaactcttttttttttttttttttttttttttttgacacagagtttcgctcttgtcacccaggctggagtgcaatggcatgatctctactcactgcaacctctgccttccaggctcaagcgattctcctgcctcagcctccctagtagctgggattacaggcgcccgccaccatgcccggctaattttgtatttttagtagagatggggtgttgccatgttggccaggctagtctcaaactcctgacctcgggtgatccacccacctcaacccagccaaaaatcattcttctaaagtgtgcactctaatatattctgacaaatgtatgccagtgccacaccaccaagcagctgaggtagagaatattcttaccccaaaaagtttcctcttaccccgtgcagatgtcctacccatcagggcccagggcgaccttgtctgatgttgatgtcccatcagatggtttgtattcagcagagcacctagaccaggctgtgaggtacaggtccgcccctggcagcccatgccttgtagcttctgggtggctcctggcttggttgctgtggtgtggagcgttgagtgacctctgcagaacagcagatggtgctgtagggccgcttctaagactcagtggaggaggctcagtggcgttctgagcggtggccaccaggacaaacctcttgtctttacaccatctgtgtgtgtgtgcgtgagtgtatgtgtgtgtgcattccagtgtgcgtccagaagccagtttccttcagaaagctttctgttccctggcttcatttttaccatttagaggacctgtgaagcaatgagatggaatacttatagctggtttaattcagtgagtgatctgaattgtaaataaaattttatcaagtaatttataaatttgatataataaattaagtctgcggaaggggctgattgtgttatggaatgagaagttttgtacatcttttgcaattctaaaaattgtggccaggtgtggtgctcaagcctataatcctagaactttgggaggctgagacaggaggattgcttaagcccaggagtttgagaccagtctgggtaacatggtgaacccctgtctgtacaaaaaataaaagtaaaaataaattagccaggcatggtggcacatgcctgtagtcccagctactcgagaggctgaggtgggagaattgcttgatcccaggagacgggtggcaatgagccaagattgtgccaatgcactccagcctgggcgacagagcgagaccctgtctcaaaaaaaaaagttgtgactttgctgtgtagtctttgtgtaacataattttatgattctattgttttaagcttaatattccaaataggtaataattatgttaaaatgcaaaaaattagcctatactctcatgatctaaatatgtagtagtggttttacagaatatatttcaaaggattgccattctgttttatttttagtagccagttatagaaagcattatttttaaataatgcctaagaatctttaaagaaatacctgtcaatgtatgttccagtttagtatcaaatttatattcagagctcataagaatttaaaaagtttcccagagtctgtaaatggggatggagctgtccttcaagggtgatagtccccctaggtttgagttgtcctctgctgctagcatagtaccacctgagctacctgtgggccaccttcaccacccgtgggtccctccagccaccccagggacaccttagcctccctgggtcgccttagccacccctgggccatgttagccaccacaggatcaccttagcatccctgggtcaccttagccaccccagggtcaccttagcatccctgggtcgccttagccacgcctgggccatgttaactaccacaggatcaccttagcatccctgggtcgccttagccaccccagggtctccttagccatcccagggccaccttagccacctgtgggttacctcagccaccagtgagtcaccttagctaccccaggatcaccttagccatttgtgggtcaccttacccaccctttcaccttagtcactcatggtcagcttagctgtttgtgggtcacttagccacccctgggccactgtagccacctctgggtgtccttagccacccccgggccaccttggccactctgggtcaccttgtctacccctgggttacctgagccacccttggtcactgtctgtgggtgcttgcttgctttaagccacattatgctactgcagctaattaaggtcgctcaattcaagtgtctcctttttttgggctcctgccttctttttgtttttcaaatcgaacacccgctatactcatttgagaagtgtagactttgatttttaaccctaagttgcatggtaaagtcacctttaaagccaatggaaaaagcttaattgaattcatttgtttgaagaagtagaggaatgttgcaagtagactgaaagttatacttagtctgttctgtttgaaaccattctcattcagaaaacagaaatgtgtttatgtaaagaaatatgttacttgacttaatattgtaaggaatcttaattgagaaaataagtagttgtgttttttctttaactgggcagcattgtagcggggtggagtgtgggtccccaggttggagagctctggatttggagtggatcctagcacatggccaccatgtgaccttgggcagtgactcagcccagctggctgccaggctgctccccatgaggtggtgggagccgtgtgggatctgcctactgggtgtgcagctgctgcggcctaagcggcgtccttgcttggtccccccatgaactcaggggtgtggcctggctccgtcatgtgttttgcagggggatctgaggggcccagaaggtaagaaattgcctacggcccttggctaatagaagagggagcagggctttgaccagggggaccagctagtgactctgtgctggttactactttaccaacaccatggccatgctgcacagctgtgcagcctccacccacaaaggccaaagctccaatggcatctgcgatgcttgtaaaacaagtagcagccgtgtccagcctgctgctctgaaacctcagtctcctttactgagatttgatgatgtttaaatgagcaaatgcatgtgtagtgattggcaggtggccatcgctcagccgacttttcctgtgccctctgcttcggcaggtgcccttcctggctccctgcttcttcctctcctaacctcctggcactgtgctcctcactcaggaattgcacccagcatcacctctgcaggtgagtcccacaccttccccctgctctccaaactcagaccccaagtccagcagcatcttctctcaggcatctatagacctccacaacttaagacatccaaattctcattcccttgccttgccataatcttcccatctcagcagctccttccttccaggctctcaggctgaaggtggcctatcctttcttttctatcccacatggcagccaggaggcctgtgggcggtgccttcaggacatgcctcttgtgcccctgtcccctactctggcctgagtgttccttttaaaactaggtcagaactagattaaagcccgtgtccaagatgctgccacagtctcttgccaccatatgactgccatgtcctcactgtggcccaggaggtcccatgtgcagagccgctggacctccgtctcctctcactctctgttaactgtgctgctgtcagactggctgcctggctgttcctgggcggtttcaggtgctgcggctacctagaaccttccatcttcctttcttcactcttcccagaagagaacactcttcccagctgtcttacggccagcttcctcaccacctcgctgcagtcttttccgcaatggcatcgccactactgccctcccacatccagccatcatcctagaataacagccactgttgtcccctgacacttgacggcagttcatcttttatgacccccattgtccccattgtcagttgtctttttttttccttattagaacataagctccaggaaagcagatgttaacgtctttgttcactgatgtatctcaggcatttaggacagtactggtacatagtagatgctcagtaaatagttagatgaatgaatatttgctacttttcttattgacagacatttctgaggtactttaatattacgttaagtaatgttacaatttcccatgtgttgattttatgtaaataatgagtaaattactctcatagagattttagaattctaataaactcatatttccccttcttaaaagagtagaaaaatgcttttaagagttttcctaaattaatattctgggaacattaaattttagaactttactctgagggcatagataaaaataaaattaattagataccaggaatgtcagatgctaaatggtgtatggctatttgtgacattctcctagaattaaacagttattaacttgcaaagacatggcagctgaagtcagaaattgatgaacttttaaagttgggaaaaaaagagctttaaggtatcttattaaaattgtaaactgtcagtttaatcatcatagaaaccatacctgatacagtaaatcgttgctattctgctttgaatttctggattctcatgaatcagacattctatttttatgtttctcttcaataatcctaaaggtggaagaaagaaatgggaagaaaaaggaagagaaccatagctacgttgtgagggcattgcttcaactctggtaacttcatgtgaaatgactacaaaatgaattaatatgcagtaagagagccagtgccccaccagggcacctttccacttgctggcacacagatttaccacaattaggatactgcttgtcctgtcatgccgggagagtctaaattactctgactttcaagaaaccaaaaatatgcatttttgatgttaggaagatttactgtgcattgggctgtgtcatttgatgaggaaaaaaccaaatgatctctttatgaaaatgaaggtaaaatatatgtaaatgccattttaatctaactttttatatgaatgtagaacaaatatcaaacaggattatacagtgtgatagtcaggaaagtagcatgcttttgtgttttatagactagtctaaaaggagccccagtagacttggtattgttaaaccaaggagatcttgagaactgttctgtctcccttgtgcccatagaattgtagcctgtggaggtgaccaaggaaccagatcccaagaggcctctgccactgaaaggagatttttattacttgcgtttcctagacgggggggcactcgcgccaagcaggcccacggggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggcccacaaatgccaaagcattaggaataagaaaatggacgtaatagaattgatcctgtgaggactggatgcctaactgccacatacagaatgtgagaaagcacagaacaactgccttcattgacaagatggtgcccagagctcaagacaggcacacagcaggaggatgccggcaggatccctcaacaagcttaccgtggtatctttcacaatgttaactgtcatcccagatgaacttttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggactacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatggcttgctatacaagttttggtcttttaaggtaagagttacaatggagatggggaaattatacttttctcatttcaaggaaagcaacagtcatgagttatgcatcagttgggaaacgggatgataggaagttgcaaggcaacctggtttcagccggaccgggactctcccggggctgcgtcctgctagagctggcaggacacagaataccactagcagcctccctgggagtggcttggcgtcttggccacctctttccacggatgtggtggatgtgggggtaaactagagagactaaagcccactattgggctcagcttcctgtagaaatcaaatcagatgaaaaccctgacccagagggagaaggcagagagttggacttttgaaaacgtgagtgtgtccagcaaccaggcagcaacagtccttgtttttatcgaacttctataagcactttatttctccagaataatttcatcataaagaatccagagctcagacagctctttaccatctgtcttttccttttttcttaccctgtgtttggcttgatctggactgcacttaaccatgacaatgttaagtgctttcttctgggtaaaaattctggcttcttctccagaaattctggctccacttctcaaattgtttctgtccctgttaggagacccctggggcctcggctggagagacagtgcagctagtcccagcagccactgtgcttgggcctggccagcccctcctcaggggtcacggcactgctcacctggtgactaggtcttctcagccagatcagttcatgtgctctggtgtttttgagcttctggctagtcctcagtttctcagacctggttaatcacagtgtggagtcatttttcataactgtgcacctcacttgtttgatgcatggcaagggaataattaaattaataaacctacagatattcccccttacagttttcaaatacagtaagtgaatttctactataaaataggtccaaagaggttttattgtttcttatttgaaataattaaagaacatttatgtttcccttttgtggtttcttggttctaatcctgtgggttgcttttgacgtcctctgttggggatacactgtgcatccgtatttaacaggagatcccgaactcccagcagggagctaagcacagatgtgtgcacagatgcgtgcttaggtaaggattttgtgcaaggtgacttgtaatatgaaactgtaaaacgtgctaccttagactggagagagaagggggtggtctgatgttttccacacgcctcttttaccaaaatgggtcatcttatctgtctcaggccaggcccccgggggtgcacaggaacagcacagctgcagtgaaggaggggctcctgcagccgggctggccccagagctgtgggtcgtgccctgcgtgttgctcagcgcgttctgcagttgccctggccttagtcccccatctcgctgtgatagccatgcaggtcagcaactgtgagccttcctggctcccacgctgcccccggcacctctctctgtttctgctcccagcatcctctcagcttctcttctgagccccacgcagcggttcctgctttaccagcaccacttctcctctgtcaccgagagagagcaagaggctgccgcgcctgtgccaactgcctggtgaggctccgtcgagtgatgtgcagggccttgcggtacagccctctcgaactcaccccaccagaggcctgtcggcatcactgtcagaaacaggcgttctcccctcccagcccccgtcacaagctaagcatctgtgagaacggaggctctgcttccccgaggatcctgccccagacgtgggggcagcctttgcagacagcttctgtcccactcacctcctccttggttttcactcctttatgccctcacggacctgcccaccagttcccaagccctcagggccatggcagcctccgtgagggtgtgagctgggtaaaaggaattaaggtggagtcacagctaccagtggctgattgcccgtgggtgtcaggctggccctaggtgccccattgctagttcactgtcctgggacggccccagtattgtcagcattgaaggaaagaatccggacaggcagcagaggctcccacctgatgacactgaggctcctgccttagcaccagggcctgggctcccctttgctgtaatgtcgtaaagtatgtcaggaaggtttgcccatgacctggtggagagagaagagatgtgacaaggcgactctggcttgtgtatcccgcccacaggggaagcttggaggagtcggtttgtgaaaaatcagggctctgagggcactggagctggtgctgagttctgcagcagtcaagaagtagagcagagctgaaatcctggctgctcatgggcatcacagatgcattcgccagcagctgggctcggctttgctctaacatccgcccctcctctgggagcgttgtttctctactcctggctgcccagcccagctccctggcctggcgagatctctgcatcatttcttctccccagcttctctctccacccatgccgccatgggagagtttaggctgtctcgtccctgactggcctgaggtagggctgtgactgtctccttttccctctctcctgtcttcctcacctatgcccacataatcagtccaccttccttactgctggatgcaaacctgctgagtctctatggctttcaggatggagttcaaagacatcacctcagcgtgaaaggccctttcaggtctggcccggcacaaccctgacacccgcatgttcctgggtgcaacaacatggggccccagggcagcttcccatgatgcatcagcctctgctggctcctgatgtggcctctgttcctgtcttaggcccctattcctctcggcaggctccacacttgccttactctatctcagaagctcatcctgacaccagctctgtcctctgtactgggaacatggagcagaaatccatcacggctgctgatccatgcatgctgatgagttgctggctgcctccttgtgcacagcatctgggggcactcaggtggccctgctgtctctgggcctgtccctgacactggcaggggttggggcaccagagttcaaatgggggccgcatatcttgtctaaatcttccagagttttaagtcaagccagtgcactattgatacaatatgttgtgtcttcttctttgacaactacatcttcaaaatggaaaaaatatgtggggacctatggtttttatatgaattaatgttggcaaaatatcaaagaccactgaatttaactgttaatttaactgttatctaggtgttctgttcagaggccactcatgtttgaatgagtaacaggatcaagacatgatttatcaataagtgcatatatctcccataacattgattattttgtttttatttctgcaaatgactaatcatgttttatattaagcattttcggataatgcttgttctgttggtgctcacggcctaatgcggggctagcgcacagcggcctacatcctgttttttgtgcagtgtttacagtttttaaagagttgttaaaaaataaaatagtgcaacagagacatggccacgaagtctaaagtacttactctttgcccctttacagaaaatgtttgctaccacttgatctaaaggattaaaaaataaaacatgtcattgggccagatgcggtggctcacgcctgtagtcccagcattttgggaggccaaggagggcggttcacctgaggtcgggagttcgagaccagcctgaccaacatggtgaaaccccgtctctactaaaaatacaaaagaaattagccagacgtggtggcgcacgctacttgggaggccaaggcaggagaatcgcttgaatccaggaggtggaggttgcagtgagctgagatcctgccgctgcattccagcctgggcaacagagcaaaactctgtctcagacaaacaaacaaacaaaaatgtcattgaatttgaagtatacaaaatttgaatatctttctatcaaaaatttgaattttaaggaaataacaaagcaaaaattataattttttgtgttttcaaaaaattattttttctaaattattaagttataagatataaagtagttaatgtgaaatgtttaaatcaaaattgtttaaagctgagttttaaatttaatactttgaaaatttagttaaatcatattaataattttataagaaataaaactattgataattctgatgtctgacatctgtctgattgctgacatggatcctgagtcttacagtgttttgagggcctccagctacattggggttccagtgccagagtggctggcagccccaccctaacgagaagtgaaggggctgggcatgctgtttccagtgctttcatgagatgctgctttgcctggcggtcgggcctgatgtctcgttgttccacctgtgaccaaggggtccctctggaaatgtgtgtgtactgacacatgccctggtggctcttgtctgatccatgtccaggttattcctgcctgaccgtcactcgtgccaggagcccaacacaaattcaggcacaaattcagtacaccacacaatgggggaaacatgttcaaagatttttacttacaggtcctgagcagggagggtgccatgagtcaggagggccgtcctctgtccctgggtcatgcaagcaggaacaaagggtcaggcagagagagagagcactgcagccaaccagcagaacaaataagggagtagggtggggtcacttgaagtgtgtgggcaggtgcctgagtgaaagatgcctctaggttctcatctctggtactggcttgagccactgggtgtggtgtagaactacaaagtgtcaggggtggctgaactctgccgctactaggagaaagtgcagctcatattccagatagatgctgaggcaatagaaaatgaaaagaattcactatgcttacgcagagtgtgtctggacacacacaaatttaagagtaataagaattgcttaatatggcataatttccttaggtgccatgtgcagttgtcacaagcattgcactaattggaataatgaattagaaagtggatgttggtcattattaggaaaaggtactttgttacacgagacagtaattgcattgtggcaagagaaagaatctgactaattaatttgtcttttttttcttttgcctatgagtgcttcttctgcttgactcctccccataatcggactccttccaagacagcctaatcttcagggcatttggatgcagctgccttttgttccagagacacaggccatctcaggggaggtatctccctggggcctgaacagcgtttttctagacaagaggaggctgagggctgtgggttctgctttgccagccctgaatgctggatcccgagtggcagaggcaccaagtgctgtatgatgtgtgtatgtgatgtgtgtgcatgtacatgtgtgtgatgtgtgtccctgctcgccccaggctggccatggtactgtgctagtcacagactggctgtgctgatcaagccaggcacagtggaaaatgggaagatgttggcgtttgcccctcccttggctgtgtgtcattcacctggggcatgagctgtgcccctgctctgcagtaatgaacaaggcagctcagcattggtccgagacacgtgagttaagagaggaggaagagcactctctgggggcggggggatccatttgtcagtggcctgcagtttcctgtcccagggatttcactggtgacatcctgaccactcacctgcactttatatggagctgttttcatcagctggcgtctgctgagcctctgcattgtgttgtgtggtagcctgttactttttgcagttttattttctaaactgtactcttttattgatagattttttgtattaggatttccatttaaacaggactttggtacgtctgctgtgggagatttgtttccctagaagattcacggctgtcgttctctcccctctgctcgtggtgttttactgtgactgcgctgaacggttagctgtcacatgtcattctctgggtggtgtgctctgaagtcattgtggtgtgtgggccccttcagcctagttctgcctaactgcggcatgatgaatgggcccgaggcagaggaggaggctccctcgtcggtaggggctgctgttgtcgcagctgccggcacacggaagtgagtcggtgtgctgctgccccgagtgactgagggacagaatgaggctggggccggccggactggcattggcgtgtctgcatggcgtcgtccaccactgggcctttgcacatggggacctttttcagcatcatggggcgtcggtataaaaggaggcgcaagaagcgctctgagaggaaaggtaattcatttagtttttattcttcagtgtgaagcatttgtctttaatgcaatacagaagtgttttctgggatagacggctttgtgaattaatcttgctgatgccagttacttcctattttccctttttgagtgccttttttgttgttggcattttatagaattttagataggggcacttaaaaaggaagattcaaaaacatgtctgtaaacatgaatagaaatcatttagcttcagagtctggagtatgtctttggaaagatatttataaaactttaaagtttgtagctttgagctacagaaaaggtttttctcccagagacagatgcttatatgagatttcctttgccgcactcttcattaatgacttttctacattaaaactgttcttcatgctgcagaaagcaaggctgagcaaccattgtgaaaatatttcccctttaaaagaatggagagcaaattccttacattctgcactccaggttaataccagtttttaattcaacttaatgttttaagtcattaaaatctagattttttttctcaaaaccagattcaaaagttgtccatgactatacacatcacaagctactggtttttggacctaaattgctgctttaaaagctgttgatgttttttttttctctttgtataatatgaaataattaatagaaaatgccttagtgaaaagatgtgtctagcccggagaacagctgaacacaggcgtgatcagtgcctctgcctctgtgtcttctgggcgcccccttagtgtcccccacccgacaggactggagtacagcgcttcaccaccacagggcccttgggacatgctgtggcaggagatggctgtttcttcaggaagtaaaattaacctcggttttttggtgtggcttcctaagaagaagaacagatgaatctcaaagtcagcaatcttgtaatagtaccttgtaatataacaaaggtgacagcacctaatggaagtctgtgtctgggagtggggaacccctgaccctgggccctctgtgcaccgtgctgccaggtgcttgtgtccagggctggggatgccacaccctcgatgctttcctggactgacgggcggtctcaggacagccaatctgtgcggccccctctgccctcacctcaagaggtcacagcattggcctgtttttgtttcctcagttaagctttggaaattgagatgtcactaagacaggcaatagggagtaaaacaaaggcacaggcaaaaactaaaggacatttttaccaaataccctcaatttagaattaccaccacttttcccatggacactcatcactaattatttaagttgggaaaaatattgagaagtacaagaataattctgtcatcattcttttggaatttactgtgattcaagcttaaaatgtctttttcatgcattccataatctcattctgcagtgggaaaaccactctcaaatatgttgcattttcagaccaaggttataagaaattgagagggttataagatgtaacaatgaggcccacatattaaatggcttgtgttccttggtcattcctatgtgagtaagttcattgtgagtgttactaaacagtatcatgttatgtgttagttctcgctgttggtattttgtaataagcattatctttgaaactaataaaaatacctttgaaattatcgatattattaagattggccatcacatttataccaaactggcaaagttttataagatgtaaaatagtcttttatactgtatatttctaaggtactgtaaatcatgtgtattgcatggttttttccctaagactgatacaatgtacgccttttaaaatgtaattctttgatgaaaacaatgtagtagcaagttacgggttttagttggcttcagtggcaatataatttcagtgatttttttcatcactcctgaattatacttgcagttactcccttccacagggcaaataattgactgttgactgtgtgtgagcctcagatgggttagcttaatcatcaggaaaatagggctaaagaataatgtaccatttaaatactggccagagtccccatcaagcagacactgccaccctggcagatgctgccagcacgagacctgggagaggtctgggagccacagggcaggattctgagtagcagttagtgcccatatatggagcgcttcctgcacccagccagtgctcagtggctgctgctgtagcctcattcactcacagcactgctgctaagttcatgaccagtgggaggggagagagatgggaacaaagaggcagtccttcagtccccaccctcctgctgtctgaatagcatcctgtatttccagatgtatttctcactgagtgttttgtttgtcccctatgtgataacatccttatctgtgcttagtcgtgtatgcacatgtgaagaccactgtcctctggcagcagttctgaactgtgttttagtctgaggctgggctcccccatgtttccaggatagaggtgaacagggtgtggggacctctgtggagctggaggtccaaacgtagagaggcctgctccccctgagtacttctggaggagaagccctggaactcctgaccttcacccttcacagagtgagcagagccagttggccaaggggaggaagcaggcggctgtcgtaccagcctccttctctggtgccagccatgactctcaccttacaaagagagcaaccctttgtgagatgcagagcatggtagcacctggaggtataggacgggatggcatttatccacccatccatataccagtccatctactcattgtagtccatccatctgtccgtcaacctatcatccatctgttcactcatttacccatctacccacccatccatcatccatccactcacccatccatccacccatctacccatgcatccatcatccatctctccatgcatccatcatccatctctccatctagtcatccatctatctgcgcatctacccatcacccatctattcatccatccacccacccacccacccatcatcacctatcatccatcatccattcatccatccatccacccacccacccacccatcatcacccattacccattatccatcatccatccatccatccacccacccacccatcatccattcatccaaccattcatccacccacccaccctcatcacccattacccatcatccatcatccacccacccacccatcatcccccatcatccatcatccagccatccacccacccacccaccatcacccattacccatcatccatcatccactcacccacccaccatcacccatcatccacccacccaaccacccaccatcacccatcatccattcatccatccatctacccacccacccatcatccattcatccatccatccatccacccatcatcacctatcatccatcatccattcatccatccatccatccacctacccatcatcacccatcatctgtcatccatccatccatccacccacccacccatcatcacccatcacccatcatctatccagccatccatccacccacccatcatcacccatcacccatcatccatccatccatccacccacccatcatcacccatcacccatcatccatctatccatccacccacccatcatcacccatcacccatcatccatccatccatccatccacccacccatcatcacccatcatccatcatccattcgtccatccatccacccacccatcatcacccatcatccatcatccattcatccatccacccacgcacccacccacccacccatcatcacccatcacccatcatccattcatccatccatccacccatgcacccactcatcatcatccatcatctgtcttccatccatccacccacccactcacccatcacccatcagccatcatctgtcatccattcatccatccacccccccacgcacccacttctctacattgttccgttcatccaacaagtactcattacacccttctctgcatgctggcaccaggggtttgaacatgcttagggaagatgggggtaatgggatggcagtggcagggggcagccacagctttcaggcttgaggtttgttctggaatgggccacctgaaatcccactaggtgcatgaagaggatggatttatgtgatttgtcactgctgcactgtatgtgtagtagtggggagggatattctccagtatctggtgagaaaggaagacaccattctctagcagtgtctgccaggagaggggcccaagtaaggaaagttgaacccccagtggacagcagcgttatggatagaaggcccagatctcctagaacccgttgtaatggctatgtgtgtacctttcactgcatctgtgctgatgggcctcgcagcacaagaaagactctgctgcctgggcaggagctcctctcagctacagggtgcatttcaagcacaggtgcatacactctaggttaacagttgaaattctaaagtaagcatgtagaagtagatttgtgaaattgcacttgaaataccatggaaattggatccaaagcagattgaacagtgccaattcttagtgcagttataagtgttaatattgaaaataaagtttacatcgttgtcttttttttccctttgattccagaaaattaactacaattttcaaataagcaggaacttacttaggttgtgttaagtagagcaaagtggacagtctttcaaatgcattgctgctgcgtttgcactgtgaaggacggagcaacttcacgaaggcagggccctgtgaaggtttgtgctctcgtgtgccggctctgacctgtgattttgttgctggatgtctccttcagcagttcatgtggctttctaaagcttgccattgcttaggcatgcctgactgaggcgggaaacaagcgtgtggatcagtgtggctctgtatgtgtgaacatgtatggacatatgtgcatagggtgggggtaacgagggagagggacaagaagggccagggcttgtgaccacatcagaagcaagggtgatgctctgtggcacagctggccctcgaagtcactcagggacctaggtttcttccatccttaagctctgttctctaacagaagtcaccctggcagttgcttctagtccagcaatagaaaggtgagaaagaatacagagaagcacgcaggaagctgtgtgagttggcccagatgcagtggcacacaccacaaattgcacagcacccccacaggaggcgagcctgtgtccttgcccatcacctctttccagctggtgtccagacctcggggtgatcactgattgttgtttcgttggtctggctgtggctcttcttgggccagcagcctgggagccacacagggacagggtaactgcgataaaatacaattatgcaggagaggaggcggaagggcccagcctggccctgtctggccagcttcctgcaccctgcacagcagggagcatcctcattctccagaccctgattcttctcgggttggggcgggaggggggaactcccttgtccattgttctctcagccactggcctcatcctttgggggttctttctgatcatcgcctccagagtcccatctgaagagggtatcagtgtagaacacagtgaggcagaatgtggaagcaaacgggaccatctggaagttttgctctaggccttataaaacacataatttgttaggtgtaaaatatatagtatgttgtagtagtgataataggatggaataaatgccttagatttgcaaaattgggtcagagagtttagggatctttggtcctgtaccagtgacatcattttgtggctcttggggatttggggagggacctccccgaggccactgtgcagcagcctcatgcccagggctcacaggtcccatatgtgtttcctccaccaaagcaccctgagctgtcctaccttcctcacatccccacaccccgcgggtgtccctctgcttagcagctatttattctgcctgtatttgggccaactgcacaggctgtctgagacctgacagtatgctagaatgtacagggcatacaatattttgtgtaatatcatggaaaagtgtgccgttctttcggttgacggtggttgcagataagactgcagagacagcttgtggtgggttggagtgtgactcagtctcccgtgggtctgctccccttccagactgcatgtggaattctgtatagagtaaggcatattcgtgtatgtgggagggaggcttagaataaaatttattttttttcttatggaagcagtacatgttcattgtaagaattaggaaacatagatacaaaataaactttatgaaaaagcaaaggtgatcatctgcattagtctgttttcacactgctaataaagactgaataatttataaagtaaggtttaattgactcaccgttccacatgactgcagaggcctctcaatcatgacggaagatgaaggaggaacaaagggacgtcttatatggcagccagcaaagagagaaatgagaaccaagcgaaaggggaaactccttttaaaaagtcagatctcatgagacttcttcactaccacgagaacagtatgggggaaactgcacctgtgattcaattatctcccactgggtccctcccacactcgtgggaattatgggagctacaattcaagacgagatttgggtggggacacagccaaactatatcatcatccttgaagctaaatctttgaatgggagcaaaaccataataattttcttccaattcgtagtactagaattagatttagaagtgtttaaggctttatatttttgtcttactatgaccaggggctcagtaatgccttacttctgccttggaggatgatgtgagcatacaagaggggtggccgcatccctccagcttcattcctggtgtccaatgggaggcgaataggcccctttgcacctcttaaccaccatagtcctctcccattgccagcctcttctgacttttgggattgttttaccctctggacagcagtgtgaacaaggtatgtcaggccaagggggctgctccccatgggaggcctggccgtgttggcttccaagaggccagatgggtgctgctcaccatagaaagtgacccttttccctgttcctgagccaacctgtcacttccatgcgctgtgtgtcactttgaaaactatctttgctttctgcaaaatgaaaggaaactttcaaaagtcaacgtattaaagcctgtttgcatttattcttttatgaattttgctcacattttttaattgggtgtttgtctaaagacaattatcgatcatagtaggctgctggaaggttgaccacagaaacctggttctctttcagggaggtcaccatgtctgcctccaggcccatcgggtaggggctgccttctgtcaaggcacatgctccaggtcccttagatggaaggaaaacacatggtctttatccagtggactcagggtgcaggtaactgaaggaattaacctccatcattttcacagatcctcgtagagctggaccgaaggaggtgggagatccctgccgggagccgctgcagtgggagggcttacagacgttcgcatagtctctttctgtttggttgttttaactcccattaaaaggagtggctttcagccttcttgcttactgtcttgtgatgtatgtgtgttcacatgttccatgcacatttgtaacgcttaccatgctctctgattcagctttgttcccttagagttgccccagcactgctttgccatgatgattgtggtttttaaaatacttccagttgcttacttctgtttagttatctcagtgctaaatattgttaattaattaaatataagcagcatgttctagattttatgtgtctggaattcttactaaaaatcttcctggatatgacttccagtcataacgttatggattttattgtaaacaaggtagaattttatttgccttttaatcatttcattatggtgagtgtcctccttacagagcgtgtactgaatttgggttttactccttttttgttcatttccacaagttgaactctgtgttattatcctattttctgttagggtcattgtgttgttaagtaatcgacttacatagaaggtgtgcacctagaaggttaacagaaaacaagttgaaacatgactgaaaatatatttctgtaagaattactgtaattcttctgagagtataaatagccagggttttaaagatctgctttataggatttatactgcaaataacttggcaggattaattggcctgcatttgcttgctgtagtcagtaccatctagtgttttagtcaatatcagtttttgtagtgtggatgaggctggtgatggcagctgcagcctgtctggagttgctgctgccgtggtgtcagctgcagcgggggaggctagggctctgtgctccgcaagttggtgggaaccgggaacaggtggaagccccacccccttccaagttggaggggcaggagccccgccatcctgggcacagctgcagccgtccattagaagctgtggacccaggcatccctgcactcaccggggcccaggaagcccccctgccccgacaggctgagaagtgcctgctcccactgcttggtctctccccactcccagcacctgctccagtttcagatcaaagttgtggccgagctgggacactgtcacaacctggctgggtgtgtgtttgctcagggcagtgctgacatgccagcaccctgctgcctcggcacccccagactttgggtgctgacaagcatgagagggaggccaacgcggggctgagggaagcacagcgcaggccttgcagccgcccctcggcaggaacactctggatgccatgcacactgtggatggcaggataatggtggccggaggcagacaagctcctgggaagaaaggggagggtccctggtgaaactccaccttcagcttacagagggcttaaggcctggggcccaggctgtcagttccacagaccggagtgagaacttacggtgcttttccagggctcacccgtgactgcccatgcaccaatcagcacacactttcctctgaagcccataaaaacccccggactcagccagacttgggcagaagacaggacgacctgcttatggagaatagctgcccactgtgggtctctctgagctgttctgtcactcaatgaagcacctcttcacattgctcaccttccacttgtccacgcacctcattcttcctggacatgggagaagaactcaggacctgctgaatggcaggtctgaaagagctgtaacacaaacagggctgaaacacacccattgtttgccacattgcaggcaatgaggagaggaggagagaaggagagaagagctgcagcccttcaaggagcccagacctaggagctccctgagccagggcagtgatgccccctttggggccctgcggttcctggtgtttccaagcttctgggcactaccgtattccctggtttcagccatggaagctgtgtgtggtatgcctggttcagctgcagccttgcagggagccagtgtccatgccagtgcctaggtctgcccgtctcacctgcctggctgtacacaatggctggaccccacgcccactcactcacacaccccttgccactccacacctggctcccccttggcaggcatgggatccaggctggaagtgtgagccgagcgcagcctgccaggctgtgtgggcagaatgagcccagcaggcccaagcaaaactcgggtaaaggcgccaccagtgatggaggtttctggccagaaaaatgataccctgaggatcctatgacactgggttctgatttaccaaaaagagccacacctgactagggacatggggaagcaggggcatgcaggtctgtccatgaaagccccactccttgctttagggacagtagctgatgcccatgagcgctccttcatgcaggtgctgtgctagcactgaatcaccagggcttgctccgcctatagaaccacaaccaagaagatgggagagactctcagctcacagcaccagacacttcagacccaggttggagagctcaaaggcctgaaacaggctccaagaagatgtgagtctgaattcacagcaccagacacttcagacccagatgtgaatcttaactcacagcaccagacacttcagacccaggtcggagagctcgagggcctgaaacaggctcagtcccagactctcacccagtgctcccttgcccgctcggccaactgtcgttttgcagacggcaggctggtcagaggcttcccatccagagtgacccatgaggtgtttctgttccttagaagaggacgctaatagctgcctgggaaaacagttgttaatgaggattgtactaagtagatccctttcacatcaatagtaaccagtttaaagccttttcatttacaaatatttctgatttaaggacttagaggtcagttcgtatacagtcaagtttagatgtgttttggagaaagtggatacagcccacaaggtcccaaaaggcaacagggcacaggtaacattccctggctgtgattagttggttgaggacatcacaattggaagcatccacgttcttcctcacaggaagcacttggctgagagctgtggacactgaggatgaggcttgagtctgtcctagcagagctcagggcctggtgggaaaagcagggtggtcaggccagcgggggagtgagcagggaggggcaaccagctttgcacaaggagccaggaatctcccccccacctccaccctgcaccaggggcgctgactctgggccctcaaggccccccactggggacgctgactctgggccctcaaggccagtggcatccacagctccatccacagcagcgagccttgtgcagtttcaccacaatagtagcacatgtgtgacctcctgggggctgctggggcctatgggagtcgggtgtggacggtgtgctccctgggcctgctcggggatgctgagtaccaggcagcagtgagtggggtgactgaagggaaactcgagggacatctggccctctgctctgccacgcttgtccccatgcttgctgtgtttggtttggggccattggccctgctcctgtagactcagagtagctgtctgtcccacgttgccatagctgagttcactcggcacagtcaccttgggctgtgtgctttttttgctgatcccttaactggtgagaactagtgtacatttgaacacttgccatccagttgacacctttcaataaaaattgcagattaataataaatgatagaagttcatgctttttccttctggtgaagaccaacacatggccctgttttaaagagcagaaagctgcagagccactgccacgtcgcaggcaccatccaggatgtgtaggcgtctcagggatgttacggcactcagaggattggtttatttttaggaaacaactgtagcagccaagtgaagactctggacaggggaggacagctgttgaatgtgtccacagggcctgaagtaggccacgaaagccccaagtttgcccctgcgttggcacaagtactggggctgccaaggaaaaggcgggggtggaggaactcagtgtacagcatgcctgtgggggcaggcatggcgcccggggtggaggggtggaggagaccgagcctgccccagccatgtgggcctcgcagcccactgggagaggcaggccacaaacagggagacaaattgtggattgcactgtgcgtggagggagagggagcggggcggtggggtgggttggtgccgtgtgagctgggacttgagcagtaaggtggggtctgatgaagccttgcgcgaggacatggcagggagggaacagggaagcaccccaggaagttggagaggctctggtgggcatagcgaagggctgacgatgagcacatgggcatgtgttagagcacgttttttatttataaggacataaccctggctgctgcgaggagaggggctctcagggtcaagagaaggcagagaggctcctgcacaagctgagtggtaacagcagcgcagaagcagacaggctgatgtgtttagcccaactttgggagaagagctggtgacatggggtgtggggtgagaggggagagagaaccaggtagtctccaggtgtctggcctgatggctgcagcgaggtgacaggatttacacatgtgcattggtacacctgctgcccgggatggccaggtgaacaaggagttggcctttgtcaaagctgaaaacaccttacttgaggccccctggagcgcccaggcctcaccaggcccacccccgcccagccaccctagagttgccttgctgggccagtctactactgtctgtgcgactggcatgtggttctcccgtgatgcatcccttttagtgaggaaggaactagagccacagtttgatgaagttgctgactggaccactgaggtgttagtgccctgtgcaaggtgccctaactgacacctctgcatgtttctttctgtcatttgtccttgctagaatttcctcttctgtttcagtagattcctattctcatcaatatttcccacttaatatgatgaatattgtacattattattcttattttaattatctcctttttgcattgcactagaaaaaatgtgtttgctgaaaattaggcacaaatcttgcttgctctgtgtacaagatctataaagattcacttagcagcttgcagggacggtttcctagaaggtaaaatatttcactgaaaatattatcaattgaatattttggaacactttagtgatattgtttggtttagataatactgaaagcaaaatataaattatgaggtgaagtgtatctctaaacatgcatgattcgcttgttgagtttcagattgttttcgttcaaatgatgtaagaggtttatacttcagttgcttttgttaaataagcaaatcatctttcaatttttttgctacaaagttaatctagctttggaatgctgcttgatgtatagtaaagaatgaacacgaataatctccactttaataccgtttctttttttttttttagtttgcagttcaaagctattaaatatggaacccatagcagtcataaagaatatgtaaaagttttctcaaagctatccatttttgaggggaaaatggatttaatccagtaatatatgttagtaattttaatcaagttcaccagttgtcttaaacagtttttaatctataaacttttagtggactcctaaagatgacattttttaccagcacaatagaaactattcaagttctgatgcatctttaatgtaaataagtcatgtttttaatattttattccaggatatgttttttcattaagggaaggggagaaaaagggtaggtatgctcattgtccaaagttgataagaacattatatttatatatattgtttatacttgtggttgcaatgtatctataaaaaggtataaagaataatataacaatcatttacctacccccagtacaaaacgtataacattgtcaatttgaccatgttagctgaaatcaaaagcgagctcatgaagaaatgatcaggacacggtgagggaacggccttgtttgatccagcttgatcttcttccatgtcggcacccagtgtctggtcctgtttattaaaaataaaaagcatgttcatatgtccctgatttaaaatgccacctttaccaaatattctgtgtctggatgtgttgtgtctgattctgggtttttcttccatcacattgaccctctttgtccgtgagccacgctgtgttgcgttaggcactgaggctctttatttctaataggaaggactaagccacctgctcctttggttcagagttttcctgagtatttgagtctgtttatccttttcacgtaaatgttagaatcagcttgtctagttccattaaaacaagttggatttgtacctggaaccaagtgaaactgaagtctcaggtcttctgcagtcaagttcaatgttcttccacactcaccacctcccagctctgtcttcttactgcattaggaggcattctgagaaatgaagaggttgttttgaatattgctatcaaataagtcttttttttttaattgaccattcttggaattttgttccataggggatatttgatagggttttaattcttatttgtttgtagttcaggtcataagaggttcttttaaaaagggaagaaaaaatagctctgtgaaatgtgctaaagtgcttgcatgtgctgttttgctttgttttataacctttggtacaagagttggcattcgtcaaaactgaaaacgttggcttctgctctgcaagagatttgtagctcccattcttaatgtgggcggtacctgcaggtactcacctgccaccacactcggcatgactattttctactgcgagacattttccatgtccttttaaaagaattttaatatgtaagggcaggaaaacaaagtgaactgtatgaattaggtgaactacatgagctgggctcactcctgtgcctctgcacttttattgttgttgtaaagtttgtttttcctggtcccagaaatctgagagaagtcagccttctcaggcaaaccaattattgattaattatgtataagaattaaattagccatttgtgtgtcttctgcctattattaataaactttttattttgaaggctgggtgcggtgactcatgcctgtaatcccagcactttggaggtcaaggcaggcagatcacctgaggtcaggagttcaagaccagcctggccaacatggtgaaaccccatctctactaaaaatacaaaaattagccaggcatggtggcacgtccctgtaatcccagctactcgggaggctgaggcaggcagcttgaacctgggaggtagaggttgcagtcagccgagatagcgccactgcactccagcctgggtgagcgagattctcaaaaataaaaaataaaaaatactttttattttgagataatatagattcacatgtagttgtaagaagtaatacttatatgaacgtaagccttcatttctctgggataaatgcccaggagtacaattgctgagtcatgtggtagttgcatattttatttttaagaaactgccaaactactttctagagtagctatcccattttacatttctgccagcagtctatgagagatcccttttctccacagcctcatttcacctggggctgtcactatctttaaagcaacactatgttgaatagcccttctcggaggtgtgcagcggagttatctcacggtagttctcagctgcatttccctagtgactcgtgatcctgagcatcttttcatgagtttattttccatctgtagatcctcttcgtgtcctttgcccattttctaattggactatttgtatattttactgttgagctttgagaatttcttatatattctatttgttggatatatatttttcaaatattttctcccagtctgtagcttgttttttcatctttttaacagggacgtttgcagagaaaaagtttttaacttccagtttatcagttgtttcttttgtggattgtgcttttggtgtgaagtctaaaaactctttgcctagccctagatcctgaggattttctcctgtaactttctaaaagttttatagttttatgttttgcatgtaagcccataatctattttgagttaagttttgaataaggtaggagacctgaattgaggttcatttttttggatctctagttgccccaataaggctgtgcctcttcacgaaattgcttttgcacctttgtccaaaatcagttggacatatttgtgtggtgtattcggggttctctgtgctatcctcttgtgatctgctcgtctgccccttgccaacactgtaccgtaccgatgactgtagctttgtagtaaatgctgagatcagctagactgattgctcccactttattttttttttatggtggttacattaaagtctttctaagagaattctaacacctgtgtcatctccgtgttggcatctgttcattgtcttttttcatttagtttgatatcttctgtttctcgatgtgacaagtgattttttattggaacctgattatatgatattatgagactctaaatcttactgaagccttctgttttagctgactttctcatacaccacggtgtcagaggaagcggggatgctgtctcattactgctggatgggggataagtccaagttccccactggggctcccggatagctccctgttgtgagagggcctcatcactgctccatctggagccttcactggcagcaccggctagcgtcgtttctaccaggtggaaagagagcccagcttccccacatagtctctcatgactctgcactgtggcgtgggaagggaaggggttgttagagcctggtggaaatgaagattgtggcttgtcactcagccttgtctgacaccacccaacaaggggactctggggttgtccttacagtctggcacgggtggggcgtggttgaggttttttgtttggtgtttggctggaataaagcaattcttgtctaagaagttttctgtcttgctgggctacctctttcctggtcctttggccagagagagcagcttttgttgcagctttttgtgtgttttgtttctgccaatgcctgctgatgtttctggcttcctcagctctatgttgagaaaatgaagcaaaaggaaaatgcagggtcgcttctcaggtcctgaggccccctggcttgtcagctttctctacatctctcagtctttttatgtgtgttttatgtataatatccaggatttttagttgtatttaatgggaggaaaaaggagaagaactctgtcttcccactgaggaagttcctttgcctatttaaaaccagtttcagccaataagaacagagctatttggacaggcttattcgttgttcctccagtttatagtttgggcttctgagaagcgccttgccatcactttgcctgcataacctcagtgccctcacacaagccacctgttttcccgtcttcgtgatatgctcagccagaccccttgtctgaagctcagtttgacgagcatgtcctcattttttggcctgatccctccagccaggaggctcctgggagcacccacagcctactgagggcatctgccctgactgcaggggtcttgccctctgtgcctacatctcacctcccattctagaccttaacccaattactttttatcagtccttccataatggaaatattaaaacatatacaaatatacaattgtatcaagaactctgcatgcccgtcagccacatcagtaattaccaaccagggcccatttgttggttttgtctacactcatctatgtttttctcaccacactgaattattttgaagtaaatcctagatattgtcctttcatttgtaaatacttcagtatatgtcactaaaagagaactgccatttctacacctaaaataatttatcataattccttaatataatcagctgttcaggcagtatttacatttaagtttctcagaatctgatttaggttcttgtatctagcacaagtgctttgcacgtaatagattctcagaaaatatatcttgaaatagttaatgactataaaataataatgcttttaaaactatctggaaaactttgttgaataaaggattctaaagagaaactcatttaactttcagcaacacatttgcctgaaatatagtgagattgaaagttattaacatgatttcatgaaaaactatatatataaaatatctatttttagatatatgatatttgatatagatatataagatatatgcatgttttagtacattttagtcaccattttctaagagcaatgaatttgccttttagtgatttataagttttatttgtacacaaagtaacgtgtgattataaaatttgcaaatcttctttttcctcaattgcaatttgatgatattatttattatagaacatgtattaatacagtctgacaaagtataactaaaatatttaagaagaggaaactcttaaatttgttagtaactagaaattgtaatacctgttctttgaggatttcctgtggtttctcctgccaacaaaataatacttatatgtaactaagaaattagattgaattttagcagtcatgtgcactttagttttgtctgcataaggagctattcaaggtgagagagaagtagctaagtgagaagctgtaggttctggttctgctgtgtggctttagtttacagctggaagccaaaagtctacccagagtaaagatagatggcaagtatgtgagcgcccttctgaggtctgtcgccatctgtcatggcgtgttgtgtccttagtccatcctgcagcaggcgtctttccagagtgcaaatgccagtgcctttgtccctagttcagcgctcttcatggccctccattgcctggaatcaaacccaccctcctcagagtggtgtgaggtccctgggcactggccctgaacctcccttgctgggacctggtcccaccctcatcatccctccatgtgggagaatccacgcgagacgtcctttgctgtgctggaatccacgcgagaagtcttttgctggactggaatgtgccaaggaggagtattttgtaccagatggcagatctgacttctctaacaagacctagttcttattttatgatttttttcctttaatttgtaataatgttgtaattatttccttagagtagacttacttcatattactcctgtcataggcacactaaatgctattttcttactgtctttcagacagaaacagtctccgccagtcaagaaaccctcaaaagtattttgccatggatatagaagatgaagaaaacatgagtaagatctaggcctatcacgtagtatcagatagctaattttatgttaacattttggtgtttttgcaaatgtatttcatgagaccagtgtggggattgtgttttttcccgtaacatcttctactgacagtggcatgtttttaatttttggtgtgttctctgcaacaggtgtcagaatttgctgcagacgtttttccttcctcgttatcgtcgtggggcatcactgtgccccgtggaatgggcttctgggtatatctcatgaagccccactgtttcatgtggagtcctgtcacggcatgcctctcagaataatgctctgagtattcacacatacaaatcgaagataacgtctgagattgatttaaatacccaggcctttgcaataataggacagaaatatttcccttcaaaatgcaggttctcgctgcattttgaaggaaggggattcacacgtgtctgttgatctaaagttcgcaaaggtgctaatgagagctgggactggtgtgggcctcctccttccgtgctgttctctctggtgccggggtggtggaaggccgctggggtacgttggtgtttcggtgaaggtacttatctcttctagttcatcttcagtcccagaaaacaggtttagatgcttccacggaagttgggagagtttagtagagaaattacaacaaaggcatcattgctctaactaatataaatatctgtatttaccttcttacttgtctgaaggaataacatgcagctgtcaatgatgagtgacatgtcactgggagtgattattgagcattagaacttagcactttccctttgactttacgcacaaccgatgatctggggtcttggagtcactcttgcgtaccatgtagaacccaaaccatgacccagtgaagcatttctgcatggtattgatttctgcatggtattgatttctgcgtggtattgctgccccatgggtgtgctgtggaggcggctgggcctctgctctatggactgtgtgctaagtgttggctttggttgaagtcagccatctggggtgtgagggtgagaccacctcctgcagtgctacccaggaaccacgggaccagcgtgctcacctcacttccgctgttgtgtgcgcagcccgtgcctgcctgctggtgattgtttttttcaggtttttatcctcatcaatcctgctcttgagatcttttaaaaacccagcttcatgtttttactgggcagttctactcactgtttccaagtttgtgacaagttttaagagagaggttacgtccatactcctcatttgagaaaatgtgacctgtgcttggcccgtgcagtagcccaccaacggagcatgtgcaggggtcctcagggcctctgtgtcaggactgtggcctacagcctacagctgcagtcacctcgcatagacagaggctttgtgatcgtgtaggttctggaactatccccaaactgatcctgtgatcacttgacatgataaagaatcctcccacatttttctgtgaagagaagccgatgttgtagtgctaaaacgtggacattctggtcctgtatttgtatcattttgaaagcaatgcaaagccctgtcatgatcagtatttacatttatgaagtgtagtagcatgatacagaaagagaaggcatctgttgaagaaaagctgtgaaagtggcatctttctctagttttagtattttcctttatgatagtagcattttcagtgacagtgagagtagtatttcagtgtgcccctgaggtgaataagaatttagaatgtatggaatctgtatcacagaaagtgtattcttctcaagattatttgtcaatccaatagtaattatttttatttctgaaaggaaagcatttggttatttcagaggttataaatatttggttaaatgcatgtccaaatacatttataatgatttgatttttgatattgataattgtttagcaacaaagtcaaaatgtaagcagtaatctagtatgtcatgttcttgctcagtttattaatctctgaattccatcttggctctattttttttaaccttttgttccctttgagcaccgaaaggagtaacctatcgagcttttgctggaggatgttataaatgaaaatttagtgtccattccatcagctttgtcaactgggagaagtggtgtgtgtgtgaggattattttggagaaataatgtctgtagagaaagttttaaatctcttagcctctaccacagtgtggcatcagttttcccatggattgtgtctaaaccaggtttatgctctgctgtcttggccgaatgatgacagccctggaattagagatctttaacctcaaagattggcagccaagggcgaggacttggtccctttaaacattcccatggatgaagctgatgaatattttcacaacttttcagtttgcttaacgtaatgagaatctaccattttacacatgtagtagaaatagaccctaaagccaccatatggggcactcgtaaattggtttacaattttagtaatattttggttactttaaaaaatacagatttttgaaatctagtggtagatgtctttaactttcattcacattacaaccttgcagggcactgtagccctcacccttgggctccatgtgacagctgcctagccatgatggaaaggaattatttcttcttctcctttttaaaaagcttgatgaacactttatactcctctttttaaaataaaaaattagggctgggcacggtggctcacacctgtaatcccagcactttgggaggccaaggcaggcggatcacctgaggtcaggagttccagaccagcctgaccaatgtgatgaaaccccgtctctactaaaaatacaaaaattagccgggcatggtagcccacgcctgtagtcccagctactcgggaggctgaggcaggagaatcacttgaacccgggaggtggaggttgcagtgagccgagatcgcgccactgcaccccagtctcaaaaatacatacatacatacatacatacatacatacatacatacatgtataaatccataaataaataaaatttaaaaattatgtttattttgccatgtaattttacaattctaaaattgtctgtattaattcaaaatctgaaatacctttaaaagttaggataaacaaattattctggaaattcatcaaataattgttttaaaaaagacaaaatcaccagaaagtgtatttatgaagttaggaagttgtaacctgcctacagcttcagttttgtgtcttgttcttacacacttttcctatcatggaacgatattaaggattcagacttagtcagcccccatatataatattctcatttttaaatagatactagaaataaaaccataccctcctaaacacaacaactaaaaagccataatactttacacaattacataagcagcttttaaagattggttcataaactaaatcaaataattgcatttattgattgaatattttaaacctgaaaaactaattatcttgtgaatgcatgtttttaaatagttttctcttctgagagacgctgcaatttaaaacccttagatagcatgagggtaaacaacagtgaaaggaagatgctaaaataaatatatatttatccatatattgatattaaattgtcatttcattagacttattaatgtaaggtctttctggattaatttatcatcccacattttgataaggttgaaaaagtctaggtacttcagaatattctcagaagaaaaaaaattatttaaagattttactttttaaagcaaaagcagttggtgacactaaatagaaatggtattagtcactaagcaaagtgtcagattacttgtttagttgaggctgatagttctttaactaaatgtataactcttcatgtatacatcaaggaataaaatttataagcacacatcacttaaccagttacaaagagagctaaaggaatctataaattttgcatttacaagatcctgcaacgaaggcattgtaagttactctttctgggcaccacaggttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggtgaggaactatgctgctgctttaaaacacggggtcattgctcttggtaatgcttctagacagcattttagtttcaggattactgttgactttccaccttgacatcactctgtccccaccaggaggagttactggtaagtctggctgcttgatttccatggccatgtggccactgagaagccgtctgcatcctagtgcatgctgggtctgtcgcaatgcaaggcagggacacctgagaccccgtccaccagagcagtgtttacaacactatccataactcccttcccgttaggcaaccccccccatgaccctcatcccacagcaagcctttagcaggagagacggaagaagagcccagtctttgaaaccttgcccccagttcagcaccattttccttcaaaggtctcatccaagaatctcacattcaagataagtgacaccagcccgtcagcagctgaaaacccaagtctgggtcaagatggcagcctctgggctcccacatgactggctggtggctgtttgctgttcctaagccgaggagcccatcaaagcagcgaatgagccagcacagcagtgagcacctatcagagcgcagggagggaggggcctccaacaactgttctagggcctgccagttgcctgggagtctctactttgaatttcctacatgggctgtatgaggacttccccgcatgcccaggctggaggtggacagccacccttccatttgacctccccagcgcagtgaaatcaggatgaaggaaggggaagttccagggtgggcttagattggcttacgtgaaagagaaaaagtaaaggagaaaatcacctttagttctcatctctaaatcctaaaactctctgattatgtattccttcttttcttggaaatccaaagttcttctggtctattgcaaaagttatttttttgaccctctattcatttattactttgtatcagagtcttcttcactttgaagataacatgtatactacccttgaccacaagacttgaaggtggcttgtgttcccctggaagaatccaagtgtcttatagtttcttttttgctgttggctacaattagaacaacctctgtgcagttgtagtctgagatgaccaggagttctgttttaaaggaaggaaatgtattttattttgcctaaaggaatcaaatgcaacatcagtataaaataatatattcaaggtatttcactgatttttttaacgaaccaaatacttgcttcccttattaacctctcgtcaacattgtttataaggattattagtccatttgtactttaacaaatcagtgctactagatcccatgtgattttttattttcaggattactctttgctaaaatattaaagcctgagttcaaaatattgtctgatgtgacttgtcttcccttaatattgacagagtggcatataagaccattgaaatgacatcaaatgccgtggatcccagatgtctgaaccttcagtgtgtaggctaggagcaccttaggcggacgcagatcgaagtgccagtagagatgtcacccctgcctccctggcttggctgtgcgcctgcagtgacttctgtgtggagcatgaccagagcccctggcttgggaaggctggagggacatctgttgggctccagcctggggaggggtgcaggtgggcagggctgcctcagccccctgacgccacgttcctctgggctctgtaggtgctgaacaccaggctctaggcctcatgtccagaaccactagggcatgagggcatggagctgcacttcgagtctctgccggagtggaacctgccaccttgtgtctttggagcccccaggatagccccggaatgtgacgtgttccttgtaggacccgggtggccctcccagaagcagtccttagggctttgttggtgggctctattgtctttcaacaggaaatttccaaatgtgcattctaggatgggtggaaaaccctcactctttttctagagtaacccttgaaggacgtaggtcagtcatccctgcgtgtcactgcaggtaaatggtgctgcctgggactgtgtggcatgggtttaactcttaagagcattttttttgttcttatatctgtcccccaaattaagagggaagtccttcattaaccatacaggttaatgagaccagtaatcccctcaacggggtgctgagccctggccatgtgcctcagatgtctgcgttaacaagcatcagccccagcaccagaccttcagagtgaggctctcggaactcactctgaagttaaagttcttcgcctctctttgaaagtttggagattcgcctaatcttacatgaaatggaaacttttatttcctctggcttatccctaatcttcttatgactttttcttctctgtaaactcgaatgaatcgccctttccctctggcaccctggccaattggaatgcgtcgccccttccctctggcaccctggccacgtcctgtgtttctgtcacagcctcagttcctcgcgtccgctcacccctgcattgcagatgccgctgcctgcgggtgcatggatccctgccaccaaagcctctgtccattctccacatgacttgtcttgaacactgtcctctggggctcactgatacttgctggtgcaatgataagagaaaaacatcctgacaactatcttttctactcatttcagaaatattttattaaggaccaacctggggatgctgggttttcctagtagtcatttgattttccagacaagtgtgaaattggtgggacatgagttgaaactggctcttaacacccacctcccagcagacatcatttcccaaaatgccatgggctcattatatccaagataaatcataagccataagaccatgtccaaaatccaacaaatacatctgttctcagaagcactttaatacagatgtctgtctgacctgagcatatacctgtgcaggtgttccgaacgtctaagcgctttccctccccgtgctgttctctggtacatgattctatcgtaccgtctgggcgagtgagcggagtcagagtgcatttgtgtggagaggctggaatgactgagaagcctctcggtggcgcctttgagggaggtgctgtgcacagcttgtggcttctttcactggatcgcatctccaagctgcccctttctcttgcctttgattttgcacatcatcctgggctgtgctcccagctgtgtgtggccctggagctgactgagccacaccgtgtgtgcatgtgagagagggcaaggggggtgggagggccatactaggtgggcgtaggcgtgggcaggtggccctgagcaggcagctttgcctgtttgcctcggtttcctcctgagggccgggctggcctgcggtgaggattggagggatgctcatgtgtggtgcccacactccacactggccccacgcgggtggcgaaggactcagccagagcctggcaggatcctggggtgtctatttccaaggaatgttctggaagaaacatacacacatacttgtttgccagatttacctgtgtggttttccagatgagaagcagcctgtgtcactccataagggagagtgcgtgcagcattgagagagtgagccctgctcccagctgcatctggcccctaacctgcatctgtgcttcccacacaggttttagctgacgctgtctcacgcctggtcctgggtaagtttggtgacctgaccgacaacttctcctcccctcacgctcgcagaaaagtgctggctggagtcgtcatgacaacaggtaaccatcttggtgttgtatgtaaccctgcctgttttcatgtctgacaaatgtgaaatgttctcaatcgacaaaaaccactgtgccacaccgacgggagatggttacttcttttcttcttcaaaatgtctgccatatgcaagtttacgaactgcacttacaagcttttttcccaaaatgttcatctttttaacctaagtttgttttatctggagaaagcacactatattaatatttgattcctgtcatcttcatcctgtgaatggcctcaatctgctctggaagatggcaaggggcttactaattcttcctttatttgaaagtagagcctatctattgtatcagttaatgttaacgatgccagataagtttcagtgtgacttcctttgaggagggagagagctctagcaagagtagaaaatccgtggggaaaaaaagcacaatttagaacgatagaagaaaccctattaaattagtctagaagttcccagtagcaaaaggaacccccgagtcctctccccacatcccgcgagtgagaacacgcagcagcatctctgtgggtagctcctgggaagggaagccacatccttggccagtgtctggcaccccagggtggagcaagactcagggagaggacccctgtcatgtggggccgtctctgtacccagcatctgctcagcccagcctggacagccagatgcaggaagcagaccctagaggtcagggaggaagctggggacagtttctctgtctacatccaccagcccaggagaaacccccagttctcggtatgtgactttcttgttctttccccctgaggggtcacctctatcagactctgcagccctcttcactgacccacctcttgctgccctaggaaacctggctgctctgctcatgaccattgtttccttgccgtgccgtgtccagggaggaggaagcacccgaacagcagcttctattctaatgttttgtacctgtatcttctcccccttttacctctctccttactgctatcttttacattaatcaaaggtgaacaccacaacgactgaatagaatagttccctaggtaagactccctgcctcttccagcagcatgggtgagtgagctggtcatgttctttcatcgttttgttgttgttgttgttttgtttttgttgttgttgtttttaacgaccttagaagaggccgatcaccttctgggaacaccttacatcttagtgtgtatttcacctgagaccacttgctcagagccatagtttacatctgaagccaggacgctggagcacttggcactccagacagctggttcagggggctcccgctggttgagtggccttgggcaggttacaaggcctctgtgcctcagttccctcatctatacagtggagacattagtagcatgagcctcagaggacatcgtgggaatgcagtgaggacaatttacctaacagacctggtgcttacctgccacatggtgtgcacaccgttggttcagctgcagtggatgcgagtttcccggcaggtgacttccagggtcctggcatcacacctctggtcagtggtttatctcacaaagttgagacggagtgatctgtctgtgggagttcaccactgcttgtgatttcactccgagtgtggttaatggtgacagtttactaatgaaaacatcacaagttaattctgttttccttcttattcctctgggtgccgttaacccctccttcctaatctcttcagtactttgatatttgatgtcaagattaattaccagaccagttagtccacctttccatagtgttgcccagctgtgttctagttgtgggcattcaagaaaagatgctattgcataccagaggaaatgacttccttgagtttagtgtctggacactaagcaatgacgatggttggctttccagaaatgtcacaaagtgagtcctcaataggaggttgtttgcgtgtatacatttgcccacttaaaaaataggtggtaagaatatgcatgaagatgagcttgaaaagtctgttggcccctgaaaagttaagtcactgagaataagagtcagacttcaggagcacagttaggcaaacattactgtgaattacagaaaatagtgtctctttttttttttttcaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaagtaagtttagtaaacaaataaggacaggaagctctttttaaaaaatattcctctattagaaaacattgcaaaacctttcattgtttctgtaatcatggaaaatctctcaaaatcataactttaattagtaacaataaggctgcatcccattcttccacaatgcttaacacacatatgcacacatacatacaataacataacatggtcataaatttcaagtctgtgtttaagaccatgtgattttgttgtatgctgtataaatagaagttcccaaactgccaggtaaagatggtaatttttattctagtcaccgtttctagaaagagctagtcatgtatccaaactccttttctttacaaagccattttttgtatgtggtctttctgttctgaagtcataaattggaagaaggaaaggttactcacatcctgatgacatatccattattgagtgacaagaactgtattaattaccctaaacatgtaaaataaatattccagttcaaacttatctttcccttgtggaaaatactagcctctgaaaatgatagactaaaatttaactatatacagctttaaatgttacttttgcaacttttttcctttcagtaacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaaggtatgagacgagattcttcaacaagccagtttctcaagaaaatgttaacagataaaaactaacctgtgttaatatcccttttcctttttttctttttatttttagacttggatgtggatctgataagagtctctataaaagcatggatttttttctttccaattaacttaattagaaaactttaatgaatgaaaaatgctgattgtaattaaccaagtaattagaatggagtgagaatattggattaaaattgtatcagtatttaaatttgggtaataaatatctctaaatcagaggtgtatgtgatcctccatatttctgaggaattctaatttgctaaatgtgtaattaaagtatttatttgcctgatatttcagaagcagataaacactagtgaaaagtgaaaccactattgtgatcatatttttttccatccttctttacatttgaggttagcacttttgttttttagtgttttgtatctacatcccttctcccaagcccttaggcattgtttattccaaatagaacgttttattacattactttccttgtttataaaagcaacaggcatactcactgtggaaaattgctaactatttttaaaatataagaacattaaaatcatccgtattcctgtaacccagaaatactcactatggatgttttaccatactttccatgggtttatttctgcatctgtctagatttattttggaaattttaaaaatatagaggaaaataacatggcaaacacccaagtatccatcacccagaattagcaaatgttagcattttgtcctatttgcttcagtgcatttttaatgatagaaataaatcatttcagttaaagtgaaaaccccatttccccaactcccttggagaccacttttgtgaattttgtttgtgttatgtccttcctactcaatttcatataatttttttttttttttttgagacagggtctcgctcttacacccaggctggagtgcagtggtgcaatcatggctcactgcagcctcgacctcctgggctcttaagcgatccttccacctcaaccttccaaggagctgggactacaggcatgtaccactatacctggctaatttttatattttttatagagatggggtttcaccatgttgcccaggctggtcttaaactcctgggctcaagcgatccacctgcctcagcctcccaaagtgctgagattacaggtgtgagccaccatacccagcctctcagcttcacatacttattttgtatgtgtattttgtatgtatggcataaacatatgcatttatatgcacagactgtattttaaatttataagctattgttagatgtgcttttcaataaatcaaatagatggtttactacctgtggggttttaactctttttctctcttagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacggtaaggggcgggggctccctgtggccacctccctgcacacaggattcatccatactgtttgccaacctcccttttccacaaccatttgaattttggccccatttcccactcaggtgttccacagtattctttgaaggactgaggttctaaacaggtgctgctgggacccccgtgaggggcagcagcaggacctagacacaggaggctccacgcttctaacattcctatccaagcgtctcagagtttaccacttatttttaacgtgggcttctgggttaaactgatgtttttaatgggctacaggccatgacatcttaaaactactggcttctcctcattagtagtagatgcaacttcagtggtcactttcatcattcagttaacattttaggtagttgatatgtgcattttaaaagtaatgcaaaccctgtcacaggcattgtgttctaagcacagagagcatccccagccattctgtgcctgggtgtgggttaggcttagaggagggctctgcaagcacacttctgtagtcagcaggcacctgggagatattcatctttcagaggcctgtatccagagcagattatagaaaacccatttcttcagatggtatcagttccagtagttctttgttttcatttttaaactaatgtttatttggaaaaaaaaagtaacataagcagatggcaaaaagcatacaatgataaagtttaaaacctccctcttcagagccctcctgtggcacccacagtgagtgggttttgactgtccatccagaagctgtcaaaattgatgcatacgcatgtgcacgtgcacatcttttcattgtttgtgtgccctttatgttgatttccttcagtgggtcttgtcaggcaacctcaagtacagggagctggattaatcacacattttgggccattgcccacagcccaggtgaccactgtgatgtgtttatttattatttgtccttccagtccacctccacacgtgcatatgtcaactttgtgtgtgtgtgatgtgggggaggggggtgtactcttgaaaaatacacaatagaattatttggagtatttgttgctaatttacagaaatgatactatgctgtaaatcctatctgattcttacattttcattcaacctatatttttggagctatttctgttgctctaaccaacagccagttcactactgacttttgcaaatcttccttcatagtcatgggccatttccttcatgatgggacacccatatttcttctaactcccttatacatgtagtcctgtatatccttcaacttatgcaaactccatcacaatattatagactttgctagagtttcttggggcatatattcaggagttatgcacatatataacttcacagaataatatcagattgcatcccagggcagtcacactagttgacacttacaccaatagtgcattaagttagcttctcccacattctgtaaactgatatcttcatagtttcaatttttatttctctttatcactaggaatgttgggcatctcttcaattacatattaactgttcatcttacaccttctttgagttgtctgttaatatcatttgttcatttgtcttttgaatctcatgcctttttcctcttgattttcagagttccttttacagttgatattgtaatccttagccctttgagaagatgcagtgtcttttgcaagtcctttcccctttgagtagtcttgcactctgttgaagatgatttgaacatatacacaagggtttattactgtgctgtctgttctattccatatgtctattctttatgccagtgtcatgctgttttgattactgtagctttgtaatatgttttgaaatgaggaagtttgaatcctccaactttattcttcttttttcaaaatccttttggctatccagggtctcctgatatttcataaagatttttggatgaagtttttcaaaaaatgccatcgttattttgatagggattatgttgactctatagattgctttggttaatatggacatcttaacaatattaagtcttctaactcatgaacatgcgatatatttccatttatttgtatcttcatttctttcagcagtgttttataatttttattttacaagccattcacccccttggttaggcttattactaagtaatttattcttttttgtgctattgaaaattgttttcttaattcccttttcagatcattcattgttagtgcatggaaatgcaactgatttttgtgtgttgattttgtatcctatgattttgctgaatgtgtttattatttaaacagttttatggaatctttagggttttctacatataaaattatgtcatctgcaaacagatataattttacttcttcctttccattttggatgccctttatttctttttcatgcctacttactgtggctagaacttctaatactgtgttaaatagaagtggcaaaagtggacatccttgcattgtacctgatcttagaggaacagttttcagtctttcaccgttgagtacagtattaactgtggtcttttcataaatgtcctttattacgttgagttagttttttttctattcctagtttgttgaatgtatttattattattaagaaagggtgttaaatcttgtcagatgctttttctgcatcaattgagatgatcatgtggcttttgcccttcattctgttaatgtaatgtattaattgattttcatatgttgaaccatccttgcattccaggagtatcataatgtataatccttttaatatgctattgaatttggtttgttgagaatttttgcatcagtagtcatcagagatactggtttgtagctttttttacccttcttcatgtctttggctttgatatcagggtactgctggcatcatagagtgagcttggaaatgttctctttagtttttttgggagtctcaggaggattggtggtaattattcttaaatgtttggtagaattctctagtgaaaacatttggtcctgggcttttttttttgagatggagtctcgctctgtcacccaggttagagtgcagtggcacaatcttggctcactgcagcctctgcctcctgggttcaagtgattctcctgcttcagcctcccgagtagctgggattacaggtgcctaccaccatgcccagctaatttttgtatttttagtagagatagagtttcaccatgttggtcaggctgatcttgaattcctgacctcaggtgattcacctgcctcggcctcccaaagtgctgggattacaggcatgagccactgcccccagccatgggcttttcttaattgggaaatttttgattactgacccaatattcttatccattaatagtttgaatgaattgtttttcatattcattattcctgctatcatttggttaccatctgcatggaatatatttttccatcctttcactttcggcctatgtatccttagatccaaaattagtctcttatagacagtacatagttgaattgttttttttttttaatccatttacccaatctgtatcttttgattggggagtttattcattgacatttaaagtaatcactgatagggaagacttactgttgccattttgctgttttctatatgcttgtagctttttgcttgtttttcccttattctcttactgccttcctttgtgtttctttcattattttttctaatgataggtgtattagtccatttccattttcattgctgataaagacatacctgagactgggcaatttacaaaagaaagaggtttaatggactaacagttccacctggctggggaggcctcacaatcatggcagaatgtgaaaggcacaattcacatggcagcagacaaaagagagctagcttgtgcagggaaactcccctttataaaatcatcacatctcatgatacttattcactatcacaagagtagcatggtaaagacctgcccctatgattcgattacctcccactgggtccctccgacaatacatgggaattgtgggagctacaattcaagatgggattttggtggggacatagctaaaccatatctataggattctcatttattttattttttccttttgtctccgtggggtacaaaatctcatttctttttgtgtatattctacaggtattttctttgtggttaccattgcaattacataagacatctttaaattatagcattctattttaacttaaacttcaattacatagtaaaactttacttctttacttccaccccttcacactttgttattgaagtcacaaattacatctttatatactgtatatccattaatatacattgtagttgtaatgtttttgtcatttaaattttatgcaccaaaattacaatagtattggttactgtatttgtccatgtgcctccctttacaggagaaccttatttttccatacagcttaatgttgctatttactgtctttctatttcaacttgaaggactcactttagcatttcttgtaaagcaggctagtggtaatgtactccctctacttttgtttatctggaaaagtcttaatttcttcttcatttttgaaggacagttttgccagatcaaatatgcttggttgacagggttgtttttttttttttttctttcagcacttaaaatatatcattccactcctttctggcttgcaaggtttctgctgagaaagccacaggtcttatgaatcctcccttgtatatgacaaatggcttttcacttgatgcttttaagattctctgtcttcactttagacagtttgattaaaatgtgtcttagtgtggttctccttggatttatctgtatttcatttctttgagcttgaacttgtatggtccatttttttccacagatttgggaaactgttagcaattatttcttcaaataagctcttagcccctttctctccctcttctccttctggtattcctagaatacttgtataagtctgcttgatagtgttccgtaagtcccttagtctcgcttcacttttcttcattcttttttctttttgctcctctgactcagtgatttcaaaaaaagacagtgacctgtcttcttttttccacctcatcaagtcttctgttgcatgcctttaatgatattttcagttcagttattgtatttttcagctccagaatgtttggctcatttttatactaatatctctttgttgatatgctcattttgttcttgctaagtttttcttattttgtttagttgtctatgttctcttctagctcattaggcatctttatgacagatattttaaattcttttttagacagctgatagatgtgcatttctttagggtcagtttctggaaatttacttttggtcctttggttgggctatgttttcctgtttcttgtatgccttgtttatttgtgtgctttgctaatatttgggcatttgaaaaaagaaccatctctcccagtctttgtgtactggctgtgtacagagaaagttcttcactaacaagctggctaaaaaatctaggacctcttatgctttttctgatttcctgcttctcctggtgtcttcctggaaaactgtagctctaatgtgctgcttgcctctgtttttagtggctcccaaactctggcaccagtctcatcaccgagtctgatgagactcaggcaagacagaaaccagccctttgggcagactccagacagccagaacatcagactaatgatccactcttttgtttccatcccaagagaagagccccagtatggaggcttcctcccacttagggggcaccttgctatttagggaaaggggaacaaacaggcatgccaaacatcgtgaaatttcctatccctttcattggaatctcttcctagttttacaatggactggatactgtagcttctcagttggtctccagagttctcacagagccattctggtctgtatattgttgttaactcagggtctctatgggggaaagagggcctgtagcttcctagactgccatcttgttgaagtcgtagtccaaacaccattgattttttaatgttaaccttatggccagcaacttaactcacttcttattctatttatactttcctggttgttcttgaatgtaccaagtcacagtctgtagatattgactgttctatatcttcttttgttataccagtgttatttttctttattcctgctgtccaggaccttggatgatatgttacagcactgtccatgttttcttcctgaatctgagagagattgtgactgaagtttctccatgatgtacagtttttcctacagggttttagtaggtagccttcatcatgctaggaaaattctgttctattcctattgtcttagagcctttttattatcatatattggtgttactttatcaaatgttttatgtgtgtctatttttaataatggtaaataattaatagatttcctgatgttgaccacctttttgcaattttgacataaaccttactttattatagtcactcattgttttaacatactgtttgatttggatgactaatattttacttaggatttttgtttataagttaaataggcctatactttttctaaactttttaattgttcttatctgattttggaatccaggttaatatagcctcataaagtgtgtttgtcttcttgttctactttctgaagtctcttctgtgagacagcagtgtatagaacccaagagtgaaaacatccagtccattatatatatatatatatttttttttttttgtagttatcttcatggtcatcctcatcattttggcaggagaccagtctagttgtaatttcaggtccttttctggttactagtttcttaaatttttgtttcttctagaacaaatttttagccttcatattattctagaaatttatctagaatttgaaggtttgaggcttctttgaaataagccagtcgattgtggcattcaggcagagaaggtggatctataattagagaatagagtagtggtagtaagagaatgagagctaaaaaagagtcagctaatgcagtcagaaagaagaatgctagaattttactatagtagagctacaataatttctgtggttatggtttcaaagagaaggtatgggaaggagtaaccaaataaggtggacatttgaaaattatgatgtattgtattttacaaagatagccccaccccaatgcctctcatctaaaatcctctccaacaatgtgaccttgccactgtaccattaagaggtgacgtctctgtcccatgcccctgaatctgagcctgtcatgtggctgctttgaataagagaatgtggtggaagtaatgcagtgctagttctggcatagccttaattggcctgacaacttccatttcttgcctcttggtggcagccaccatgtgagagttgtgactaccttgagaccaccgggctataagaagctgcccctccgtgtagagaggccctggaagatgagatgccacttgaagacagagagagggcaaggaacagtgaagcaccaaatgtgtaagaaaagagttcacctggaaaatggaagagagaagacaaaattaccaatatcggaatgggagaggtgaaattaccacagatgctacagatactaaaaggattgtgaagagaaattataaacaaggctatgccaattgacaatttagatgaaatggacatatttcctgaaagacacatactaccaaagctcacttaagaagaagtagataacttgggctatctatatgtattagagaaaatgaatttgtaatttaaagcctttcccaccaaaaatgacaacaaaagaaaaaccccaagctcagatggcttcactattgaattccaaacatttaaggaagaaatacccattttgcacaaaatattccaaaattgaagtgaaagagatacttcccaactcattctgtgaggccagcatttccctggttccaaaaccagatgaagacaccacaagaaaataaaactacatgttaaaatgtgtcatgaacatagatccaaaagttctagcaaaactttagcaaaccaaatacagcatcatgaccaagtaggggctatcccaggaattccaagctaaatgaaacatttgaaaaatcaatataattcaccatattaacaaactaaaaaagacacagaaaaggcattttgcaaaatccaacatgtgttcctcataaaaactcatagcaaaatagaaatagaaggaaaccttctcaacctgataaaggaaatctatgaaaaatctacaggtaatgtcattcttaacagggaaggactgaatgtgtttgcctaagatcaggaacaaaacaagattgtctgctctccccacttctgttcaacattgtattggaagttctagccagtgctataaggtcctaagaaatcagtggtatccatattgaaaaggaaaaagtaaaactgtctttatttgcagacatacttatctatgtaggaaatgagatggatattatacaaaactatgagaatgaatgaatgattttagcattgtggcaaaatataagatccaaaatgtaaaatacaaaatcagttatattttttacacctgcaacaagcagttgaaattgaaatgtgtaaagcaatacactgaaagctgtatattgaaaactgtaacacattgcctagagaaattaaagaactaaataaatggagagatacatcatggtcactggttggaaaactcattattgtcaagataccagttttcaccagattgatctatagactcaatgcaatcctaatcaaaatctcaacaggattttttggagaaattgacaaactgattccaaaatccatatggaaatgcaaaggacatagaataggtaaaacaactttcaaaaggaagaacaaagtaaaaggctaatactacctgatttcaagatagtaattaagaaagtatgattttggcataaagataagtatacaaacaagtgattccttattatttagagtggttttaggtttataggaaaattgagtggtagatacagaatttcccatatacccagtgccctcacgtatgcacagcctccccatcatcagcatctcccactctagtgctatattcattacaatcgaagacacatcatcatcacccaaagcccacagtttacaatggcgctcactcttgatgctgcacattgtctggctttggacaaatgtataatgacctgtatccaccatcacagtgtgagaccagagtagtttcactgccctaaaaatcctctgtactctgcctgttcaccccctctcacctcctaacctctactctgcctgttcacccctctcacctcttaacctctgtattctgcctgttcacccctctcacctcctaacctctgtactctgcctgttcacccctctcacctcctaacctctgtactctgcctgttcacccctctcacctcctaacctctggcaacagctaatcttcttaatgtctttgtagttttgccttttccagaatgtgatctagttggaatcatacagtatgtagccttttcagattggctttttacacatagtaatttacattcaagattctttgatgccttttcatggcttgatagctcattttttttaagtgctaaataatagtttggatgtgccacagtttattcattcacttcctgaaggttcattgcttccacgctttggcaattacaaataaagcagctataaatatctgtgtgcaggtttttttgtggacatgagttttcaagtcctttgggtaagtaccaaggagcacgaatgctgggtagtatggtgaggatatgttgagttttgtcagaaactgccaaactgtccttcaaagtggctgcactgttttgcattcccaccaacaatgaatgttgtcccacattgtcaccagtattcagtgttgtcagcagttctggttttgggccattctaatacacatgtagtagtatctcgttttaatttgcagattcctaatgacatatgatgtggagcatcttttcatgtgtttatttgccatctgtatatcttcttgaatgacgtgtctgttaaatttttttggccaatttttaatcaggttgttcattttcttattgttgagtttagagagttttttgtatatttggaagagttcttcatagatttatcagatatgtcttttgcaaatattttctcctagtctgtggcttgtcttttcactcccttgtctttcacagagtagaactttttaattttaataaagtctagcaaatcagttatttctgtcatagattgtgcctttgatgttacatctgaaaagtcatcaccaaacccaagatcatctagattttcttctgtgttatcttctaggaattttatagttttgcattttacatttaggttgtgacctactttgagttaatttttgtgaagggtgtaaaacctatgcctagattctttttttttttttctgcatgtttatgtccattggttctagcactgtttgtagaaaatactaccttttgtccatttcattgtctttgctcttttgtcaaagatcagttgactgtatttatgtaggtctgtttctagactttttattctgtcccattgatctatttgtgtattctttcaccaataccatgctgtcctgattactctagtatagtaagtctttaagtcaggtaatgttagtattacagcttcattatattccttcaatactgtgtttgctcttctggatttccctttttatatcagccttaggaacagttcatcaatatctacaaaataacttgttgaaatattgattgggattgtgttgaatctctatgtcaagttggacagaaccaacgctgagtcttcctagccataaatatggaatatccatttatttagttctttgatttctttctttggaattttatagttttacttatacagatcttgtacatactttgtcaaatttatacctaaatatttcagttttgggggtgttagtgtaaatgatgttgtgtttttaatttccaattctgctgttcattgctggtcacagttaatttttgaccaaggcacaaaggcaattcagtggagaaagaatagtcttttcaacagtgatgctgaaataagtggatatccctgtgcagaaaaaaaaaaagcaaaaaaaatcaagcaaccaaacaaatggacttcacttatattttgcaccttatacaaaatgaatttgtaatgggccatagacctaaatgcataaaaattctggaaacaggagataatgtttgtgacattgagttaggcaagtttttagctacactaaaaaagactttccataaaaggaaaaaaactgtcaaagtttaaaaattacttctttcaaaaagcactgtttaaacagtgagaaataaactgacaaacagggagaaaatgtttgcaaatcatatatctaataaacgattggtatccacaatccactgttactctcaaaacgcaacaaggggaaaatagtttttaaaatgggcaaaatgtttgaatggacacttcaccaaaaaaagatacacaaatgtgaaataagcacatgaaaagctggtcaacaccattagtcactgatgaaatgcaaaggagatgccacaacacatctcttggagtggctgaaattaaaaagactggccaaaccaaatgttgacagtgatatggaggaactggtactgtcatccactgtggctaggtatgtaaatagaacaatcacttttaaagacagtttgacacagccaggcacggtggctcatgcttttaattccagcactttgggccaaggcagatggatcgcttgaggtcaggagttcgaaaccagcctggccaacatgacgaaaccccatctctactaaaaatacaagtattagccaggcatggaatcccgtctactctggaggttgaggcagaagaatcactcaaacccaggaggcggaggttgcagtgagctgagattgcgccactgcactccagcttgggcatcagaataagactcaaaacaaaacaaagagagtttgacagttccttaaaaagttacagatatggccaggcgtggtggctcacgcctgtaatcccaactctttgggaggccgaggcgggtggatcacaaggtcaggagttcaaaaccagcctggccagtatggtgaaaccctgtctctactaaaaatacaaaaattagccgggcatggtggcacacacctgtagtcccagctactcaggaggctgaggcaggagtatcgcttaaacctgggaggtagaggttgtggtgagctgagatcacgccactgcgctccagcctggggaacagagcaagactctgtctcaaaaaaaaaaaaaaaaagttacagatatgcctgccatgtagcctagccatttcactcctagtggtttaccaaagagaaatgaaagcgtatgtccacgcagacttgtaaatgaatgtttgtaggactttctttgtaatagacaaaatagtcaaaaactggaagcaatccacgcagccatcaaccggtaaatagatagaacagacggtggcatatccatgcagtggagtactactgggtgaaaaaaagaacagtgatacacactacagcatagagaaatctcaaaataattacgcagagtgaaagaagccagatgaaaaagaggaattaccatacagtcccatttgtatatatctcgggagaatgcagactaagctgcagtggcagaaagcaggtcagttattgcctagtggggacagaacgagatgtaaggagacaggaggtttggggagtgaggtcacatgggtacatacaaatgtcaaaacttaccacagtgtccctttaagcgtgtgcagtttattgtatgtcagttgtaccgcagtaactccaggggaagaaatcacatgagaaaatgcttatataagtaaatgacagaaagcaccacaactatatgaattagaaaaattcaaataagttagaaggatgcaaacagtaaagttaagagcagaaattagttttgtaagcaacaaagatgtagcagtgagcagtaacaaagcctctaagatgtcagtacttagagcaggcaggttgattaaagtcaacagaaccggtgaggctgatcaagaagacagaaggcactaccaaaacgtatctggaatgaaaacacggatatccttcagggtccagcagagattgctacagtggagagtcctagacacttcagcactgataggttttaaaactgagacaaaatagaacattttctagaaaagtgtacattgctaaaagtgacttaagcatatgcagaaaattggaatagaactctgcctattaaatcacacacacacacacacacacacatacacacacacacagagaataaattaagaaaatagaaggaaggagagtctgtggagagaggggaagtggttggcccagacaacattgagtgagttctagacatcgtttgtgggatgatgatccccattttatgtaatattttccaaggatagaaaagtagggaagaattctgcagctcattgtgtggctcataactcaaaggttactacaacctttatctccacaccagacaaggacagtaaaggaaaacaaaacaacaacatgtcatggaaatacacatttatacacttacattatctttaaaaatttagcaagccaaattctattttatattttttaaagcttcattaattcctcttaaatctatcatttcaatgtgattttaataaaaatcttattttttcatagtacttaaaagttgaatcccaacatggcaatagaaaactaacaatataaaaccatagtaatcaaaagtgagtggtaattttcggcagaacagtggcacaacatacaatctgaaaagacctgcagacccatggggcagcactggtgatcaggcctgcctgtgtttaaaagaaaatgtaaactagatggaggcttgtctctctcacagaaaattaagtccaaaaataggtggcccagagaagctctggtggctccatggtctggagcctgatccctctttgtcccgcaccatctaagaggtctcttctgagttcagggtcttcataatccctagagctgacgaaatccctgagtacccagtctgaattccaggcacagggacacttcagccagctcagctcatcatccagagctcaggcacagggctccactcgctatggggcagctggggtggccgggcttacacactcagccacctggaagaggactggggctctgtcatgcaggaggaagggaagaaaggcagggctgcagccagcagtctgtgctagacgtggtgctcgcagaagacatggacaaagtagccaacgaccagtcctggagaaacaggctgtctgtgcagagaagcagcccaccatacactatccaaagcacatgctaggacagttaaggacctgagtatgcagagcagtgcctggcagttgcagggttcttcagtaaggcacagaaaaccccaattataaagaaaagtgaataaatttgactaaattaaaatttcaggaattatttactataacccacatatttggaaaagaaaagccacatattgggaagagatttctgatgtctcatgtgaccaacaaaggattcgacttggttacaggctgactcctgcacctgcatagcacagagccatccatttggaggatccttgctggggcgtggggatgtcacacacataaatgcaggagtcggggctcatggacctgaacccttcagatccaagccttttattatatagtaattagactttacctcaaggaagaaacaaacacaagctgatagaacctagcatgggtgggccaagaaatagcaaatggccagaaaagttgcccggaaagagccctggtggccaaaatgatgccagttggctgcagctgtgtccctgctctgggagagttgagagtggggagcagccaccttggagggccaggtggatggggctgggtgaggctgaactgttccccttacacaggacacagtgacaggcagagggcccagggccatggtaggttgggggtggggtgggagccacagcactgccattggaggtcaccagggtgtccatcccactggcaggcagtttggcggtgaatgcagccccagagagttgtccacaagaccatggggtgagaggctcccatggggttggccaccccacggtgattatgttggcgcgggagccgtgggaaggaacgagagtcttggttcagatgacctcggcctgtgtcctcagctgcacagagctgtgggaacaaacaagaccatccagaggaggaccagcagcctgtctattcagagtcggctatggcaagggggccagagcactgtgttgggcagactcaaaggcacgcacaggaagggggatggctttattgtagggaaagggggaggctttgggtatgttctgatggaggtaggggaagccaagatgggctctgcagaaggtggcctcccgtgcagctgcttgaagaacccaggggcatctctggctggtcctgggttgaaagcaggaaggaatgggcgtggggcaaccactaggaagctgtagtccttcctgaaagcctggctgactgggccgagtgctgtggaggctgtggtttgggtcagagtagttctcctgccctgtgtggtctggccgacgtctgtctgcagctcagtctctcaggccgggccctttactgaatcaggggacagatcagatgatagcagtctggactctgttcctaaagaaatggcacaaggaaaatgaaagacgaagaaggccaggcacagatgcctagacccgggtgcactgagccgaggccatgctgtgagagtggggacacctgtaggttccttgggtgtcagccaaacacacttcatggcacgctgtgagtgggcacctcccatggggtccgcaggacaggtggctgtggacatgtagtgggtatctctaggagacgtcctgcctgcagtcttggcagagctttacttgttttatttgcatggacgctgactgtgtctgacaccctctcgctggcgctaggcgatttcatcctgatgaagtttgtcccagctgtcctttgtgaggtgcattagtggaagctggtgccacaccatttcccacccagggcctctgcagagctgtagacactcttggaattctctttcaaagcatacgttcagaattaatgactcctaacaaatgaaggtttctgcaggatcactgctttaaagtttgcccagaagacctaattcagcttaaagatgctgagtccatagaggcttctaatctgtagaagaaaggggcctgtgtttcttagaggtattgaatcatttcatgctttttctgtaagttagggaaaccttcattttcatttccattttggaaggtggaaggaatgtgtcataggaattggaggatttgtccattcgacacatatttattgatcttctgtatgtgccaggtacatattgtaagtgctgggataggtcagtaaagaaagcagacagaaacctcttcctgcactggggtaggatgggagcagagagtccaacatggatctgtaaattatgtggaagtcagaatggggttggagggcttgggcggcagggaagggagacctcaggcagcaggtaagcaaaaggcttgagtggctgggaagggaggcctccctcagaacggcttttgtacagggacctaaagtgggggcagccatggctgcctctgggattggtgttccagctggtggacctgtggacagaagctttgggcaagcagcaaggaggtccctgagggtggccagaagcttggggacaggtgcagggtgagaggtgacagggctgggggatctggccggaggactgctggcattttcttgggagccactggactgttttgtgccagggaatggcctgtgctggcccacgtgttcacaggggtcaagaggagagggcttggggcaggcaccgggttccccttaggagagggcgtcatgacacaggcaggggggcatgacttgacccatggcgtagcagtggcagtggccagaagtcaggtcctatatctcttccaaaagtggatcccaggtgatctgctgatgactgctgtgacagggatgagcagggtgagggtgaccccagagtggggactgagcagctggaggtcagtgctggggcatatccagaatgaggcgtaaacaggtgaggttggcggctgtttgtcatgtgctgcctaccccacttgccagctctgccctgctaggctcttgagggggcatggagtggccctgagacttcaggcctccaaatacaactgtgggcattgtcaggcagaggctgtgccacggagtgagtgacagaggggggatatatggaggctggttccagtctgggcgtcagcctcctccagtctcaagtcctgccacatccgcagatctaagcccgaatgtttctcatctgccctggcctccctgtccccacactgcccagtcgaccttcatttctgacctgtactgctgagcgtcttcccctgcagcgtgtgctgagcatcttcccctgcagtgcgtgccacactgtgctgagcgtctaaccctgcagcgcgtgccacactgtgctgagcatcttcccctgcagcctgtgccacactgtgctgagcgtcttcccctgcagcctgtgccacactgtgctgagcgtcttcccctgaagcgcatgccacactgtgctgagcgtctaaccctgcagcgcgtgccacactgtgctgagcatcttcccttgcagcctgtgccacactgtgctgagcgtcttcccctgcagcgtgtgccacactgctgagcgtgtaaccctgcagcgcgtgccacactgctgacgccacttcgtaaaatgcgcatgcgccagcccctcccctgagacactccatgaaattagattgggccactccagaggcctctctctgccatctgaataccgccccctccctcatcaagctcctggctgcttaggggcccctgccctgcccctctgccctggctgcccttgctgctgtcctgtgtcccctgccccccaggctgggacatgcgttcctccctcagcctcacagccccctcctttggggctaagcttcagggtcaccccaggagcattccttcaagtacatacacccctttttctttttcacagaaccccgccctttctcccaaattgattttacctcaatttatagttcttcatttgtctttttattgcattattgtttagctcctgagctgtatctccccccaggtacttcacaccctgtgtatgtagcgcccagcaaagggtgctccagacacagcaactcccaggctgagcagagcatctctgctctttgtggggctcagaaagagagaacaggcatattgtgaaggcatgtgtgtgttggagctgataatgaatacctaagttgccattggcatgcatcattggtgtcatgcatgtcagctgcacacgtgcagtcgctgtaaatccccacaccctacctgcctgtgcattcagtgccattgtcacttgcagagaacaggaaataagcagtttaatgttttgaaggacctcttgaagagctgtccttttttaagaagtatagtggtccccgcttctccgtagatgtgtctcaagacccccagtagactcctgaaactgtagatagtactgaaccctgtacgtgctggtatttttcctgtaagtaccttcctatataaagtttaatttatgattagacacagtaagaaattaacagtcactaataataaaataagagtgacttgaacacaagcacagtgatgctgtggccatcaatcttatcaccaaggcgactgctaatgggccagcggcatctgcaacgtggatggttcacatcccgggctggacagcacaagatcgcaccacactcctcagaacggcatacagttgaaagtctggaagtgtttatttctggaatttttcatttaatatcttcagatcacggttgacagtgagtaactgaaacctctgaaagtgaaacctcagataaggggacctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgcactccttcgtcagttggttgggatcctgcggaattgccagtgcatccctgtaaccacgcaggcttgggctgggctgcgtcgacactgagtccgagctccctgaagactgtgctttcttctccctccagctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcaagtatctctagagtgtgctgatttaatctctgtcttgattttgcaatgttttcatcctcatgaatgaaaaaaacaccacctgagctgctctgtggctatcaaaagaacatcagagtccttctaaagagacccaaggtgatgtttctgaggctctccgggccttgtctctagggccttttaagtgagtctctctgtaagattaatctcctttaccaatcacaaacctagccattcatagaagaattgatgggttcacacctgtcatcccaacactttgggaggccaaggcctagtggattgcttgagcccagaagttcaagaccagcctgagaaaaatggcaaaaccccatctctacaaaaaatacaaaaaaatcagccagatgaggtggggcatgcctgtggtcccagctacttgggaggctgaggtgggaggatcacctgagcccaggaggtcaaggttgcagtgagccaagattgtaccactgcactccagcctggacaacagagtgagaccctgtctttaaaagaaagaaagaaagaaagaaagaaatgaaaaatgaaaagaatgaaattatgactgggctgggcacctgtctgttttcctctcactcaggcactgtattcattcctgtctcagcagcagagactcaacagacactgaaaattatgtcagcattggctttcccagactaaccctgagccaggtctccgggacgtttacgctgtcttagagccaccagggtgtccacagcggtgagctgcctagagcctgccctgggctccctggagaggccctgttggctccgagagatggtgacaggtggaaccaggggtgccaatggcaggcagaggctgtctccctggtgtctgcacctaccctcgattcccttcattgctggttttcttttttctttttttagaatttcagtggctaacagtaaagtgaacaggagcttttgaattcaaaggtcctaacttctaagctcacctttatttaaaaggacacagttaaggtatttttatctttttaaacatataatttcactacttttttaaaagctcaaaactaaaaccataatcctaacctgaaacacgtttattttggggtgtgtgtgtgcttgtgtttgtgctgccttgttttctagtgcctggcaactagcacgcctttaatttgagaaaaagcagtgtggaattttatttgaaagcatgcctgtcagagcacatgaaggaggcagggatggggaaaaacagttgtctttaattaaattttacagttccgtaacttaaccattgtgttttaagaaaaacaaaatagataaaacttgatggtaggtaggttgaaattgtagcatcaatgtcttttgaagtattttgttgtgtattggtgtgtgaatttctcatgattcagaaaatttccctctttgctctctgtcttctgtacttgagcaaagagtgctttaattttagctgtcactcatcttttatatgcatagatacttaaaacattgcatgtggaatatgggacacataggtgatactcaaaaatagttgttaattagggccttgttgaatagcgctgtctaagcaatatctcatccgtaactaaaatctgcaaagacagaatcattttgctaaagaaattttctaagatattgaaagtagagctcatttataaaagtcagtgtatttttatcatatttcacttatgtgaaaagcatctatatctgttaaaagaccttgaaagatagtgtctgcaagatagagacttcaaagttactgatgctgctgtttatcctttcctcctcaatatcttctctggtctttttttttttttttttttttttttttttttgagacagagtcttgctctattgcccaggctggagtgcagtggcgtgatcttggctcactgcagcctccacttcccaggttcaagcaattgtcctgcctcagcctcccaagtagctgggattacaggcgtgtgccaccacagccagctaatttttgtatttttagtagagacggggtttcaccatgttgaccaggctggtcttgaattcctgacctcaggtgatctgtccacctcagcctctcaaagtgctaggattacaggcgtgagccaccgtgcctggcctccgttatctctaatcttgatagcctaaagcacattaccaaacccctcccctggtccccgctgcagggggctgtgccgagctgattcagcagcagcagagagagcctgggttggagccatgaggctgcccctgcgtcagctctgcctccttggaagcttctgtgtctcgggttcttcatacgcccagtggcagggatggaccaggcaccccttgcaatccttctggacaaatgtgccactgtcctatgaaaataaaaggacaccactcaagctccaggaggcagaaccttaactcaaatctgagccaataaacaatgtcactctagcaccaaagtctatttcaaaatgcaaactatttgaaatatcttatttttggtaaatgctttattttggaaatgggtttttgttgttgtttccctgaagagagttcagatcagcaaagcaagtagctttggagaagacacctttagacgaggactcctgtgaatcagcaggacagcgtagcaggacattaggtgagccacagggtggagcaggatgggagggcagaggcttctgcttcagaattgaagccgaaggcaagtaatgctgtgggtgttactggagacaaaaggaaccaaacaagaaaaatctggagaggcaaatgttgatgtcttaatagatttgggaggtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcgcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctctcgagctttctcagactttctctcaaatgagtttcacatccagcacttgcaagtttcaggacaattccagcttcttatttatgtccattgatctcctgagtgtgagctcctcagctggcccagtttgttgtccaacgctcactaagataaaccaagaagaaggagcagggtgcccaaatgccgcatgcgatggctctggggaccttgttgacagacagcctgctccggggtttgcagacaaggcttcctatcctgctggttttcatgttgaatgttggcacgaaacgttaacaaacaaggctacatgatggggtagggtccttgtgaagagcttgcatttaggtatctctgggaggacagcacagggacccaagggggctggcagcaggcccaggtgtgtggcaggaagaaggcaggtgcctgctgagctgctatccacccgagaccatttgacattatgggcaggaagagcaagggaagctggtttaatgaggccctggctggagtgagagagaaggaacatcactgtgagagtgtggaaagtgtgtgtgtgtatgtgtgcgtgtgtgtgtgtgtgagtgcatgtgagtgtgtgcatgagtgcgtgtgtgtatgagtgtgtgtgcatgtgtgtgtgcacgctcacatgagtgtatgagagagagagtgtgtgtgtgtgtgtatgcgtattctccaggtaagagcaggcaccggggttgtgggaaagaggtgtcagtaatgtgagtttcctccttgccctggtttctaggaggagtgaacgtgccatgagtcattgtagaagagaacgaccaccaagcttggctccaagtacagaatcattcttttcatctgacaatttttctttccattttactttctgttttcctcccctttgcttttgctggaccgattaaattgtctttcccctttcttccgactggtgggaagttctaaatcttatttctattctgaccagtggttaccccaattttttaaaacaaatatgtttaaatcactttgaaaaaatgttggcatcaagaattaatatttgtaaagatccaaacttgggaaaagctgaaatattgggctcatttttattccacactcttcccatcctcatcttcctagattctgatgacatcatcttgagttttagaaactcattttatcgtgctttttttttaaaagcctttcgtaatgagtcacatagcctcatgatcaacaattgtttagatgaagccgtaagagctcctggtttctcttctaaccagttttctgtagccagtgctcctgcccttaactccacatccagatttatttttcactttgctggaatatatccttaattggggtgacagggtgatttcttggttggttgtttttgtttggtttttggagaaaagtcctgtgtgggtggggccctggatcttgatgttacctggcccttgcctgtgtgccaggtggactggggactgtggatgtctgggctctgccctaccccaaggacacgtcaagacctccatgccacccctccatggtcaccctttgtcacagagccagtttgagtttctttcctttctagaaggtacctccttgttttctctcctgtagcgttacatttatctattttccctaaaattcaggaatttcaacagattaagcctaggtgtgtggttagtttgtttgagtttctttcctacttactaccctgaaccctctgatctggattgttgagtcttcacttctgagaagtttccttctgtcctgtcacttctgctagaagcatcttctctgccctctctgttgtccctgaaaatgctgctgagcagaactcacaggcctgtgaccagtgtctctcctctcatctgatgtgcttttttgactgtactgcattctaagagaatgcctgacttctgtcaccatctcaggagtgaactgttttccccgcggagcaggctccccgggagctcatgcctggcccacttccctgcaccacggccgccacacggctccgtctcttgctctagttctcctttctgggagagtgactccatttggggctcgtcatctctgttgggttttcagtggctgcatttggggttcctcatgtctgttgggttttcagttctccttttgcatactgagagaacaactttctagtgattggaactgtctagaaaagtttcctgaaaggaattgagctcccctgactggaagagttcaggttggaattggatggacactgttgttacggacacggtgataggggatctggctgaaaggattaacccacgtgatctccaggtgtcttctaaactcgagatcctacggagtgcagtttgcttgtttttaaattctctgtgcagatgactgtaatgctacagtacagttaccattacctattgtatcaatgacacttttgaaggtttttaaaaataataatagttacacttcactgactgccgtcctcaggccatctcccgggcatgcatgtgctcaagtcaggagccagattcttacatgcttccctgaatccacgccgcagccctgtgggccgggcctgccgtcacccttcacagtggaagcagccgcagccggcagacaccacgaggcttgcagctcacagccatattccactgtccctaggacaagtacagcttgaacccacatcccacctttcaccaccccaagccttgcctcccatggacgaagacagtgcacgagagtgccttggggctcccccaggagctgcttcaggaaaaggaggagctggcaggatcactgtgagcctctcagccccactcccccggctgctccccttcatctacatccagttagcatctcctgcccatgcagctctctggacatgagcccacctcactcaggaccacagctctgaggctccttccacagctggtgttctaaaaccctgaggtctcctttgagaaaggactgttatgtggccagaggtcctctgtgtaaagccctcagcacctggctggggttagtggacaaccaggacaaggcacttccgagctggcagagaaagcctgagagcagccctggggagtgggctggaagggtcaggagaacccagccatcttgctctgtacggattctaatggcttgtgtttatttctctgtcagctcaagggctgcccttaagacgatcacaatgaaaggctcaaaggtgctctgctctcagcttaaatggcaggttggttttggacccagaggggctcagaggctccctcctgtgttgcatggcctgtatcatcctcactgggggtgctgtgcacagttttccttatactgtaacttatgcccaggtcttgactctttcttatttgcagaataaaggccactttcagtcgagattgtaagtacacattttccttgatccactaatgaatgtctgatagtttctataacatgaacccataataaccctaaaatatccattaatcattatgtatattattcatttttgattaccctactgtatgaggaacctattggaaaatacctttagggtagaaataagaaaaaacatcaatgccagctcttctgagttttttaattgtagcagttattaggccaattcacagtttctctgtgtttttgctttaaaagttctgattcagcacacttaatttacaacaacagagggattctcgttaccagccaagttgttcttgcttttattggtttctgtaccgcggcctgggattaactcattaccctagttccctctttgcaggctggaaagataagcatctcactcacgtcagcccccacactgcactggcctcagggactcgtagacgtatgcgcttatgaccatttaggggctttctgccccagaaaaagcgtatggttagtattggaagctcgggctattttcttttttccttgtttcctccatttttgtttcaagatgggacttgatttaacttaaaatataaaaaatattttgtactattgggatcttatatttttgttaatcatttagttttagtgaaaaatattgtaattctaaggtttaagtatcattcaacagtaatcctttattttgatgagaagtagtggaattgcaaaggaagataatataagcgttatccatttgtttatgaaagattcaattccattatggtcagagattccccagcagtttaaatggacaccctctcttctagccattcccccacaaaagaaatccttcctgattctgtctgcttgaagggtgtgaccttgaacatgctcctggggctgccgcctctacagagtgacagctcagggacctgcaggaactcagaacatgcaggcaggtgctggaggtagggcaggtgtgctggtaagatggatgacctcagttccactggcaaaactgtgccacaggagaaacctgagcgtgtggtaaaaaccaccccagcagcaatcagtaaatgcaggaacagtgacctcaggaagacatgaggctcctaccagtgcctgtgatgaggccagcccagccctgtgtgtggttagggcacacctgaccaccccgacaaccagggaaggacggtgttggagctctgagttcttggcatgaggacatgatcttggctgattgttttccttcagaccttctgcagaattgaatgcacatcaaagaaacaagcagaagaaaccatgccagctacttgtattgaataaaagtattttacttacaaacttggattatcaaacttatgaggaaaataacacaaaagagaaagatctatatgagaaaacagaacaactgaaagaaacaatttagaaaacaagagaaataagtaatgataaatcttattagtatgttatttagtaagtgctgaaatcaaatattaatttgaaggtctagaaaatattcagtattttttgagtgtgcagtgggcatggttctgggtgttgggattttgcagtgcacaggacaaacaaaacctcttcctcatggagcttttgctctgatgagggcagggggatggtgaagtcagataagtctcagataacttggaacagaaaggcagaattatgagacagtggccagggtgctgcccaaaacctacccaatcagaatctcagaggtaggattcaatgtgcttattgtttaaagcttcatatctgattctactgaacatatctgcttaagaactacaaaatatatattggctgtctctgggttttatagctttaattttctaaggtttgtgtgaatttttggaattgtccatagtgagcaaatgttatttttttaatgagaacaattttttttatttttaaattatctttagtgtcttttcacaactttattgaggtataattggcatatgataaactgcatatttaaagtatacaatttgatacattttggcctatgtttaggtctgtgcaaccatcaccacaataaagataatgagtatacttaatccacttcaaaattgtcttagtactccttcataatccctccctctccccgatccccattcccatccccagtatgtaccatctgtctatatagatgagtttgcattttctgggattttacataaatgtcatcataaggtttgcaccgttttggtctagcttatttcactcagtttaatcacttggagattgatctatgttgttgggtttatccatagttcattccttttcattgctaagtagcattgcactgggtggataaaccacaatttgtttttcccttgaaatattgatggatatttaggttgtctccagtcttttaatattataaagctgctgagaacatttctgtacaaatctttgggcgcttacttccatttctctttagtagatacctaggagtggaatggctgaatcctaagataggtgtatgttgaactttttagaaaactattaacctgttttccaaaatggttgtaccattttcacattaccaccactagtgtgcgggagttgtagttctgtcacttatatgccggcacgcagtacgagcggttgctttagaaattttagcaggtgtttagtgatattccattgtgcttttaatttgcattgctctgatgactaatgaagttgaatgccctttcacatgctgatttgccatccctgtgccttcttcaataaactgttcaaaacttatgcacatttttactgagttgtttaacatcttattactgggttttgagagttatttatattttctagatacagatcctttatcagatatatgatttgaaaaatgctttctcccaatcagtggcttgtcttttaattctcttcatagtgtcttacgcaaaccacataattttaattttgacaaaatctaatttatagaaattttctttgatggatcatgcttttgatattatgtctaagaaatatttgcctaagtcagtactacaaagatttcttcttatattcttggaaattttacagttgcagtttttacatttaagactatatttcacttgagttcatgtttgtgtagggtatgaaggatgaactgaagttcattttttggcatgtaagatatccagttgatttagcaccatttagtgaaaggttcctcatttcttcatggaattgccttgtgcccttgtcaaaaatcagctggcatgtatatatacatgtgggtctgtttctggactctgttgtttgcctttaatctctttgtctaaaggccagtattacattgtcatgattactatagttttattataagttttgaggtcaggtagagttagtcttccaactttgtactttttcaaagttgtcttggctgcttaggtcctttttgtatttccatagcaattttatagtccactcatcagttctacatccttattgcactggttaggacctccagtacaatgttgagtagaagtgatgacagcagacatccttctcttacatgtcatcttgggggaacacattcagtctttcaccattaggtatgatgttggctgtaggattttttattgttgttttttgttttagagacaaggtctcactctttcacccaggctggagtgcagtaacgtgatcatagctcattgtaacctgaaactcctgggcccaagtgatcctcctgtctcagcctcctgagtagctgggactacaggtgcatgccaccatgcctggttcatttttaaattttttatagagacaatgtcttcctatgttgcccagattggtcttgaactcctggcctcaagcaacccgcctgcctcagtctcccaaagtgctgagattataggaatgatccaccatatctggctgctgtaggttttttacagatgtctttatcagctcaagacattttttttttctatttatagcttactcagcgtttttaatcaagaatgtgtgctggattttgtctgatgctttttttctgctcttagatgactgttgtcattgcagtgacttaggcctatagtcccagctacttgggaactaaggcaggaggatcacttgagccctggagtttgaggccatcctgggcaatgtagtgagaccccatctgaaacaacaacaacaaaaaatgagatgagcatttagttcatttttcagtttgctagtggtgacgttaaaaaaaaattaaaccaactttgcatcttgggataaacgttatatggttattatgtgctattctttttatatattgttggattcagtttgctaaaatttcatttagaatttttgtatttatatttgtctgtagggatattgggctatcattttagtttaatgtctttgtcaggcataaaatgagttggggtgcatttctttctcttcagttttctggaagagtttgtttggatttggtattatttctttaaatatatggttaaattcaccagtgaaaccattgggcctgaagtttgctttgtaagaaaattctaactacaatttatttttctataatagatttagggctattcatgttatctgtttttatcttttttcttgagtaagcttcagtaatttgtctttcagggaatttgtccatttcatctaatttgtctaatatattggcataaaagcattcagaatattcattttaatatctgtgatatctctaatgatatcgtcttatcccttatattgatgatttgtatcttctcttggttgtttttttctgatcagtctagctggaagtttttcaattctgttcgtctctaagtgccaacttttaggttcagtgatttttgtcttttgttttatatttcaataatttttactctgattttaattatttcttttttttccgcttacctggtgtttcaattgcccatctttttgtagttttttaaggtgctagttgaggtcattgttttaagaccctttttactgcttttgtagcatttaaaaattatgatatgttttcattttcacttatattaaaatactttgtcccttgggttatttagaagtctgctatttagtttcaaaatactagggattttacagagatctttctgttgttggttttttagtttcatttaatgacttcagtccttttaaatttattagacttggttttatggaccagaatatgatctatctttataagtgttccacaaaacttgaaagaatgtgaatctgccactttggggtagagtgatctgtaaatgttgattaggccaagttgtttgattatactatttattttcttttatattcttaccgatcttctacttggtctatcagttattgagaggcaggattgaaaatctcttagttataattgtacattatctatttcttccccttttttagagtttttacttcctgtattttgtagctctgtgattagatgcataaaaatgtaggattgttggtttatcttaataaactgacctcctttaccattatatgatgaccctctttatttctggtaatagtgtttgttctgaaatttgttttgagattaatataacctcctcaactttcttttgattagtgttagcacagtgtatcttctatccctttatattaaagtactttatcttaaaaatatgtttcttatagacatatatttatatatatttatatgtttggatcttgcttctctctcccaccatggacaatctctgccttttcactgaggtacttagaccatttacatttattgtgattattgatattattaggtttaaatttcatcttgctacttattttctacgtgtttcatatgttctttgttcactttttcctcattttcttactgcttttgccttaattgggtgtgtttgatgattccattttgactccttcttgacttttgagctgtaacttttgttaatttggtggtggtttttagggtttatagtatgcattcttaccacgatctcccttcaagtgatattatactacttcacatatagtaaaagaaccttacaacaggatactttcgtttttccatccccaacctttgtggtattgttttcagacacttttgcatgtgttaaaaaaatccacatcttattattttcatcttaataattatcttttaaaggaatttaaataataagaaaaaaacctcttgtatatttatccatgtagctatcatttccagggctcttcattctttgtatagatctggatttccattttggtatcattttttcttctggctggaggacttccttttacattccttgtagcacaagtcttctgatgatgaattatttcagctttggtatgtctgggaaagtattttgctttcattttgaagtatattttgctgtacaaatatatttctgctggaatggcagggtcctttttctcctttaagcactttaaagacattgcttccctgacttgttgtttgcgttgtttccagtaagaaatgtgttgttatctttattcctctgtgtgttttttgctctgggtttgcttaagattttctcttaatactagtgttgaacaatttgttctgttgtgctttggtatatagttttattcatgtttcttgtgcttgggattcattgaaattctttaatccatgggtttgttggtttcatgaaatttggaaattttttattcatctttcttcagatatattttccgttcccccttctctctcctcaccgtcatgaaatctaattacacatatttcaccctacctaaacctgccccatatcactgattttctgttctttttttctctctttgtgtttcatttttggtagtttctgttactgtgtctttaagttcactaatcttttcttctgcggtttctattctgtggttagtcccatcaagtgtattttttatctaatacattgtagttttcctctctagaaatttggcttaggcctttttatatctttatgtctgtatcttctatatgtgaatgtcaggcacttttccattctctcaggaggctgtttcccagccttgattgagtaacatgcctactctgatcagtgctccgcaggatattcaaggacaccctctgcgtatctccagggctcactctgtctgcatgtctcttccttccggtactctgtcttatgaaatctggctgacttggtttcccttgactctcaattcaggggatctgctacactctgcctgggttccttactctgaacagtgaactgtcatctgggttttgatatctctccaagggagggataaatggtcattgaaagcaagtgagcatggtgacggggtgggggtggcctccacagggcacgaagtgagttgtactgagtcatctgagagtgcagtgtgctgcttctggccagtgggcttgacagttcagtgtctgggttcagaatatgagtctgcccatgtctaagcatgttctaaagattcatatcccaaattagttttgattttggtggcctataacatccatgtgatatgaattatcaagctcaatatataaatgcagatacatgtattcaattccgagttatgcaagtgtctttttaaaaactttcaaccctgcagaattagcctgtgattagttaagatgagatcgtttaaacacagcaagaaaataagtacaagggtacttcaaaaagttcataaagttaaaagataaaaaaatgtttaaagatataaacattatttctcaacataagctccatcaaattcaagacatttttgtaagtgctgatcctagccatttagattgtccctaaagaactgaatggtggctaggtgtggtggctcatgcctgtaatcccaacactttgggaggccgaggcgggaagatcatgaagtcaggagattgagaccatcctggccaacatggtgaaaccccatctctactaaaaatacaaaaaccagctgggcatggtggcacgcgcctgtagtcccaggtacttgggaggcagaggcaggagaatcgcttgaacccaggaggtggaggttgcagcaagccaagatcgcaccacacactccagcctggcaacaagagtgagactccgtctcgaaaaaaagaactgaatgtcttgggagtttaaccatgtcagtgcagtctttcttacattagtaactgaagaaaaattccttaagcatgccccttaaggaatttttgagattaggaaacaaaaagaagtcagaaggagccaaatgaggtggatttgcaaccaccataaggtggatggctcatgatttcctctcgaaaccctcacacacttgcccttgtttgatgagaggaataaataggcgctttgtcatggtgaaggtctctggcgaagcttccccagggggtttctgctaaagctttggctcactttcttgaaacactgtcatcataagcagatattaccatcctttggccctccacgtgaacccaacaagcaaaacgccttgagcatcccaaaaatgctgccatggcctgtgctttggccagtcagcctgtgctttgactgggccccttctgcctcttggtagcctttttttttttttttttggattatgcattttcttcaggattgtctttgtaaaagctatttttatctcctgtttgatgtttgttcttgcttcaattttagcagaagtcatgtagctctgataggagcgcttttcaaacagatgtcttaatcttcttagtgcctcaaactagatcctattcagacatgtttcagcaagttagtacaagtttattttggtgccaaaaaattttgaaatccatgaggttttttcataataagcattttccatgaactttttcaagactcttgttaagaattagggtttcctattgcatcatggatgtcacacatgcaaagccacgtgacctgaacatgcctggcctctcagtggcaggggagcacatgcaggcatgagcgccagaggtggtgtgatacaggagcaacccccacctgcacgacctcatgggaccctgcattagtctcagaagtggctcccacccatccactctcaggctgccaaggttcctggctccgtcagtgccagagtgagaaaagacacacttgtcaggaagtctcatgatttcaggtttctgtcaatcttctgcccacctgccctgtcagacaagtgcatacccgtgggtcagttctgctttctcagcactgctcctattctggtggccgtggaagagtgtgaggccactgccacggcagatgcacgctcaagtctgcgtatattcctcggcaggcagaattcccccaccacgcacttctgtggccatgtctgagcacagtgtgccgcccgtggctgctccctccctgggggtgaaagcgggcttcacaccaccttcctgtgtcttccgtttcaggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggtactgaggcgccctcaccgcaatgcgccggctccacctccccaatagcttgtctgtcctcacacctactgttccttaagttgtttcgtcatgtcatcatgcacagcttccgaaaacgatcacttggaatgattcttccttcagattgttttagcttagaagtgtggctacgtccctgaaaccttaatgccatctcaaaggcagctcttttcctccctgctgcagggtaacacccactgccaggccactgtgtgtggtggaaacgtctcttactctcagatattgaaagtcattatgcaaaacgcagggccagtcaccctgctgtcccctccttctcagcaacataaaaattgcttggattgtgataaccctccagtggagtttttaaaccttttgaattagctgtggggcccttttttccccagaataaaactttatatagtaagtcagggtattactagtttgtgtgtattcttcagtcaagtagatggcatctgtttattctgagaccagcattgtgcactggcatgggaggtatagccagaagggacagtgcccgggagggtcctgttcaccaggggcagcacccaggccagctgccacaagtccaaggtccacacagaaggagttactggccgcatgagggaaggcctccgaggtcatcagggtgatgacacacataacatccgtggtgcttcttagagttaaaaatgaaacgtgaatccactattggtggtttcccagaagcatgtcttcagaactcgggggtctgtagctgcctgtttgaccagcaagactggaacttggcaataactcagcccttaggagacgccgcaccttgttctgtgtgaagccgttcccttggcagaaggcgccttcctctgggttgctttccccccagaagccaatgcagttctgaaggccatgttttggtatcttattaggtgttgttttcatctgttacagcgtcaacagttgcatttgtttttttatcccttcacaggttccctcccacttactacgctccaagattaccaaacccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctctctgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcacgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctagaacatctgccccacagcagcctcctcctccaccgaagagggtagttgtctccctgaagcagtcacagcaggcgtctctgccgctccgtcaccacagtggggttttgttcaggcagatcgcgctggggttctgcacctgcagaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctattcccaagccgtccaggcaggaggaaggcagccaaggcaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttcggggagccctgggcggggcggctgttggggggaactgggttcggggtgccctgggcagggggctactggggggcggctgtgaggaggagttgggttcagggagccctgggcggggtggctgtcggggggaactgggttccgggagccctgggccggggcggggggcggctgtaggaaggaactggtttcggggagccctgggcggggcggctgtggggaggaaggtgacgtgcaggggaccagaggctctgcactgctcctaggacagctcatctgtaatcagaaaaaaaataaataaaatacagaacgctgactcctccgtgagacagatcggggaccttagcactttaatccctcccttctgagcgctcggtgtgcacttttagactatagctgtttcattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgacaggtccagatggatgtcgtcaccaccttcctcagctctcatcacctggtcgtacgccaggcccacctcttcccagcaagggacgccaaagaactgcagtttttattctgagtcttaatttaacttttcatcatcttttcctattttggagaattttttgtaattaaaagcaattattttaaaatgtgcaagccagtatctcacaaggcatggatttctgtggaatttatttttattcaaataaccatatttatctccaggctgtggaatcgccactttctttgtgaagacagtgtctctccttgtaatctcacacaggtacactgaggaggggacggctccgtcttcacattgtgcacagatctgaggatgggattagcgaagctgtggagactgcacatccggacctgcccatgtctcaaaacaaacacatgtacagtggctctttttccttctcaaacactttaccccagaagcaggtggtctgccccaggcataaagaaggaaaattggccatctttcccacctctaaattctgtaaaattatagacttgctcaaaagattcctttttatcatccccacgctgtgtaagtggaaagggcattgtgttccgtgtgtgtccagtttacagcgtctctgccccctagcgtgttttgtgacaatctccctgggtgaggagtgggtgcacccagccccgaggccagtggttgctcggggccttccgtgtgagttctagtgttcacttgatgccggggaatagaattagagaaaactctgacctgccgggttccagggactggtggaggtggatggcaggtccgactcgaccatgacttagttgtaagggtgtgtcggctttttcagtctcatgtgaaaatcctcctgtctctggcagcactgtctgcactttcttgtttactgtttgaagggacgagtaccaagccacaagaacacttcttttggccacagcataagctgatggtatgtaaggaaccgatgggccattaaacatgaactgaacggttaaaagcacagtctatggaacgctaatggagtcagcccctaaagctgtttgctttttcaggctttggattacatgcttttaatttgattttagaatctggacactttctatgaatgtaattcggctgagaaacatgttgctgagatgcaatcctcagtgttctctgtatgtaaatctgtgtatacaccacacgttacaactgcatgagcttcctctcgcacaagaccagctggaactgagcatgagacgctgtcaaatacagacaaaggatttgagatgttctcaataaaaagaaaatgtttcactactctggtgttgctgagactttcttttcctttcaaattatttctgcccttggctccactagcaggcctggggatggacacccacatgcataacctgaaaaggtggctgagtcccgcccaagagctgcagctctgcctccacgtggtcttgtcacctgctgtgcttgcaccagtgctactggaatttccccaccttgggacagtctcccctcagtccccacccctgttagattcttgacttcactgtcttcctggagagcgtgttggcgcctctcctatatataaggtggtgtagaggaaaagtaggcagctgccccactcccatcctgcatataaaatggatgttgacacatgcccgtgtgactcgttaccctcacgttacttgtggctagaacacaggaagaacctacacactcaataagaggcaagggtgacacgggtgctggggtgcagtgaaaaaaaccaggtgctaagtgccaccatagaactatgttatttctaattacaacactggaaggacagtcacaataagtggaaagttggcagcaaagcggcatttccgtgtcgtggctgtaacagtgtatatatgcttcacgtactgtacaagcacaggtgggccaggctgtctaagaagggagtctggccgtggtctgtggacatgggatttgagatggttttgattttgtgttcttatgtgaaaagcatatccgtttgtctgatgtttctacaattaaatgaaaaacaaatataggaaaatattttgaaaagtcaaaagcatcatacaagtaataaaaaaagcactattacagacaggtaacttgattttctcatttgcatcaattttgaaactatttcatttcccacaataaaaacgttaaaatatgttgcagcaaaaacaagcttcagagaaaagaatgaagggaaccctctccctgatgagtgaatcctttgaacagtgattcttcgggagctgcctcgggggccacaccagatggaatactcggactcactattctgtcatggaactggggaaatgtccgaatttgaccacgtaagatgaaagttttgctttttacgagatactgtatagtgaatctcgtagagcctggctgtaaatgttgaggttctcgagcttttattcagtacatgcgtaatgaaggccgacccggaaggcactatttcaggtgcttggaacaggtcggtgaacacaacacagactcccccccaaatagctgctgctctgcaggaaagcaaataacacaccagacgccagtgtcagggaatggtgcctgggaagaaagaaaaagcaggtgaggatagtgcagtggggcgggctgcaatggtaagtactgggatcagagtagcctcacagagaaggcttgcaaggcagatggtcagccagagggggcctggcgagcccggggcactggaccaggcatcagcgtgccactgctggaggctgcagtgccaggaacctggcccaccagtaggtgaacgcagctgttatttaacgtcacatttgataaactcagaatgatattaaaaacaaaggtaaacactcgaaactcgtcacttcctactttttgctgcattttactgcaatctgtgttcttactgtgtgcatactctgcaatggtgggcacgcccctcctaggctgcgtttgggaactcacatcagtagcttggaatcagttgtggtgggaggtttcacaccactggtacccacagacacggtgactcaaggcttgactcactgttgtgattgtctctagacctagcaagggatggaggaagatgcagatcaaactgcaaatgtagctgttacattgtgaatggcacagaaaattgaagaaactgtctcacagcctctggaaactgttatctacttaagcaaagaagtcactcagtcactgaacaagtgaagctctggcattcgtcctgctgcttcgccttcatctgactcatcggtgaaaacatccccagcattcttgtcagaaccaca

SEQ ID NO: 16958 - DNA, 156895 bp, Human; identical to SEQ ID NO: 16957
  misc_feature (1)...(156895): n = A,T,C or G

SEQ ID NO: 16959 - DNA, 156895 bp, Human; identical to SEQ ID NO: 16957
  misc_feature (1)...(156895): n = A,T,C or G

SEQ ID NO: 16960 - DNA, 31713 bp, Human
ccactcctcgcagtcctcaatggaggtttctgtaagttcttcacgagtctcctggctcttccctcagagcagctgcctctagattacaactgccaagtgctgttggtggcagaagccctacctccccactccgaagcagctcctgcaggaaacctgggccttgtgtggctggggaactcccaggactcctgccacgcagggggacccgagggcagcttgggcaggcccctcgcggccgggggcggattcgctcggctacacctgaccggagagacaggtgagggactggtctttgtgggtcctgcggggtccccttggggctgtggctccctgccttgctgtctccaggcgggaagggggtgggagccatccttctgtgggaaggggtctaggagccccgctgctgttcatccccacttcccctcggcttcctggcctgtcctgcgtgtaaagggagcaggctgccctggcgagctggccccatggctggctcctctctgcctggagggaaggaagggcccctcctcctccgcgttgcccctcctgtcttccagcagggccaggttctgcccacccgtggagaaggccagtacaggggagagagccagggctcccacaaagcagggggtccctccaggtgaggcgctccatcctgtagtgttcccttaaattctgcaagctaccccagatcccccatttccagccaacaaatcctttttaagttcctttgagatttgttcgtgtggcttgctacactcaggactctggaaagaaggcccaggccagagctttgggcaggcggccatttagggcaagggccctgtgttggcttcctggtggggttgccctgctggtgggcgggagaccaagagcacccccgcaacaccaggaggcaggtcgcggattgtgctgtctacactccggaaggggtacattccaggggctgctgccccagactcacccctcgcctgggacccgcactcttgagctgtgggtaccacggtggccgtccccttctgttctgtgcagtggacttcctggctcctccttagccttggggcccccacagccctcggcttggcttccctccccatagccaggccctgggtaactccaggggaaagtgaccctgaggccccccacttctccccgtgtcctgcacaggccttgggctttcggcggtgctgtctgccgcagccccacgccttcctgggagagtggcccaggccccccttcctgagtgtgactgcgctgccgtctgcgaggcctgcgcgggtctcccccgggctgtccctgctgggatggggactggtggccccgggccacgtcctggatccggcttgctccttggtacaagcccgtacgggtcacggtcaggcaggagggcgggcggcggggtcccgggggcgccgagttcggggccgtgcggtccccaagagcaggctgtgcgtgtccctgttggagccccacgaaggcggcccagggccacccctgagggcgcgtgggcccgacccgcgtcccggatccagcttgcggccaggaatgcaggtgttccagggtgccaaaaggaaaacgcacaaggcctcgtcgaggagggggggtcaggaggggaccgggggtgggaagaacgcgggggagagggatggcagggtgcccgcccgagggaccgacacctccgcgagtggcaccccaggatgctgacgccggcgggggtgggggcccgaggggcggtcggggtcagggggcggccccaggggtagggccgcagcacgaggggccgcgtgaccccggcggtgaccgggtggggagaggccggcgccggggctgggagacggccgtgggtgggagggtgccccgtggggacgctcctgccgcagcgcccggccacgcgcgaggccccgccctcaggacgcgttcggcgggacggacccgcccaccccgcagccgcgcgcccgccgcgccgccttgtgggcgctgtagtcccggagtccgcgtgcgcggggccgggtccgggagccccagggcagccgccccgccgagtcgcaggtaccggtggggaacggggccacggggccgcgtgtcgggggctgcggggtgtctcggggccctggggtgagtgcggggcgcgggccgaggtttgcagggccctgtgaggtgagtgtgggggctggcgctggggtccgcggggccctggggagggtgcggggcgtgggccggggtctgcggtctgcagcctggggtccgcggggccctggggagggtgcggggcgtgggccggggtctgcggtctgcagcctggggtctggggggccctggggagggtgcggggcgtggccggggtctgcggtctgcagcctggggtctggggggccctggggagggtgcggggcgtgggccggggtctccgcgggggtcgcggtggcccgggcgcctggcagaaccgttgctgtgcagcgggtttcccgccgctcgctttccgccgcagcctgcgaatggggtggggagtcccggcccccagcctgccctccgcgtcatcctggggcgccaagtcccacccccgggtctggaggaaagcgtggatccggcgttcgcgcccaggcacgtgttgcttcgggacgggccagccggtgggtgaaccctgccagccacgcgtggggcgggcccctggcacatctccagaccattgtctcctgtgccagaagctttgtaggtgcaacttccccttggagcagctgtgggtgcggatccagcggagcaatcccgaggcgtctcagagagagcctggacagccgctggagcctttcccgagtgggtccttccaacaccgctacagcaggaaagccatccccctagggtcctgtccatcggaaactcctgtcctggggagtctggcctgcctggcctcaggacacaggccaactaagctggccccgaaatccagaatgcatccagagggaaggtgggataaagtccttggaggcgcctgttggccgccctgtaaagaggtggcctccccctacggagacccgaggatccccgcacagcccagattcaatcagcagagccgaggtgcctctggcccagtgcacctgcctgccctgtccaggcctgggagccaggctgcatctcactggccgcctttgcctgggtgccacctgtgcactgcttgttgcaattgctaattgctttctttccgaaggggctttggtggatttttataattccagatagtacagttatctctgctggacacagatgagaaagagtgcttctcgggtgtttgggcctgcagcagtgatagccggagggtctaattatgctgttaggaaccctgaacttggtcatctgaacaggggtgggagggtgtgcaatgctttcttcttcttcttcttctttttaaactagcaggcgttctaaaaaacataacgaacattcttggttagccttccagagtaggagctggtttaaacacggaatgataggtggcgtttgcttgtgttttgattgcgggtctctggccttctctggtgcttggaaggacagggcctgggtggggctggtcactgtggacagtggggccggggatttgcaggggctgttacaaccttctcctgaaggcagggattctctctgcttccccgtggccctcctgtctggtcggggacttccttcagatgccgggaagaggcctcaagctgtatgggactgggctggggtctggacacttggagtctaggcgtcccctggcttggggctgcgtttctatgatggtgaccaagttccctatctttcctcttggaggtggtctgggccgtgatggccaagcctctgtcagtgggctacgttcacggcacataagttgagtatgctggcagcagaggctgactgttaagaccagcagcagccccttgctggcggagactctggctgtctctccaaggaaggaatgttctggtcgcttctggaggtggcacctttcagaacagggggcccaagtacccagggctcccgggcccctgggggtcctgtgggtggggatctgactcctgcggccatggactgtgggcgcagaccctgggcttagttcagctcctgatggctccccgttgtctgcggcgatctggttgctctggttgtctggggatcggtgcgcctgtctaaacctgctgacaggtgggaaagtgaacttgacagggagtcccagggccaaatgggtctcccagtggggaggagtgggtgcggtctgaggtatgtccagctctacccgtggcctctctgggcatcagggtccctggtgatggagcccaacctttgtgcactgatcttcccagctgttgacaggccctgaggaggcgtggaaggtgaggccgaggcaggcgaccgtcagatctgcctcggcctggcagtggcccctgcctgcgcttcctcctgcctggccggctgttttcatcctggccctttgagaacttctagggtcctggctgcctccaatggagggtgctggtcccatcttcttcccagctgtgccctgccgtggagctccggaaacctcgaggttcccctaacccttccccctcttccctgcggcccccattgcaagcccaccagcctctgcctcttaagggcttccctgccatcacctatgttcctttgtcacagacatgagtgtgtagaggtgtcaagacgggaccccagatgatgctgatggctttgcctaagtggcctggggagggtctctctctctggtccctgaaggccacctttttcctaagcctgtgtgtcaggttgggggcggttcagggagcacttccagcctgagtggtctctgatacgtgaagactgaatgctgagagcctggggcagattttcctaggggtccctggacccccaaagctggccccacatcgagggatgctctgagcccctgctggagggttggaggagacttctcaaatccagaccctctgcagaccccctgccaccctcccaagccggccctgtggcgaggcacaattgtccaactgtcagcccagtgcagatgggacggcgaccccgccccacaaggctgctcagctgccctctgcatgcgctgcatccccaccccacctgagcagcagatggcctttccacgtgcactctgccaggcctggcctctgggagcagaggtcagctgatacagacgtgaggtgcacctgtgggggaccagggccaggtcctggcctcacggggttggcttggtgtgggcgtctgacacacttgtttatggcagttcacttttgacttacttgaaggagaactttacaccgaggccttaatggaaaaccagggccacgtggcacctggagacatgattctgataagtggacaggcttttgccccgcagctgaaaggcacgatttgtggtggtgagacgtgcccttgcccgcaccggaggagcctttctcctgggcagaatcaggactgaaagagacacgccctcgagtgtgcttcgtgctgctgctgctccaccacgtgccctggccgtgtggggcgggggtgctggcgggatggtccccaaggttgggtgcatgttgcctcgtggatgaagtcctgtggtctggggtgctccatctggaacgtgtcaggtccactcatggctcctgccagctgctttcgtctagggtaacctgccgccggggatgctggggtccctgggctcaggggctgggcctcggctccatcccatcctccctcccacgcgtgtttcacccctggctgctctcagccccctcaaggacacctgcttttccctctgcccttccctcactgtgggcttggcctgcacgccctcctgccagggcacgcggctgatggggacctgaggctggtacctgcagccacccgccgctggccacctgtggtgtgaccccggcctccagcagcgtccgttcctgcctgtgccctccctgggccacctgggtgccgctagagcagcagcaggcacgtgggctgccctcaggcctgtggggtgaggtgtgccccctgaccgccacaggtactgcccagcagtgccatgagtctagtgtggccccaaaccctaaattttgttagtttagttaataaagtaagtcaattagttaattaacttggttttgattggcacttaaatcactccatgtggctggagacttccctcagcctcggagaccctggaggtggtgacagcctggcctgggggactccggagcagctcaggtgtgggtggctcccagtttggtgctacggggtgaggatgggtctggggtctgcattcgtctccagggtggcgtttggtcctgagtggcgaggaggaggccggcactgggcctcgttttgcggggtagggaggcctgcagaccatcttccaaggtgccctgactccacccctccttccaggcacagcgtcaccttcgtcccctccggagctgcacgtggcctgagcaggatggtgccctccagcccagcggtggagaagcaggtgcccgtggaacctgggcctgaccccgagctccggtcctggcggcacctcgtgtgctacctttgcttctacggcttcatggcgcagatacggccaggggagagcttcatcaccccctacctcctggggcccgacaagaacttcacgcgggagcaggcatgtgggtgccggggtgccgggcggccgcctgtgggtgggtgggcggggagcagcgtctggaataggcacgtgggcgccgggatgcgggggcggccgccagtgggtgggcagggagcagcttctggaataggcacgtgggcgctgggtgccagggcggctgcctgtgggtgggcggggagcagcttctggaataggcacgtgggtgccggggtgccgggcggccgcctgtgggtgggcggggagcagcttctggaataggcatgtgggcaccggggtgctgggcggccgcctgtgggtgggcggggagcagcttctggaataggcacgtgggtgctgggtgccagggcggccgcctatgggtgggcggggagcagcttcaggggccagggcgcttttcctgttggatgtgtgagcacttgaggctggagcgggtgagtggccgtgtcagctgataatatggtcctggagggaacccggctggggtctcacactcccagcagcgggcaccatcagatggaggggcctggcttcggcctagtaaccaggctagataaaaagtgatattgtgtcctgcagagagagagcctgccccaccccacccgccaggccgtgctcatcggccctcctggtgaggaagcccacgtccaaccctgctgggcacctgccttccacagagacttagtggctatttacctaaagagattattgaaggaattttcattttactcagccatgaggacaaagggtcttattgaaactgttctaataggcttatgcccagtcacgggtctctcaggtcacatgagcggtggaggcgggagcggccgtatccgaagcagtttcctcctggagctgtggggtccttgtccataaggcacatctgcacaggaagagcctggaaaagcgctctcacaggctgccagcccagctggtcaccccgacaccccatcccagggccctgggcctgctcacctgcccatcccagccgctgaccccgtcctctgctcccacatggctgacgctcggcatgcctcttgttccctgtgtctcctggccggaagccggaccccaaccctcccagaccctagaattgtgaaactgatgtgcagccgaggagtgtgctattgggacagtggaggtgctgcccttcccgcgtgcccagctcagagcaccgtgcggtgtgattgtgtctcgtcccacggccagcactgctaaccgccaggctgggtcactttctaggcgaggacagggtcttgccctggctccggctgtcggtggcggggctggggctggagcggcggagccatctccttgacccctcatgaaatgccttctgctcctggccagtccgtccctctccctgccacccactgaccagatggcatctctgctcttagtggagggccactgtccaccgccaaggttatttataggggtgagcattatgtgtggcgtttcccttaaaataacaaaataagaaaagtctctagagcaaaaatgtttaaatcccatctgcctgccctctcatgttgtacattaacggattaaaaagtagattccagaaattaagccattccaccaggccttggatatcatcagagggacgatgggtgcaggtgctctgcgcacctgccacttggtggggcccccgatctcagcccctctggctgcaggagaggcccggggagagcttcatcacgccctccctcctggggcccgacaagaacttcacgcgggagcaggcacgtgggcgccggggtgcaggggcagccaccagtaggtgggcggggagcagctttgggggcaagggaggcccagcctgccaggactcgccagcccctgttgttgccaggcttgtgtctaggaagttcacgtaagtggtgtcttgtgacccagctttcgcaagttgctctcctgcccaatctgacttgagagacgttccacgtgggttcgaggctgttcttaagctgcgcctcctgggttgaactacaaggtgcttatctgctgctttgctggaggtgattaggggattccggcttctcccactgcaggtgatggctgcaggtagagcacgagccggcagcctcaggcagtgggccttgacccagctggcccgggctggcacttccagttcactcctggggcgaatgctgcttcctctgcagcctgccacgggctgcccacgttcccctcaccagctcgggtgggctgctgagcgccggccgtctggccgctgtgaggagcgtggtttcctttgctcacatttgctctgccgccatttctcccgccgtgggccagtgtttcctggcagccctgtggttgctgtcctcctcggacctggttcccttttctgcctcctggggaccccgtgcccttgggattggactggttgtgtgttacatacggtgtttctctggagtcattttgaatttggccaaatttccctccagggtttctgctttgagtgtcagctgagagcgctttccccggccgagtccgtgaggtgctcctgggtgcactgaggttgcctgggcccccgctggaactgtgctgtgtggtgggagctgcagcccccgccctcctccagggagaccccccggcccaggaccctgtgcacagcagtccctcctgacctgcggcccatgccccgtccccagccagcccctgttgggtgcccttctgtggcatccagtcctgctgccccacgcctggccctgccctcgcgtcctgcctgccttcgggccttgcccaccttcccgcctccctgttcagagaagccgccctgaggccgtctggacgtagatttgggcgcagctgcctgcactctgcccattcagcctggaccccaaccaagacctgtggagagcagggccgacgctgggctcaggcagcaggaggctgtcctcgtgtcagagtcgtggccgcctgacagatgccacctccctgctgggaccgttgtgagggcccctcccccagcagccttgtaagtgggacgcaggtcacagctctgggcagagcctccctgctgtctgcctgccaaggctgaggaagagggagtaggggccgttgaggaggtgcagggagaggagcgggagggctctgggtggctgccaagggggagctctgcgctcagaccctcaactaagaccaggaggtgcctgatgaggccccagcctgcagagccagctcctggtggaagaggaaatgaggcatgctccattcattcggaggtgggtgaggcttctaggacccctggccgcccttttccagagagccgtggggtctggggagagcctctctgctggctgtctaccattttgactctgggctgtgggcagaacctgtgccccggccaggggctggggctgtcatgcccccacgcagcctcctgtgtctgggggtcgggggtccctgaggtcctaggaggacccctgcctctgagccgcttctttcggaatctgcaggggttccctgggctggccctgaggaggagcctcccccagtcgagcaggccatcagccaggagagcttgcccacagaggggctgtttgatgtccccaggacattgctgtaaacacagtgcagaagccgatggctggccctgaggctctctgtgacccggcgggctcactcagcctcctggcacataacctgccctcagagtgtcccggaatgtcctgagcaggacggagtgccggagggaccttgggtgcctggtgctgctgggaccacagcctttgggtcagcctggcctccatgagggtgcaggctccagggtgcgacctcagggtgccctgaggtggggtctctgggcagccttcccctgagcccctgggaagcttctcagcatgccggcctggctgcagggtcctattgcccagctgttcacagtagccggtggccgggctctgagcacatcgggccacacatcttgggtgtgccagacacgaggctgagagcccccggggaggcggcgtggctcggcgcagcaccccacgtgctgacccagggtttggtcctgccaagtgtggctggcaggggctgaggtcacctggggcagcacgagtggggctgtggggttactggtggtcaggcctgagtcgggtggggcctgctggaggcccagagtccagcagggccctgctggctcatctggtaccaacctccagtggatctgaggtggggtctggtggggcctgtgggcggggccacctgctgaaaatgcacctgggccccaggggaggctccaagcatagggtggctcccacatcagtccccagggaggggcaaggcaagcggcttggcctcacaggggtggggcctcttcctctggactgtgcccaggtgtgcccaggtgtgcccacagcagccctggcccctgccaagacaactgaggacgtttggtgcctgcctgtagtagtctggggcagtgtcctctgaccttgtcctgtaggaggtagcacccccagccccatgcccagcccacgttcccatggaaggtggatgtgtgttgaggccacaggcatggaagccaggcctggagtgtccaccagcagctcagtggccaaggctgtggagctgggttcccacataacatgtgatggaggaggtgggggtgggcaggctgacagcctgtgctccccctcctgggagggtgcagggcggctacaggggcgtttgcccccctccctgctcctgggttggagtctggccttaaagaccttgctctggggacaagtgtgagatgggagtgtgcagcccagggccctctgccctaccccacttcctctctttccccttcttccccttcctgtctttcttcccctgccgggttcccccacgaacagtccctcccacgaacctgctgtccctgatcctgcccttcctttctgtgtcttctgtttttgtctctctccaggaaggatggaagaagcttgtgctggtgtgaatgtgtatgggttacagctgtgttttccatattgtttaaaatgaaataaaaccatgttttgattctattaaaaatagagaagctggctgggtgtggtggctggtgcctgtaatcctagcactttgggaggctaaggtgggcagatcacctgaggtcaggagttcgagaccagcctgcccaacatggtgaaacccccatctctactaaaaatacaaaaattagccagacatggtggtacgcacctgtaatctcagctactcgggaggctgaggcaggagaactgcttgaacctgggaggtggaggttgcaatgagctaagatggtgccactgcactccagcctgggcgacagagcaagactctgtcccaagaaagagataaaaatagagaagcttagatgaacaggcttgttaataacgattccttctgtggccactgccagctttccgcaggcgaacgctcccaggctgccgggacggtcgggagccagaggtccctgttcagagaggacgatgcagtgggacatgggacaggggcgtgttggggagaggggtcccaccaggcagtgttggggcaggaagccgtcagcagccatcacctcgggcgggctgtgtctgccgcagcggcagcattgctaacgcctggtggggcgcacgcccgcctgtccgcaggtcacgaacgagatcacgccggtgctgtcgtactcctacctggccgtgctggtgcccgtgttcctgctcaccgactacctgcgctacacgccggtgctgctgctgcaggggctcagcttcgtgtcggtgtggctgctgctgctgctgggccactcggtggcgcacatgcagctcatggagctcttctacagcgtcaccatggccgcgcgcatcgcctattcctcctacatcttctctctcgtgcggcccgcgcgctaccagcgtgtggccggctactcgcgcgctgcggtgctgctgggcgtgttcaccagctccgtgctgggccagctgctggtcactgtgggccgagtctccttctccacgctcaactacatctcgctggccttcctcaccttcagcgtggtcctcgccctcttcctgaagcgccccaagcgcagcctcttcttcaaccgcgacgaccgggggcggtgcgaaacctcggcttcggagctggagcgcatgaatcccggcccaggcgggaagctgggacacgccctgcgggtggcctgtggggactcagtgctggcgcggatgctgcgggagctgggggacagcctgcggcggccgcagctgcgcctgtggtccctctggtgggtcttcaactcggccggctactacctggtggtctactacgtgcacatcctgtggaacgaggtggaccccaccaccaacagtgcgcgggtctacaacggcgcggcagatgctgcctccacgctgctgggtacgcatgccctggtccccgaggcttcttcccgcagaggcttcccgtccacctccgcctgccccgtggatccttcccccggaggctccctctcccgccccctgccccatggataccttcccccagaggctctccgccacctccccctgccccgtggatccttcccccggaggctccccctccccgccccctgccccgtggatccttcccccggaggctccccctccccgccccctgccccgtggatccttcccccggaggctccctgccacctccccctgccccgtggatccttccccggaggctccccgtccccgccccctgccccgtggatacctttcctcagaagctcccgctacctccccctgccccgtggccccccagggccgctgcaacgccccatccctcccctctcaggcgccatcacgtccttcgccgcgggcttcgtgaagatccgctgggcgcgctggtccaagctgctcatcgcgggcgtcacggccacgcaggcggggctggtcttccttctggcgcacacgcgccacccgagcagcatctggctgtgctatgcggccttcgtgctgttccgcggctcctaccagttcctcgtgcccatcgccacgtgagttccagaagggtgggaagccgggggcgggcaggcgccaggatcaagccccgcgcttcgctgggtgctcccaccttcctgctgcgccccagcggctgtgccactgctggccccgccagccacctggagctgaccagggtccccacttgcctctccctgggacctcgggcgtcccttcctgtgccgtcttgctgctcccccaggccctccacgctcctctctgaagcctgctgggctcacagccttgccctgctcccaaccccaccctctaggccccgggctgctgagaccccatccaggcaggagcgggagcttgcacctgtgtgagttcatcctcagcttacactcacaccaggcactcacaccacacacacaccacacgctcacacatggacacacacacactcatgaacacacaccacatgcgcacagatggacactcaccacacactcatgaacacataccacacgtgcacacatggacaaacacaccacactcacacatggatatatcgcacatgaacacaccacacacacggacacacaccatgttcacacatggatatatcacacatggacacccactacacatggacgcaccacacacacacggacacacaatgcacactcacatgaacacaccacacgctcacagatggatacaccacacagacacaccacacacgaacacacaccacatgctcacagatggacacccactacactcacatgaatgcatcacatacttacacatggacacacaccacacacacggacacccaccacactcacatgaacacactacatgcttacccatggacacacactacacacggacacacacacactcacagggacacaccacatgttcacagacacccaccacactcacatgaatgcaccatatgcttacacatggacacacaccacacagacacaccacacactcacatggacacaccacacactcacagatggatacaccacactcacatgaacacaccacatgcttacacatggacacagcacacatggacatgctacacgctcagatggacacacaccacacggacacacaacacatgctcacacatggacacacaccacacgttcacacatggacacaccacacgtttacacatggacacacacgttcacacatggacacacgctcacacatggagacacccacacattgacacactcccaccacatactcagaccacacacactgacacactcagacactgaccctgtgtgctcacagggtcctgctccctggacctgccccctctttcctgcccgctgggaggactttggccccagctcagttccccttcctgggcttcccctccagggtggcctccgagccctatctccctccctccgtgggtcatccccctgggccttatgctggtcacgagcctgtttgagctgagagcaccctcctgacccttgcattgggccctctgtgtcggtggcctcacccctgcagcatcctgcctggatgtgcccggccctgtacctccccatcctccccacatgcaggcagcagtctcccggcatgggcagcccggcccacccctctctcccgcccctgccatactcggggccccttctgctcctgtgtggccgccttctccaggctccccgaggcccacactgggctcttgccgtccctggctcgtgaaggcccagcgtgatcttgcttgggcccccccactgacctgccagcactgtggaaagggccagggcctctgccattgtgctgtcccattgctgcagccagggggacaacgcctgaaaggttttagttataaagtcattgatgcccatcgcaaaaaaatccaacacggtgcagcagcgtgcaaagcagaaaactgctgtttgctacggggaatcccagcattttctgcttgtctgtgttgggttgatgccagacacagatgcagatggtcactcacagatgcaggtggtcactcccggtcatgagtggtgggccttacaacccatccccagtctatgggtaaagtcaccatttccatttttcttacacgaggaaaacactgagatgaatgcccttctacctacatttttgtttccaaattctaataatgaccctcaggtggattcctggaaggggaatggccaggttggagagtacgtgcttttgaaagcaggtttctgtcaatattgcaggtatcctgcaggccggcatgcgggcttcctccccgtcaggatggtggagtggcctccccaccctccctgagcccctgacgggccggctgggctcccagcctttccttaaccagagtgaggccggccggcctgctgtggactgagtggcccctgtgtgtctcctgactctgttgggactcgctttcctccctgctgatctggggagcattcatctgtatcatgtattttcaatcacctgtgcccccatcacgccccacactcgtctgcctttaattcaactcacagtgtttctgagtgtccttggaagcaccctgggggctggcctgggctctgccctgcccagcgctggcatccagaagctcgtgtttgtgctcagttctccctgttgttcgtctgcccttcatcccactgacctgctcaccgggacctctgtgtgcttctctcgtcctccctgctgccggcctgcctgcctgcccccgagcctccactgtccccactgtccccccgtctccagtgcccagcagcacagacacctctgcccttctccaaagggttcctgggcatttttgtttattttttcttcaggtgaactttaggacattttttgtccagttcttttttttttttttttttaagcactttgcagattttaattggaactgcatcggaagactagtttctttgcagagcaccagaagcctggcgtgtcacctctccatgtcaggaatgtggtgccttcattcctggacatgttcatgccaccgctcacctccagggcccgccctgcctggctgccactcacctccagggcccaccctgccctgctgccactcacctccagggcccgcagtaactgactgccactcacctccagggcccgccctgcctggctgccactcacctccagggcccgcagtaactgactgccactcacctccagggcccgccctgcctggctgccactcacctccagggcccaccctgccctgctgccactcacctccagggcctgcagtaactggctgccactcacctccagggcccgccctgcccggctgccactcacctccagggcccgcagtaactgactgccactcacctccagggcccgccctgcctggctgccactcacctccagggcccaccctgcccgctgccactcacctccagggcccgtcctaacctgctgccactcacctccagggcctgccctgcctggctgcctctcacctcctgggcccaccctgcccgctgccactcacctccagggcctgcccgggcatacccagctgctattcacctccagggcctgccccgcctccaggcccccctcccccccaattgccactcacctccagggccctcccgggcatacccagctgctactcacctccagggcccgctctgcccagctgccactcaactccagggcctgccctgcctggctgctgctcattcaccgactctgtggtttcactgctcttctaatttatcaaacatttaaccgtgaaagactttcattctagacttttctgtctgtgcccagaggttctcttgatgatgattttctgaatgttttgagacgcccgtgacctggtctgtcccagagctcatgggagcccttccaggtatcttctcgagtttgtgttttgtgacacccattgtataggttcagcatccctaatcaaaacagccagaattcagctgggcgcagtggctcacacctgtgatcccagcactttgggaggctgaggtgggtggatcacctgaggccaggagctcgagaccagcctggccaacatggtgaaactctgtctctactaaaaatacaaaaattagctgggcatgatggcgcgtgcctgtaatcccagctactcgaaaggctgagacaggagaattgcttgaacccaggaggcagaggttgcagtgagctgagattgtgccattgcacgcctgggcaacagagcgagactccatctaaaaaaaaataacaaaaaatccagaatttgaaatactccaaaatctgacagtttttgagcaccggaaagacaacccggtggaaaatcctgtacctgaccttgtttgacgagtctcagaacacggtcaaaagtttcttcatgcacaaaattactccagaactcagggtgaggccctgggcagtagcaggcaacccctttggcttgcaaatgtttgtcaggtattatataaaatcaccttctggctgtgtgtgtacagtgcatatgagcataaatgcatttcgtgtttagacttgggttccatcctcaagacatctcattatggacatgtgaatattcccaaatccaaaactactggccccaggcattttggataagggaccctcactctgtactgagccagggggacacggcagctcccagaatggcccctcgagggtggcctgggtgctggctcctgcctggcaggggcgggcatgtgtgggagagatgggggcctggtggggggcttgtgcgtgccctgggaccccgtggctgccgggcgggtcatgggctggtgggagccgggctgcaggcttttccctgtggctgctgcttattctcccagcagcgcctgatctgcccgctcttcccgttcagctttcagattgcatcttctctgtctaaagagctctgtgccctggtcttcggggtcaacacgttctttgccaccatcgtcaagaccatcatcactttcattgtctcggacgtgcggggcctgggcctcccggtccgcaagcaggtgagcccatttcaggcctgcgtcctcggggatggaagctacttgtggggacattgttgaggcctcctggtgcccgcctgatgtggagcccactgtgggctgggggcacagggtgcgggcctggggcttccagtgggacacaccaggccagcgagagcaggaagtgagagagaccctagcggggctcagttgttgtgggcgggagcctccgtcaggccctgggcctcagtgggagcagctgagcctctgctcgccacggcggagctgtccttgtctccgctctctgcctgtggctgccggaacttggtgtccttgagccctggctggaggccacgtgacctttgtcctcttcaggaaggagagctgagcagagccactcagcagtgtcagtgcgcaggcctctgcgggtgccctcccctttcccacctctcgcgggcctctgctgcttctgagaagagctggaaaacacacatttaactcctgagggtcccagccaaggccgggtctccgagtgagctggaatcagccatggtgggcgtggtgtgagaggtccttccaggctcctcaggactgccccagcctgcagctagacagatgcccttggcgggtgggacaagggctttgtccacctggggcccaggtctcactgggcaggaggactgtcagggttagtcctgatcctctgagggtgcggagtctgttcagcttcagtgactccagagctcagggtaaggcccgggcaatagcaggcatccccttcggctcacaaatgcctgttaggtgaggatggctgttgctcactcatcgaaatgcattcttcagcccaagagtgtcattagggcctgtccacgctggcaggccacgtggccctgtgccacagagccctctgggtacaacacccccgacccaggtgtgaacactcagggcgggtgagtctccaaggcccaggggtgaacgcttagggtgggtgagcctccgaggcccaggtgtgaacactcagggcaggtgagcctccaaggcccaggcgtgaacactcagggtgatgagcctccaaggcccaggggtgaacgcttagggcaggtgagtctccgaggcccaggggtgaacactcagggcgggtgagcctccgaagcccaggggtgaacgttcagggcaggtgagtctccgaggcccgggggtgaacgctcaggacaggtgagcctccaaggcccaggggtgaacgctcagggtgggtgagcctctgaggcccaggtgtgaacactcagggcgggtgagcctccgaggcccaggtgtgaacactcagggcaggtgagcctccaaggcccaggcgtgaacactcagggtgatgagcctccaaggcccaggggtgaacgcttagggcaggtgagtctccgaggcccaggggtgaacactcagggcgggtgagcctccgaagcccaggggtgaacgttcagggcaggtgagtctccgaggcccgggggtgaacgctcaggacaggtgagcctccaaggcccaggggtgaacgctcagggtgggtgagcctctgaggcccaggtgtgaacactcagggcgggtgagcctccgaggcccaggtgtgaacactcagggcaggtgagcctccaaggcccaggcgtgaacactcagggtgatgagcctccaaggcccaggggtgaacgcttagggcaggtgagtctccgaggcccaggggtgaacgctcagggcgggtgagcctccgaagcccaggggtgaacgctcaggacaggtgagtctccaaggcccacgggtgaatgtgtccaggcccggcctgggtggacacagcctcctggtggccgggctggtctcaggtctgcagaaagggggcccagaaggcttctgttgaatgcatggccccagggcggggtgctggcagcagtccagctggctttggaggggctccagcacccgggaggaggtcctccccattcttggagccccgagttacctctgtccccagacagcagtggctgccagcatgtatgggcagggagtgcccgtcccagggagaccctcagggccctgtgtggccccagccaggctggaactggcttctgacctgcctctgggtgctgactgcccctgactaccgttgccgccccacctccatccctctgtgactgcctcttgttcagcccttggcagctggaggggcagatgcctgagggctctttagggactctgtgcgtgtgctcccctgtagctgccctgtggaggggacccctcacggtgggcttctaagggcccatgggggcttggtgcagggggtggagcagttcttccccagagagctggtcacgaggaagccctttcccttccttagctggtcctggtcctggtgtggccgtggaggctgtgggggagacagctctggggaggtggaggcaggttctggcctgtggttcctggctgcctcttgtcacatagaaaaaaaacacatggacttttctctggctggtttgatttctaggttaaaaagttaactagtggggcattttgctcatggctggacatcctgttgggtctagaggaggtggtgcgggctcatcttgcccccgtgcctgttactgggtgccgagtgtccactctctttcctccagcatggggagaacagctgggccaggagttcaggcttggtcgggggtagagtctggagacgggagggagccgtgatggagcatggggggacagacagggctagagcttgcctgggtttgcctgctttttaaattaagctttatatttgggtaatcttatattcacatgctgtttaataaataatacagggagatccatgtaccccgtacccagttttcacagtggtcacgtcttacagttctgtagcacatcacaaccagcatggcgacagtcaggatccagaacattctatccccacagggatccctcatgctgctctttatagccaaggcccaccctactcccagcctcacgtcctctttaacccctggcagccactaccctcttctccgcttgtatgagtttgtcatttcaggagtgttgtataaacacggctatgcattgtgtatcgtttagggattggctcttttcactcaacactgttctctgaacattcatccatgttgttactgtggctgtggctgattccttcttgctgctgagtgctgttccagggtgtaggtacagcacactttatttattcaccgttgaaagacttgtttccagtgtgaggtattaccaataaagctgctatggacattcttttataggtttttgtgtgaatataggttttcctttccctgggacagacgcccagaagtgcaagtgctgggtcaccaggtagttgcttgtttctttccaggaaagaagcagggaagcagcccactttccatagcagtcgtaccgttttatatcaccaccagcagactttgagagatccagtcacagcgtctttggtatgccgtgttgccactagtttttattttggccgttgtgataggtgtagtgatatttcattgtggttttaatttgcatttccctggggcataatattgttttaatttgcatttccctggtggataatgatgttgaacatctttttatgtccttattttccatttgcaaaatcttcacatcttctgcccattttctcattggattgttcatttttatactcttgagttttaagcatggtttgtgtattccagatattagtcctttgttggatatatacagtttgcaatttttttttcaactctgtagctggttgtttcatctacttaatgtggtcttttacagaacaagtgttttttaactcccatgagctctgatttaacagtttttccttttatggaaactctttgcctagccctaaattcagaagattttcctcaaatttcttttttaaagtttcgtgtttttacatttaagtctctgaccagctttaatttttgtataagatgtgaagtttaggttgaggtcactttttttttggcctgtgcgtatccatttattccagcatcatttgttgaaaagacttagctctccccattgaattacttttgcacctttgtcaaaagttgggcatatttatgtgagtctgtttctgggttttttatcctgttccattgaactatgtgtttactcttgtaccaatatcacactgtcttggttatgaagctttacagcaagttttgaaagtggatagacttgattcctccaacttctttttattcaaaattgttttgactattatagtttctttgcctttccgtatacattttagagtaatcttgtctatatctacaaaaattcctgctcagattttgttaggaattgcaattaagccagtgtatcaattttgggagaattgacgtgtttactgtgttgttttccaatccatgaacatggtatatctttccatttatttagatctttgatttctttcagcattttgtagttttcagcatatgagtactatacatgtttttagtttatgctttttcttaagtaaatcaaaccatattttgaaatttgttatctgcattagtctgtttgggctgccatagcaaaatatcacaaactgggtgacaaacaacagaaatatattctctcacagttccggaggcttgaagtctgagattaaggtgttggcaggttggtttctcctgatgcctctcttcttggcttgcagttggcatcttctccctttgtcttcatatggtcttttttttctgtgtatggtcctccctggtatctttttttcgtttgttttttttttttttgagatggagtttcgctcttgttgcccaggctggagtgcaatggcgcaatctcagctcaccgcaacctcctcctcctgggttcaagcaattctcctgtctcagcctcccaagtagctgggattacaggcatgtgccaccatgcctggctaatttcatgtttttagtagagacggggtttctccatgttggccaggctagtcttgaactctggacctcaggtgatccacccgcctcagcctcccaaagtgctggggttacaggcatgagccaccatgcccggctagtgtctgtcttcttataaggacatccagtcaggttggagtaagatgccatccttgtgacctcatttaaccgtaattaccttttgaaaggccctgtcttcaaatgcagtgacattgtgggttagggcttcaacatatgaattgggtgatgggttcacaattcattccataacagtgtatacatgttcgttgctagtgtatagaaatgtagttgatatatttgtgtgtttatcttgtatactgcaattttgctgagattacttatttgttgtaggaggcttttccattttttggcctttgttttttaaattccttgagattttctacgtagataattatgtcatctgcaaatatttcttcctttctgatctgtatatcttttatttctttttcttgacttagtgcactggctggaactttattaattccttctttctgcttgctttagatttattttgctcttcttttttctaggttcttgaggtgagatattgatttgagacttttcctcttttctaatttatgcatctaatgctataaatttccccactcagtactgctttagttgcatcccacaaatcttaataggctgtgttttcattttcattcatttcagtgtgttttttgatgcatcattatttcaaattttgttgtttaatttccaagtgttttgagattttcctgttatctttctgttattaatttcttttttgattctgttgtgattggaaaacacattattatttcagtccttataaatttgttaagatttgtcttatgacccagaatattatctgttttgatatactgtggacactttgaaagaatgtatattctgcttttgggtggagtgttctgtaaatgctgatcagatcctgttggctgatggtattgatttcctctcagttcttgtggattttctgtctagttttattattgagagggggtattgaagtctcctaagtataattgtggatctgtttctcctttcagttctgttgtgtttttgcttcacatattggcagctcttttgtttgttgcatacacgttagggattgaaatttgttttggtggactgaccctcttgtcaattgtgtaatagtgggattatataatgtccttctctgtctctgctgtccctggtcttttttttttttttttttttttttgctcagaagtttattttacctgatgttaatatagccacccctgctttcctttgattaatgttcacatgatacatctttttccatcgttttactttcaaccttcctatcttggtatatttgaagtgagtttcttgtagacagcacgtagttgagtcatgtttttaaatcgactttgctaatctctgtcttacagttggtgtatttagaccatttatatttaatgtgataatttgtatattagggcctaagtctgccatttcgtttttaatttttcatttattctctgtttttagtttctgtttacattttttgcagcttccagtgggttacttgtacatcctttagaattttgtttggtttatctattgtgtttttgaatgtacttagtatagcttttttggttgctttatggattacattaatacataaagtttgagtgaagtataaaaacgttgcctttatgtcactgtcatctcccgcttacagtacaattatcttaaatattttctctacatacctttagtgctacataagaaaatattgtaatttttgcattaatcatcaaacatattttaggaaactaaagaaggaaagtctgttttatttacccataatgttgcctactgtggtatttcctctttcctgttatttcaagattccttctttagtaatttcctttctgtttagagaacttgttttttgtttgttttttgccattattttagacagatctgctggttacaaatttcttctcttagtttttcttcatctgtgagtgtcttgattgctcttttattctcaaaggatgttttcactggatataggatgctgggtagacagtgttctttttttttagcctgtgagaaatgtggtgccccttcctcatagctttcaggatttttgatgagcaattactgttattcaaattgcttgcccgtaaagtgtcatttttctctggccacttccaagattttttctttatttttatcgttagcttatagaagtttgaatatggtatgtgttggtgtgattttgtttgggttttctatttggggtttgctcagcttcatgaatctgcagtgtacatctcaccaaatttaggaagttttcaaccattatttcctgaaatgctttttgaaccccactccttttctcctctttttctagatcccccatgtcacaaatgttagatcatgttgtatagtcccacaaggaatgaggctttgttcattttttttcagtccattttttcttttgttcaggttggataatttctattgttctacctccagttcattgatcatttctctgcctcttctattttgttgttgagatgattcattaagtttttaaattctgattattgtacatttcagttctaaattttttttatttctcctatttctttgctgagactgtgttttttcatttgtttccagcatgtttgttattgttcactgaagcatttttatggtggctgctttaagatctttcttggcgaattctactgtctgtgttgtcttagtgttggtgtctattaattgtttttcagtttgagatctttgtggtttagtgtgccaagggattttttagtgagatgcaagcattttgggtatgatgtaatttcagcatcctgttgtggctgacgcaactcctgcaggtcaagcggggtgtgcacctcgctacaggcaggtggggtggaagtccaggctctcactcagcctttgtgacacctgagggagggtgggtggctgggtgggggctccttcttgttgccaggcaaggatgggagtccagctcccctcgtggcccccttgatgcccctggggttgggacattctcattattgctgggtaggtgaaagtctggactcccgcttgacctcctctgacaccccccagcatggagggggacaggacaggcacgctcttactactgggtgaggataagaggccaggctccccatatggtctctgctgactccgtgaggcttcgggggtgactaggctccccacatggtctccactgactccatgaggctttgggggtgacatcttgggcttccctgtggtctctgctgactccttgggggtgagggtgggtgtctttaccaaccagtgggagtgaaagctctagtgcccactggtgttgtctgacaccaccccgcaggggactcgggggtccttgttacaggctggcgagggtggggggtccttgctgacatggtgggtggagccgaggtctggtgtttgcggggagcagggcgattcctgtcgaaaggtctttcctcatgttgggctgacccttccctgggtcttaggccagagagagctgcttccatgggctcttttttctgcatctgttgtcttttccagcctgctgccttcttcagtttcaaaatatctgaggtgaaaagaaaagcccccagggagctctgcgtggcacagtctgtccttgcgtggcacagctccccagaccccgagggcccggccagtctgcccttgtgtggcacagctccccagaccccgagggcctggtcagtctgtcctcctcgctcctgctttcagagtcttcccaggtgtttatctcagtgtcttgggtaggagaagagcagggagaagcgtgtcagccccatcttcctcagtttgctttaaaaacagctgtcctggaagggtgccggtgccgatgggctgcagggattctggcctgcggatgtggagctggggcctcaggggtcttgggcgggactcactgggctctgcccacggatgtcctgagggcactgcagcctcctgaaccctctgcacctccgggaatgatcaggtccctccctggtgtcccagggacatctccagtccctcctgcccctggcagctgcgagaatcaggagagatgtggccaacgctggtgctgctccttctggtcatcgtagcacagcttccgctgccgagatggagacgggctccatgtgcaggctgctgggggttgctctgggcgcgaagccctggggatcagctcctggtcacctgctgtggctctcctcaccctgctctgccaggcgggacgttctggccctcatgggcacccttccgctgtctcagcaccatgggggggcagcaagcaccaccaagcaggggactcgggagcagacaccgcaggccacgcagaagcaggccacctgccaggttccgaggggttcttgggaaatggtgggaaccccccttcaggcctgtgccaggtggtggaggtcgggggggctgtggtgagcactgtggcacctgctcctggggctggcctctgaccgctgtgcagtgttcagggtcagcctctgagctggaggagggtgagcctgggagcaggcgtcggggtgtagggtgccagtgtcccagccaggccctccccacccgcctcacccggcctctctttccagttccagttatactccgtgtacttcctgatcctgtccatcatctacttcttgggggccatgctggatggcctgcggcactgccagcggggccaccacccgcggcagcccccggcccagggcctgaggagtgccgcggaggagaaggcagcacaggcactgagcgtgcaggacaagggcctcggaggcctgcagccagcccagagcccgccgctttccccagaagacagcctgggggctgtggggccagcctccctggagcagagacagagcgacccatacctggcccaggccccggccccgcaggcagctgaattcctgagcccagtgacaaccccttccccctgcactctgtgctccgcccaagcctcaggccctgaggctgcagatgagacttgtccccagctggctgtccatcctcctggtgtcagcaagctgggtttgcagtgtcttccaagcgacggtgttcagaatgtgaaccagtgactctcgggcgcccctgtggtaactttgcaggcggccctcagtgcatccccacgacccctgcctcgagggccgcctgccttagcaatgggggcctccgcttatcctgctagcaggccccctaggattccccctgccctgtgccgcactctggcggtggccacagcgtgctggcgacactcagggcagctgcctggccatgctgtccctgcactgtgccccgcgggctttgttgctggaagaggtgggtggtgggcttctgcgtccaccaggcctcactggctcatgccccttggggggcttgagacaaatcctttctgccccccagggctagtgaagtggcctcttggataccagctcaggggacactggccccacaggagttgtgagccctctagggcagggtgggagccgggaccctcaggtgtagctgagctgtgacattgctggtcatccttggtgctcttgcttttttgaaagatgctttttttttttttaactgacgtagaatgaagaactgcatgtggcttctctgtctctgtggaaaagccatctcaggttggcggcagacacattgtcatcagaggggagcagcggctctggtcctcggagctggttcctctctcccaccctaagggcagccctccatggtcctgtctgtccttctgaagtgtgtccatcctgacctgcgggtcctcagctgctcccacacttgtgccagcccggaggggactggtcccggtcaccgcggacgtgctggccttggtatgtgccaggcttgcctgggctgggcagccttgggggggctgcctttgtggtgggcgctggggaagtacgtcccagcggcctcagggtctaaggagcgctagtgccttgcccacaggtgcgggaccatctgatgtgatgtgaatactcttcccacatacattaaacacacttaagtgagtgtgcgcagggcttctgattcagggccggcctggcctgggggttgagggtcagcagtcagtgaggaggccaggagaggcgtcccagccttctcccgcctccagcccacgcagggccttggtgcccatgagctgagcacccccacaaccctagtcaacggccctatcctgtggggcctctgccacatctcagcggccccaggtgaatggctggctgctcagcacggagagctggggagagaatctctggctggggaggggctgctggagctgctggacccaggggtctcccgaggtggctcaggggagcaggcatcttggggtaccctgggttgaggcagaggctgcacgtggaagatggcccgagtcagtggatggtgccagtcagacagggccatggtcccaggtgcatccaggggctctgtcatggccaccctggggaccctgcttgggggggggtctgcaccagccatttcctgggctcgtagatctagcaggatgtgatgggtggaggtgggctgggcctgtgccatgggctagagcgtcactggggaggcccacaccgccatcagaatcctcctcccagcgcctccccaacctgagggcctgctccctccgcagcctgctcactgcacccactgcctgcctgcctctgagtcctgcactcacccgtccaccaggacagggatggctgtcaggatgtagtgttgctgggagcaagtcaggtcctgctgtgaggagagacctaagagtgttggtgtgtgtccacacacccgtgcatgcctgtgtacctgtgcacactatggatgctcctgcacacctgtgtacaactgcacgcctgtgtatggccatgcatgcataccccatgtaaccgtgcgtgcctgtgcacactcgggatctgccagtggggcagtccagggataaaagactcctgagaactccttttggagaattgtgtccttcctgtgacagtgaaggctgcttgcaaaccaagagtcagtgtaaaaggtcacttttatttgcctgtctgaattggcttcacatcacacacaattacagaaccagccccaccggtttcgtcgcagtcctgaggcaggtgcgtgttggctgtgctgtggtcagcctggcgctgccctgagtccacttgtccctccacagaacgaatgactcgggttgatgttgccggatctcaggggtggctgtgactgacagaggaccttgttgcacctcgtggctgctttgttcacccgcagggcggcctgtgggcaccccggggttccccttcagtcccaaggagggtaaggatatgggtttcctaggagacagccaatgactgccctgcatctggagccagcctgtccatgggcagtgcacagatgacagccctccctcactgccctgtgtgctggctaccgcatgtcctgtgccagcctcagcctctttgatgtggccgtgttccatcctggcgctcagctggacaagtgctggctgagccacgtcccagccaggggcatgagatgggggccctggatgggaggctgccagaccccaactcatgggtcccttgaatctcccagcttggactcggccagggtggagctgtctgctttggatgtatcatctcatggctcatttgggaggccagccccaggctgctgtgcttggtgttggaggacaggccggagctgggggtcacagtgcgcctctgagcttgggaacctgcttcagcctggggttgctgtggagaatggcccagagctgagcagaaggggctccccctagccccagggacctgagcctccctcccatctaccgcagggcgagcacacaccctggaggagcccagatggccttgtgctgagtgtggcctcagctcccattgcctcacggggcctgtctgctaacaggtctgggttttgtgcacagaacggtgctgctaggtgggagatgaagtcagcacctgctggggcgagcacggcttcccaaagcaggaaatcctgga

SEQ ID NO: 16961 - DNA, 31602 bp, Human
cacagaagctgctcccattgactgtggccccactcttgtacccattgaccgtacctcctctcttgtactcattgactgtgccccccccttgtatccacaactttgccccctcccttttaccccattgactgtgcctcctgtgccctttgactgcacccccttagtggctccagaatgacgctgttgagggtgagtcccagctcagcctctggccatcgtggtggctgaggccacattgctcaggcttctaaggtgtaagtggcatcacagcagtgcctcccacggattttgtgagggcagattgcactaagatggctcaatgtgctcaagaggcgacctggctgctgccacggctgctgctgttctcactggactccttgttcctttttctttcatttgtttgtttttggagatggagtctcgctctgtcacccaggctggagtgcagtggcacgatcttggctcactgcaacctctgcctcctgggttcaagcgattctgctgcctcagcctcctgagtagctgggactataggcgcatgccaccatgcccggctaatttttgtatttttagtagagacagggtttcactatgttggccaggctggtcccaaactcctgaccttgtgatccacccgcctgcacctcccaaagtgctgtgattacaggcgtgagccactgcccggctccttgttcctttgaactgtctcgctcaggacaggacggtagtccttctgcatcctgcaagacttggacaggatttctttccatttaacactgtctcctaaagtgctgctttccttggggaactttgctgttcttgctagtccagaacaagtggcacaactgcccttgacctccacatgaccttctcagggcagcccagactctaaatgtctgtgacctgcaccagcagcagcaaggccatgccggccgtggtccagcccggctgctctcccccactctgcagtgtttttccacacccatgctgcaggtgctggttgcgttcctgctccatccttcagtgcggaagtggcattttgcggttttctgttgtcatgaagcaagtgcgccacacttgcctgtcttatgtgcgtgtgtatatgagcatgcccatctcagtctccctgagcgcctcttttccacccgtctcaggcctctgtgttagctgttccctctctctgaaacaccaaactccctgatctcagcctgtctctccagtctcgacgtaacagcatcttcccagcgaggcctgctctgaccacacggcccgggaaagcagcccaggccccctctcacttcaccctgtgcccattcttgaccctgtgtattgtgtctctcccttgcctggtttgtgtcaggaaggcagaggccctgcctgtcctgctcactgccgcaccccaggcccagcatgctgcctggcatgggcaggcattgacttgatattagctgggcaatgaatgacagtgactgaaaatgtaatagcaagtcagggcctagcacaggaaaataagtgattgctatgtaagtgaagggttgctaagtaggatttgggtcataacatactgttaaggataatttttttgttctctacatgtaaaaatatgtatttttaaaaattggatgtcatgggctgggtgtggtggctcatgcctgtaatcccagcactttgggaggccgaggcgggtggatctcctgaggtcgggagttcgagaccagcttgaccaacatggagaaaccccgtctctactaaaaacacaaaattatccaggcatggtggcacatgactgtaatcccagctactagggaggctgaggcaggagaaacacttgaacctgggaggcggaggttgaggtgagccgagatcgcgccattgcactccagcctgggcaacaagagtgaaactcggtctcaaaaaaaaaaaatttgatgttatggaatgagggagacaaaaaatgctctacaactattaactgatgcttttctggttttgttctccagacaccattcgcttttcacccaagatgatttgatgtcttataaaactctgatgaaccatgatggctacacagacattaagtatagacagctatcaagatgggcaacaggtgagcttgaacttgattctgcattctaattacaaatcaacctggcactcaagcatgaacattgctttgtatacttgcaattcaattgccatgaggttgcatgctcagtgttagtgtattatgcatttattgtacattcgtgttcagaaaaaaaagccatagaataatactatttcgttaactgataccaagattgccaggaatcttgacttccctaagtcatatgacagtttcttgggaatttacctttttaatgtcagtgttaattagcactgttactttgaaagaaaacccggttgattttcatgatgacagattcccatgttgactggtggctcttctgagtgtctaactggatcagcttttgaatgggaatcttgtagcctcgtctccccagttgtaggcatgagaggggctgtcccagtaatgaatctgcaggggccccagtgctctatctttgtaccttgctcgtgcttggatggttgtgccatacacaggcagctctccattgccctcccaccatagatgagactttgttctcctggaagctgtggtgttttgtgcttttgagtatctgagtgttttgtgttctgtgacctgaatgaattgaggagcaggtggatcgagacttggctgaggcccttgtggtctttcttggcttgcgatcttgttaaacacggtgttctgaacccactggcatttggctcatcatcccactgactctggagccagtgaagggatttggccctgccctttactttcctgcccagcaggcaggggcagtgcagtacacccccctcggctctcctccccacctcgaggacttcggtggcaaggatcaggctccggaaaactcactggagccatgctggtgaggtctgaggaggggttaggagctgaggcgctgggtccccctttccctggtggttagttttaccaaccagtccttgttcagttcctgtggcagagatttttgttgttggtggtggtggtgttagtgttttttttttctctgtatagcaattaaaggagggagattctgtgatgtagtcagcctgcttccttagcctagaagtccttagtcctttggtatttccaattgacttttttttttttttctaaaatgcaaatctaataatgtcccgcctgagctctccagtggctccctgtggattcctgtgggtttcatgcaaagactgagctgctctgtggcccgaatcgtctggcccctctggaccccaggacgcccccaacatctctgcctggcatatcttgggcacctctctgcctgccctggagcaccggtcctcactgttcccatcactcttctccctcctgcctgccaggtctttgctccgaccccactgctgcctcctgtgcaccaaggcacggtgaccacctccaacacagcctggttgctaccagccacctcctcccaggcagctgtgccaggtgcagatgacacctggagcactgcccttttcatacccgagtgtttccaagggcctgggaagtgtttaatcagcattattttaaataaacattgaaatatatctacagcgtagacctatcataattattttgccatttttccaaggttgaacatttaggtttctctcttttcacaatcatttttttttcaaatactgaaatgaatcttttaaggcttcttattttttattatttatttatttacttatttatttattttgagacagagtcttgctctgttgccccggctggagtgcagtggtgtgatctcagctcactgcaacctccgtctcccaggttcaagcaattctcctgtctcagcctcctgagtacctgggattacaggtgtgtgccaccacgcccagctaatttttttgtatttttagtagagacagggtttcaccatgttggccaggctgatcttgaacccctgacctcaggtgatccgcccaccttggcctcccaaagtgctgggatcacaggcataagccactgtgcctggcctttttaaggctttttatacatgctggcagattgccttacacaaatactgtgtccacttaggctttattgcttttattttttttttttaagagaaacataaacagttttcctaatatgttgtaccatttaaaggcagcagaatagaagtcatcttattgcaaaaacaagacattggagggaagagagcgcagggctggaggatgtgagaggcgtcctgtgcgggtgggcgttcatggctggcccccagtctgtctggacagtggggatggccccgctcccatgaggtctccccgcccccgctgccccaagctgcttcctcaaggggcagaagcatggccaaatccaccgcgggagaaatggcccgtcctggtcctgaggaagctgaggtcaggacagtctaatctgctgctcatggataactagaagtttactttcacgaaattttgtttttgtaaactgattttttttaacgatttaaatgttttttacctaaatgacaaaggcattgcttgtttaaagcagtttaaatgatagtatcttttaaggctttaagtaaacacagctggccttttcctttctgaatgcagtgacatttttatggctatgtattgctgaggtttgagggtagatatgggagaagttcaaccttgtcccaaatatgtagcgtatgggttaggttgtgtctgtgacatggtaagaagaccttggactatttgtctatgcttctctgactgtagtattgctacacgtgaggagatatagcaatagacggaggagtagattgcacgtgtgccgttctcttcattaggccatcgccagtgttattttaaaatcatgagcatttcacagacattggttatctcagttcttaagcagtttggaaattttacctttattttaaagcacattaaattcaaagctgttttgttggtagcattctttacatatgattgcagtcatactgctgtctggcaattccccactccaactgcattcctgttggagcatggaatacctcgtagtagtttgtgtttgctaataagaattatcttcctccttttacagatgcaagtagtaacagagttaaagacagaacaagatccaaactgctctgaacccgatgcagaaggagtgagccctccccctgtggagtctcagaccccgatggatgtggacaagcaggccatttataggtagtgcccggggtgccggctgtgggggcctcagaggagtgaggagtgtccacaagtttgttaaaaggaacaccagaactagtagcgaggcagagttgtgaggtgccattatgatgtgataactgctcggctgaaaattttctcagattaagatgttatttctggccaggtgtggtggctcatgcctgtaatcctagcactttgggaggctgaggcgggcggatcacttgaggttaagagtttgagaccagcctggccaacatggtgaaactccatctctactaaaaatacaaaaattagccagacatggtggcacatgtctgtaatcccagctacttgggaggctgaggcaggagaatcacttgaaccggggaggcggaggttgcattgagctgatatcgcaccactgcactccagcctgggcaacgagagcgaaactctgtctcacacacacacacacacacacacacacacacacaaagatgttatttctaatacctataaaagttttagaatatcaatctataaattttgtgtaaccttgcaaaaagaaatattcaggcacagatgattttactgagaattctacccaacatataaagaagaagagagcagcaagtctgcatagtctctttcaggaagtagaggaggagtgaatgcttcccaactcactttataattgacatcactctgacactaagaccaaagacaataccaaataaggaaaatacaggccaatatccttcatgaacttagatgtaaaaatcatcaataaaatattaacaaatcaattctagcaatatgtaaaaagaataatacgtagcgaccaagtcaagtttttcctgggaatgtcagacttgtttagtatttaaaagtctgccaggcgcagtggctcacacctgtaatcccagaactttggaaggccgaggcaggtggattacctgaggtcaggagttcaagaccagactggccaacatggcgaaaccctgtctctaccaaaaaatacaaatattagccgggtgtggtggtgcatgcctgtagtcccagctactctggaggctgaggtgggagaatcacttgaacccggtaggcggaggttgcagtgagctgagatcatgccactgtactccagtctgagtgacagagagtgaggccctatctcaaaaaaaaaaaatttttttttaagttcagcatagaattatatataactcagcaattctactcctatgcatatgtatacctaacacaaatgaaaaaagtccacacaaaaacgtgtacatgaattttcatagcagcacagcctatcatggccaaaagctggaaacagtgcccatgcccatcaactgatgaatgaacagacacattatggcatctccatgcaatgcaagaatatttagcagtaaaaggaatgaagtggcgggcgcggtggctcatgcctgtaatcccaggactttgaggggccaagtcgggcagatcactttaggtcaggagatcgagacaagcctggccaaaatggcgaaatgttgtctctactaaaacaaaaactaggccaggcatggtggctcacgcctgtaatcccagcactttgggaggctgaggcggttggatcatctgaggtcaggagtttgagaccatcctgaccaacgtggagaaaccctgtctctactaaaaatacaaaattagccgagtcatggtggtgcatgcctgtagtcctagctacttgggaggctgaggcaggagaatcgcttgaacccgagaggcggaggttgtggtgaaccgagatcacgccattgcactccagcctgggcaacaagagcgaaactccatctcaaaaaataaaaaaaattagctgggcatcatggcgggtgcctgtagtcccggctacttggggaggctgagtaggagaatcgcttaaacctgggagggcagaggttgcagtgacccgagatcgtgccgctgcactccagcctgggcgacagagtgagactccatctcaaaaaaaaaaaaaaaaaaaaaggaataaagtactgatacccgtaaaacactggtaagccttggacactttatgctgagggaaacaagccagacaccacggtcacaggttagacggttcccatttagacagaatgtctagaagaggcaaatatatagagatagcaagtaggttctaacaggctggggtctgggaaaaaatggagaatgactgctattggatacagggtttctttgcggggatcatggaaatgttccaaagttgacggcggcaatgctgtgcaactgtaaaaaccgttgaattgcatactttcaacgggtggaccgtgtggcgtgtgcattttcacccaacagaggtgttagtgaagtagtgcaggcatacacgcaaagacattctcacggagatgtagaacgtaaatggattcttttttttcttttctcctcaggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaaccgataatttagtaagtaaaataaattttatttttagttttcaaaatgtgaaatctgttcatgaaattttaggcttctaagtagaactttagactgcttgtagttctgctaaaggagagactcatacaactctaaaagaatttttatggtgtgtgtaatgtggatatccccaagtcttccagccttctctaggtatcttttatttatttagtttttatttttagatttattttatttttgtagacacatcttactgtattcccccagatggtctcaaactcctggcctcaagcaatcttccctcctcagtctctcaaggcccaacctaccctttcctttaaaaataaaataaaataggccaggcgtggtggctcacacctgtaatcccagcactttgggaggccgaggtgggcagatcacaaggtcaggagttcgagaccagcctggccaacatctggtctcgatgttggccaaaatcccatctctactgaaaatacaaaattagccaggcatggtggcacatgcctgtagtcccagctactcaggaggctgaggcaggagaatcacttgaacgcaggaggcggaagttgcagtgagccgagattgtgccactgcactccagcctgggtgtcagagtgagactctgtctcaaaaaataaaaataaaataaaataaaataaaataatttgagcctccatgccaaatggacacggggattcagttctctgcacagtgtttgtaaaggtccgtagggctggggtgttcgggtggcatgtctgtgacctgtgtctgtccttggcttatcatggacatggacacagacttgagctgtattctccaagacagctctgtcttttttttttttttttttgagacggagtctcgctctgttgcccaggctggagtgcagtggtgtgatctcagctcactgcaagctccgcctcccaggttcaagccattctcctgcctcagcctcccgagtagctgggactacaggcacccgccaccacgcccggctaattttttttgtatttttagtagagacgggatttcaccgtgttagccaggatagtctcgatctcctgatcttgtgatctgcctgcctcagcctcccaaagtgcagggattacaggtgtgagccaccacgcccggcgacagctctgtcttgaggctgacagtgatttgtgatgccctccccccagggccagggctccaaaatccagtgttttctgtgccctccagaggcaatggagaacatcttggttccgtcatcactggattgctctgaatgagctgcacctgaggcacctgtacagcactgtcagctttgggcagaccacactctctgggtgtgctctcctgccagagtgtaaccacgtgtttacttctcagagctgggtacacaaagatccggcatcagggaaccttcactggattcccttcgagccatcttggtcccatatcaaaaccctggttagggccttcaacagaaaaggtttttggaaaactcatttttcctgaataaattgctgaggtcttagtttttaagaaaattctcattatatactcgatgcttaccatgaaacagattttgtgggtgagttatctgacttgaatctgtctcctcctctctgagatgagactaacagtgcatgctctttgggtgaggatccgatgctctctccacccctgagtctgtggtccacatccatcttcccattggcccacacctggcttggcccagtgagtagagcacaggtgtcctctgcaccccactaggctggcagggaccaaggttctcttgactggtgagtgtttagcacagggcctagcagagtttgacactccatcatttttgttactgagtgattcatttattcactgcatagatacctacgaattcctaccaccagatttacaggtgaaggagatgggcttcggagctgctgattcataggcagctggtgcttatgaaaatggctgcattattggtattagttatctattgctgtgggacaaattaccccaaaatgtagttacttaatataaaactatacaactttggccaggcgtggtggctcacgcctgtaatcccagcactttgggaggctgaggcaggtggatcacctgaggtcaggagttcgtgaacagcctgaccaacatggtgaaaccccatctctactaaaaatacaaaaattagctgggcatggtggtgcacacctgtaatcccagctactcaggaggctgaggcaggagaatcacttgaacccagaaggcagaggttgtagtgagctgagatcgcaccactgcacttcagcctccagcttgggcaataagagtgaaactctgtctcaaaaaacaaaacaaaacaaaatgatataacttttagaaaaatcgcaagagaaaatcttgaggatctagaactaggcaaagacaccaaaatggaactttatgaaaatgtagcactagcctagggtgagtgtggatgtatcactatttgtggatgtagaaacaggagtagatgagggtgagtcacttgtcctgcctgccacagagcgaatcagtggaagggctaggctttggctcacagcccacacacctagcactgggatgcaccgaggtcaccaccacgcgcctttgtcttccctgcacaccagatgcagccaaacaccaaagcccaggtcagtggcaccggaacaacacatcagtttagaggatttctgatgttattccactttggttattggcagtagagatggttctatctaatgactaagaactggtatgtaggatcatgataacttacaataatgccacctttttctctgaaagtcttcattttctctgctctagatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccaggtacttacatttgggggtctcgctttccctctctgccactgtgaacatctgcattgagtcatgagaccaccagctctttcagaattcactgggtcatctttatgactttctacaagaaggaccctctaggtctctgaccccagcctggtttgggaatgaactccctcagattatgaagtgagtcctcaatctgcatactgggcccccggtcccatgtttatggaaggcacaattccattcatttctttcttttatttcttctgaaaatattttacttattcttttgaaaaattgtgtaaaatacacataatataaaatttaccatcttagctattttaaaatttacagttcaatggtgttaagtttattcacattgttgggcaaccatcaacaccatccatctccagaactttctcatcttctcaaactcaaactctgaccccattaaacactcattccggattccccctcccctagcccctggaacccaccgttctactgtctgtctctgtgaattcgatgactccaggtctctcatgttaagcggaatcgtacagtgtttgtccttctggatcctttgcttgtttcattgtgcagaatgcctggagggttcatccatgcggaagcactattgtgttttagccattctgatgatatgtagtgatattaatatttctttgtggttttaattttcatttccctgatggctaataatgttgaacattattataccctctgtgtattttctttgataaaatgtctgctgcttatgtcttttgccttttttttttttttttttttgagacagagtctcactccatcacccaggctggagtgcagtggcgcgatctcggcttactgcaaactccgcctcctgggttcatgccattctcctgcctcaccctcctgagtagctgggactacaggtgcctgccaccacacccggctaattttttgtatttttagtagagacggggtttcaccgtattagccaggatggtctcgatctcctgacctcgtgatccgcccgccttggcctcccaaagtgctgggattacaagcatgagctaccacgcctggccgtcttttgcgcattttttagttggatttttttttaacttctgagtgttgagagttctttgcttattgtagatactagttctctgttggatatgtggtttgcaagtgttttctccaagtctatagtagctaagtatttttctcatcctcttaacaggtctttttcagagccagcctttttaattttaataaagttcaatttattaggttttccttttatggatcattcttttggtgtcaagtctaagaactctttgcctaaccctaggtcccaaagacttcgtcttaagttttttcctaaaagtttttaaatagagacaaggtctcactatgttgcccaggcttgtcccaaactcctgggctcaagtgtgaaccaccatgcctggcctcaaaagttttatagttgtacattttgcatttaaatccgtgatccattttgagtggatttctctatagaataactctcaaagctgggcacattgtttcctcccaccctgtgattccttttcaaaattgtttagctgttctggttcctttgcctgtccacataaattttagaatgctcttgtctagagctacaaaaacatcttgcttagattttgataggaattgtattatacctgtatatcaatctggggagaattgacatctttactgcattaagtcttccagtccacaggtatggcatgtctctccattgattgacaactctgatttcattcatcagtgctttgtagtttttgacacataagttgtgtacatgcgtttttagaattatacccaagcatttcctttcctggcctgtgccatctcgaataagagtggcaagagcagacatccttgccttgtcaccgccttaggggacacctttcagtcgctcactgtcgatgatgttggttgcaggtttctttctagatgctctttatcaagttaaggaggttatcctatattgctttttttctgagagattttattttgttcaattttgttaaatgcttttccagcattgattgatatgattatgtgatttttcttctttagcctgttaataatggacattacatggattggttttttgaatattgaacaagccttctattcctggaataaactccacttggccatggcacataattcttttcatatgtattcttgaattctattggctaatattttgttcagcatttttgtctatatttgtaagggatattggtgtatagttttgtttttcatactgtctttggttttggtatcaaaatacacaaacttacataaaatggattgggaagtattccctcctcttatttttttctggagattatgtagacttggtgttatttcttaaatgtttgagaaatagaattgatctatttcacctaagatgttaaatttaggagtttagagttggtctagtattctcttcatagccttttggtgttagcagggtctatagtgatctcttcctgttttatttctgatattgatcttttgtgtctctattttttttttagtcagtctttctagaggtttatgtaattttcaaagaacagtattttgttttattgatttttttggttgtttttctgttttcagtttcattgatttcaccttgatctttattatttcctttcttctgctttcggttcatgatgttcctctttttctaagatcttaaggtggaagctgggatgattgatttgactagcttaacttttattacagcctaattaatgtggcaggctttaagcgtagccactaagcttacacattccgctcgatgatggcccacagaatcaccgccttggggtggcgtccccttatgctatgtaactgctcacatgtcagggcacatgagtgtgccaggcccggcactggaggctcctctcccctgccagctgcccacccaggcgtcacagtcagtggataaagtggcccatgtggatctaaccccagatgcatagagtcctccatggggcatgtagaaacatttgcatggggctcgctgtaggccgggcacagttccaagcactgtacaagcaagaacactggggaaagccaagatcacacttagtccgtgccggggtcaagagtcaaggtgggtgccaggggctgactccccagcacagcttggaatacctcagccctggtcacttctagtgcctcccaggcctgtgctataatctcttgaatgctcttatcggtcagggagagcttggttcatggaaaactcaagagtccaccaagccaagtctaatgaaaaagatgtgtgatcagaaagcagggtcttcctcgatatactcctgggctgtaaggcacgtggaatatggcagtgagatgaagataatcttttggaagccacagtgcaggctgacgttgcaggctggcttgttgtgtttaatacacagttgaacatctcttgctttccgtgtgtgctgcgtgcattctgaagccgcgtcatctgaggatgttctttccctcaagcttctctttccttttttaatggtgtcattatgctacttatgttaaagttttaaacatgggttttccgttttctagtaattccttcaacatgtgtgttctgacttgcagcagattcaaagtgccatcacaggcaccatcagccctcagggaattgtggtgccggcgtccgcgctgcagcagggaaacgtagccatggcgacggtggcaggtacgatgacagaaaaatggacacactctccatgagtttttgcagaaaatggtcctgtgtgttagaatgacagtataaatataatttcaagttcatgccattttctaatatagcaatgttagaagctagaggtctctgaatgcctctttcttgttaatactcaataacaaatattttatgcagattgtgtttctttgtttctctaccaaaaatatattggaaagaaaaaaggttttatgtaggaattgaaaatatacaccaaaaaccagttgtcattttcaaataacatagctttttgttgtgcttttaatagcaccgtgaaaatcttaagttttatcattaattgatgacaaataaaaatgcagtcttagcattggtattacttgtagaacaaaaccgttacaggaaagggacagattccagagttccctgatgcgtagagaacattgaaaacacaaagcatcatggaaatgggacacggcgaagagggaggggtagaaatttacaccaaagacctcacataatagcacaaagggaaacctcagtgggaaaaaaaaaagcaccattgatccaaaaatataactagaattaaaatagttattatttagtacccttggccaaatccttaacatgtgctaattttaggaaatagtagaaagcagaggctagcaaaaggaagggagccctcacaccccaggtcagttggtggtgtgtgagccgggctgtgtgggctgccaggcacatagcgcccacccacctgcccacccactgctgcaggtgcccgagtagcccacccagggagtttgttttgatactttatagtgacaagtcaactggcaaaggattgttgatcttttgaaatgattaaaaagctcatcaaaccagggattttattccttttgtaagtatatcaagaagagggctggtcgcagtgcctcacatctgtaattccagcactttgggaggccaaggcaggaggatcagttgaagccaggagttagagaccagcctgggcaacaaagcaatgtccctgtctctacaaaaaaaaaaaaaaaaaaaaaaaagaagaatggtttaaatcattgagacttaaaagcagcctcatatttttattctccctttcgaggtggcacagtgtatcagcctgtcacggtcgtcactccccaaggccaagtggtcacacagacattgtcgcctgggacaattaggatccagaactcccaggtgcgtgcgccattttatggaaggctttgggggcgagtgctgcccacataggggcacaggtagaacaagcatgagcccttccctctgcctgaagagctttgtcttgtgtagcaatttctggtttctctgaatgtcagtgttttgtttctttgtactcttatctctcgcattgtagagaatttgcaaagttcagaaaattctgaaagaacaggaaaaaagtcactcataaccaccccctgccacccacacacacacacacacacacacacacacaccacaccacacacacacagagttatccagtgctaacgttggatcatgtgcacgtgcaccaggggcagaggtcttgtaggcacacactccccagggtccccacaaagggcacggcagaactgccaggcaagcttttcagaccagtgagcctggcccacacctccatcatgacaatgtcattgggccagggctttcaggcctctctgtcacccaggctggagtgcagtggcgctatctctgcggctgctgagccttgcccgtctttggtgtgtgttatcagttcttactttaagaacattgattctgggccgggcacggtgacgtctgtaatcccagtactttgggaggccaaggtggacagatcacgaggtcaggagttcaagactagcctggccagtatggtgaaaccctgtccttaaaaatacaaaaattagctgggtgcagtggtgcacgcctgtaatcccagctactcgggaggctgaggcaggagaatcgcttgaacccgggaagcagaggttgcagtgagctgagatcgtgccactgcactccagcctgagcgacagagtgagactccatctcaaaaaaaaaaaaaaaacattgattctggccgggtgcagtggctcacacctgtgatcccagcactttgggaggccgagatgggtggatctcttgaggttaggagtttgaggcgagcctgtccaacatagtggaaccccgtctctactaaagatgcaaaaattagctggatgtcgggtgcatgtctataatcccagctgctcgggaggctgaggcaggagaattgcttgacctgggaggtggaggttgcagtgagccgagatcgtgccacagcactccagcctgggcaacaagagcaaaactccatctcaaataaaataaaataaacaaaaaaaaaacacacatttttttgagactttgcaaacctaaaaatgagtttattttaatctcatatttgatatgcagtctgtttacttgtagaattctgggttgaaaatcctttctacccaacattgagaaagcattacttttgtttttctgagacgaagtctcactctgttgcccaggctggagtgtagtggtgtgatctcggctcactgcaacctccacctcccaagttcaagtgattctcctgcctcagcctcccgagtagctgggattacaagtgtgtgccactatgcctggctaatttttgtatttttagtagaaatgggtttcaccacgttggccagtctggtctcaaaatcctgggctcaagcagtccgcctgcctcggcctcccaaagtgctgggattacaggcgtgagctaccgcacccagctctcaagaaggttggtgttcttttttccaatcttttgtgtttttctcatcttttagaagcttctctttttttgcaggtgctctgatttttttttttttttttttttttaagagacggtctcgctctgttacccaggctggagtatagtggcacaaacacagctcactgaagcattgacctcccaggctcaagcaatcctcccaccttcacctcctgagtagtgggactacaggcatgtgccaccttgcccagttaatttttaaatgtttttgtaaagacggggtctcactatgttgcccatgctggtcttgaactcctgggctcaaatagtcctcctgccttggcctcccaaagtactgggattacaggtgtgagccactgtgcctggactaaagttaggtttatatgtgaactcttaaacaggctgacctatccatgctgcggaccctacggagcgattttgcttccttccttccttccctggtctgcgcagtgcgcagtggcagcatcatctcagcaggcacctggggagggagacgctgtgtgagggaggccgtgccagggcctggagcacggccttgtaacgagcagatcttctctcgtgttttgtgagaaggaatttaacaaagaaatgccattcacatctttttcttttaaaatgaagttggcagagtagcctacgctttcctgggtgacaggagggaaggtccgtatctctagtgcctgtggaggcgtctggaacaaggagtcagcctgtgccctcctgttctgcggaccctctttctgcctttgtgctgtttctgtttctttcccctctgctcccctggcgtgtcctgctcttgagagttggattttctggtgtccctgttcattctcattggtccttgacatcccttttcggctaggaagtcacatgttctcactgacctcgctgcaggaggcacaggtgggaacaggtggtgggtgagaggaccacggcattcctgcctgcagaggatgggctctgagcctccctgcctgagaggcctctgcagagccaagtcactagtgcaaagacttatcatgtgccagcctgggcaacagggcgagaccctgcctctacaaaaagtagaagaaattagctgggtgtggtgatgcgtggctgtggtcccagctacccaggaggctgagctggaagaatcacttgagcccaggagttcaaggctgcagtgagccgtgactgcaccactgcactccagcctgagtgacagagcaagatcctgtctcaaaaaaaagaaaggctggtcatgtggagggagccgtgtcctgaaacatcagtccacacagggttcccgtgcatgggcctcgactacaatcatttccctgtccgatccttggctgttttctccacctgcagttgtaagtacttggatatgtgagaatttcctatgctttctaatgttatttttcaactttaaaagcttcagttacagttaaaccaagatctcagcatcttgcatcaagatgatggttcatctaagaacaagaggggcgtcctgccaaagcatgccacgaacgtgatgcggtcctggctcttccagcacatcggggtaaggacggctgggccagcccttgccttgcagccctctgcgacgcttgctctctggcttatgtgtcatggaaaagggttacttctctgggctcagaaaatcaaaggcctgactttcaggactttgtggcatgtccataatgtggggagcgtggggcactgctgcagggaacttgaagggcaatgagggctgccgtgaaggagcacccgagcacatgtgaggcgtacacgtgtgtccgagacagcccaccacgaagggtgatggggtcaggtgagccagaaaagtgggcagagaagggatgttcttgggcagcagctggggaagttgctgtgtttctgtgtgttggattaacaaggaagctgagatgggttagagacatcgcagggccgggtgcacccacaggtgggccaccgggtgggtgcctttcgctggaagcgagtttgtcccacagggcgcgccgttttgcccagcacgtgtgcacccggcttcctcccccgggccatggccgcgtcttctccctgtccccaggacatcttaggaagtgcagtggtgggcctgcttgctgagttgatgggggagacctgctctgcacgctgtgtggcaccattgctgccagcctgctgatccagggcaggagagagcaggcggggctctcctgggacaagcacagggaggccaaggcgggaaggcagacgccagtttggcttggccctaagtttgcccttctcccctgctgtcgccactgattgttgtgaggctgtggccatatccgcctgtgtcccagcctcctcctcctcggccttctgcactgcatctgccctgccctcccactgtctcctctccagggtgcctccgctggggctgaagcctgtttgtcctcagcactctgtccttgccctcccctgactgtgggcccctgagcccgtagccatctcgccatttcgcggcccactttcctctggctgcctcgggctcctcagttgaggatagggtccatgggagtgactggcctgagggcttgaaactggtgggtagtgttgctgagtggtcctgggaggagaagggccctctcctgggcagaaggcctggcaggagcctgggctgcgcctcttctgcttgcctgccctggcctcttggtctccaccgagccgcttccatgggcataaaaggtagcaagccacacatgtcaggagaaaggcgtgctacctgtgagcagcggggctgctccgagaaattggttcaaagagatcagtcacaagaaaacggaaagatttgtgtgtaagaatgttagtgtcgttcaatataataatggaaagcaggtcggcatgtagatggggacgtactggtttgatggagtatcatatgcatagttaacatgaggaatgagggctctaagcagtcgggaggtttagtgaaggataggaagtcaaaaggcagcatgttggtatatttacacacattgcgattattacagccaatcagtatatgtataacataatgatagaacaacaccaagtggtgggattgggtgagtactctcctttcaggtttcctttaatgttttaataatttctcaaacaataaaccctgcccatcatgtccagtgaagacgccgcgttttttcctgtggggcgtcctcagtccctcctcaccctcgtttcttggcagcgccgaccccctgtagtttcccgcatactctggggcagcatctctggctgtttggtgttttctgcttgtgtgctcgtgtttcctgccctgtttctattttatgagctttttaaagggggagaacagtatttctgtttccatgaccttgagctcagagccacacactcattgatggagtcaagttgagtcacactgccgttagtttgaggaaacaaacccatcactgctgaggcacatctgaggccgctccgtccccatgtgatgggcaggggtgtttccacgccgcactcagtgttcctttcacgtcaaagccaaagtaaactctcactgctgactttgctggtaccgttcattctcttgggtccttgttgatcccaaatcaagggctttagtgcattcaggttttagagtaaatgtcgtgttggtttccacatatagacagtcatcaaccttggagaaattatttaccatagctagaaatcattttcggttggtacttctgtgagttttgctatctagttctgattggattttttttttttatttttctgcactcccaggctggagtgcagtggcgcgatctcggctcactgcaacctccgcttcctgggttcaagcaattcttctgcctcagcctcccgaatagctgggactacaggtgcgtgccaccatgcccggctaattttttgtatttttagtagagataaggtttcaccgtgttagccaggatggtcttgatctcctgacctcgtgatctggccaccttggcctcccaaagtactgggattacaggcgtgagccaccacacctggccagatttttttttttttttcccagatggccaggctggtctcgaactcctgacctcaagttatccacctgcctcagcctcccaaagtgctgagattacaggcgtgaggcaccgcgcctggccctctggttggattttttgtatgtgaaatgtttcaatcatacataaaagaagaataccatagcaggcactcctgtcaccagccctgggttcagttccttactgacagcacaggtgaatccagcagagatctcaccccaggaaagccgtcgatggcatcagcttatcccagtgtcagttgattcctgtggtacccatgatggaaatttgtcccccagcctgcctggccatttcctactccacctgtttcaccagctgtgggatgggggcagtttgtaaacacttcatgcctcagtctcctcttctgtaaaataaagacactgacagtgactgtctcagcaggtgcttctgaggaatcagtgaattattatagaatggaccaaggtaattgaaatgtgctgtgtattgcttgtggcagaggctcccgggccagaacgcatccacccatcctctttatatggatgtagtttattgttcataagttaaagttcaataaagttgataaagaatctatagattgtatcaagcctggtgtagactcaccgctggactgcatagctgctcctcatgatgtcgctgctgttatcgtcaccgctgaaccgttaaacgtggggggcggtctgccttggcctatacgctaaccagccactgcagcactaggacattcctgggacgaggagaaacactttgttcgtgagactacagttaggttttggctagaagcactgttgacgtgaccattattttctaatgattatgtaatgctcacattttgcctaaatcgtcttgatttcctttgtaaactcgaaggccatggtaaccttctttttttattttcagcatccctacccaacagaggatgagaaaaaacagattgctgctcagacaaatttgacactactccaagtcaacaactggtaaggtgccctgcttcctgaaatcatgctgtcagcacggtagagcacttggaaaccctggcaccaatacatggtgaaatcttgctgaaaataggaggtctctctttttcttttttcccaactgagacggggtcttgctgtgttgcccaggctggtctcgaactcctggcctcaagtgatcctcccacctcagcttctcaaagtattgggatcatgggtgtgagtcactgcacccgactaaaaatatgagttcttttaatgggcaatgggagcaggagacttaggaataaaccaggttcaacctaagttttcatatcaatacctcattatggactgcatcctgcctgcctctttagagctgtttctctagggtgctactgtccccaagccccacattcatacaaaactgtgatgtgttgttagtggatgagcctctggatggtgggaggccaagagtgagaggtcctgccccatgaggggaccctctgccactctttcttgtgggggtcctgctccacagaagagtctgggagccattcctagcaaagaaacacccaggaggacatttcataaaacgtccccttctagtcctgctgtcaaacattgctgtggacacttagactctggccagatgtattttcttcagtaagggcttgtgcgtgttcctaggtggcactgaagtggggggtggtcttccattttggttattagtcacttgtcacatttttttaatttacttattcagatgtaggaaacagtttcagcttaataaaactggcatgcataaaagaagaaagcacaaattcttccagttgtaaacattattatctttatcttagctgtgctaaaatgtgaacttgttgaagttccagcaagaaagtctttgtctttgtgcagtcgtgtgtgcgggaggtatgcttcggggttgcataagtacttccatgatcctgcattcttgccattcttttagatgtgggtagtcacaacagactatactatttgcgttatttcctgttaaatcttttaaatagaatattaacaaaaatttaaagattctgagtatgttgttgctgcagtggttgttatattctgctcatgtgcttgttttcctggagctatgtggaaaccacatactttggttggggcacacctgtggtgggtgggctgaagtgggagggatgcgtctctggatgtgctggtgccccgtcactgctcagcaccctcctgcttttctgcattcatgatttcctggtgttccctgacttgctactatgttacattaacgaattgtcttatctaggtttagtatcaacttttaatttttagtaataataacagtttaataatataacttaaaaattccaaatttctgaaatctttaatatttgtagctacttttactttttgtgactttcttttcttttgtatttacaaacattacatcttggagtgagatacacacacccatcattagttcatgcctctgctggtagcagctttgaataagaatgatttaaaaacacattacaggccaggcgcggtggctcacacctgtaatcccagcactttgggaggccgaggtgggcagatcacgaggtcaggagttcaataccagcctgaccaacatggtgaaatcctgtctctactaaaaatagaaaaattagctgcgtgtggtggtgcacacctgtaatcccagctactgaggaggctaaggcagtagaatggcttgaactcgggaggtggaggttgcagtgagcccagatcgcaccattgcactccagcctgggcgacagggtgagactcagtctcaaaaaaaaagaaaacaaccaacacattacagtagcagtggggccttccctcccaggtctcgctggggttgtgggtggccatggagcttgtgctgcagggatcaccaggttcctctaaatgaagcatggcgggatccgatctgcttcattattattagactgtgtgctaatataattgtagatatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatcgtgaacatggctactcagctatccagatagagaagtctggcttttaatagatgagcaatgtgtgactctagcaagaggtcaactactttatcattcatgttactgaaaaaagaagacagaaacgaggccttaagcatggttggtattgctgcttttgcgttaggttggggtaatgcatgaatctggacgggttctggtttgataggcgctttcacgggacagatgttgtttttctttccgtttctttccatttcagctctttttgtagcaaagtggcccagtcagtggcatagggtggtgggtgcagcagaacgcatgtctggtttgctatctttgtcctctagtcactgcaggaggaaaagctggcctagggatttgagtctccttgcactttctcacatttaaaggcaacagctcatagcataagaatgggaactgaagacagcagcctttaatcttaatgtattttgagattgctatcatactcatttgatatgaaacaatgtccagcctgccttgccaacctgtgactgttgggccaggtgcagtggctcacatctgtaatcccagcactttcggagaccaaggcaggcagatcacaaggtgaagagatcgagaccatcttggccaacatggtgtaaccccgtttactaaaaatacaaaaatgagctgggcgaggtggtgggcgcctatagtcccacctactcaggaggctgaggcagcagaatcgcttaaacccaggaggcggaggttgcggtgagctgagatcgtgccactgcactccagcctgtgcgacagggcgagactccatctcaaaaatacagaaacaatgtccagcctgccctgccagcctgtgattgttgctgctctcgttctctgtggagtcttatcacaggcgtgagtgcctggtctgacagagtcgccagcgtctgtcggggatttcatcactgctggtgcctacgtgctgtgctggccacatgtctaggaccactggaggacttacgcctccagtcatctaagaaacagctcatcattgggaatggtttttgaaaagatgcagctcttgccttagatcgtgctttgtggtgaaacaagaggaggtggcagtcccattctctgatggctcagacacgttgccacccagaggctcggccccgttggtgatctggtgacgtccagacgagtgcagactgcccgatcgtctcaggcatgatggcactacagaaagtcttgcttctttaacatttttcttccttagggaaaacagtgtcagattcacaaattcaacagtatcatctatgtcgttatgagtatctagttcacaaacatgccctaaaggagttgagacaaaaaaaaaaatgccatggacgagttggtgcttatttgcatgatttttaaaacaacaggctctgtgtttctgggcatttagagaattcagaagagctgttgagtcctcttaagtagttactatagtggagaacttgagtcattctttgtagcgtgcttcgtagagcagcgtgtttgttagaaggatttgttaatcctgtatagggtctttacgaaggctgttttcatggaagcttctctttgttgactccaggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggtacaggtggccggccaaggccagacatggtggaccatggggtggggattatgaacaagaggcctggatcaggcctgttagctgtgagcctcaggtaatgtggtgaacgaaagtgcgtggttctctttctctgcaactaaaacatgaggaagctgcattctgcgtgcacgggagctctcagtaagagttaggagcaccagtagtagagaatgtaaaacacgtgatagagatatgaaatcattaattctgtctcaaagacacagtcatgcccatggatcttctcctttgcttctgtgtttgctctccttttccctccgacgccgggtgtggaggagggacttaccccgttctcaccacgtggcttctttctcttcatcccccatgcccttctcttgtttttgcttgttccctgtggcctctgctctccatcccctgacgtaggcagccattctgatgtgttttataggcatctttctgttcgcatgaggtcttcatattttggatggttttgtgtgcatgtgtttttatttttttttatttgtttgctttgtttttttttttttttttttttgagacagagtctcactctgttgcccaggctggagtgcaatggcgcaatctcggctcactgaaacctctgcctaccaggttcccgccattctcctgcctcagcctcccgagtagctcggagtagctacaggtgcctgccaccacgcccggctaattttttgtatttttagtagagacggggtttcaccgtgttcaccaggatggtcttgatctcctgacctcgttatccgcctgcctcagcctcccaaagtgctgggattacaggcatgagctaccgcgcccggcccagaaacagtttcttaaatccctgttgaacattccctaaacatatataggtgttttattttaactttaggtcaaacgagcaaacagcacccaattgagtaataaagtgtttttctgtgagtactaatttaaataatgacacaccttcatcctgccgcaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggcagaaaatggaaacaggtagcttttatgttttttattatagttttccacaaatctaattattttgatagttacaagaagataatgattcatcagtaagctaacataatccctttcatagtt

SEQ ID NO: 16962 - DNA, 7775 bp, Human
gaagcgggaatgatgctgggacctgcttcacagggtggctctgaggacccacaggcagagaggtctggtgtaggctttcgggggaagcacccatcactctcccagcgtttcctatctgcaccttaatttggcaccccagggaatcgctcctctggaattgtaaccttgcagggcaaaagctatcatttcaagattttttgggatcctgtgtccccggacagtgctgtaaatgtaggaggaagggtgctgctcatgggtgctgctcatgatggaggtgccccgtggagcacgcctcggagccccccctttcatccctgatcccatctgggatgtgtcaggtctgatccgcatacactggggcatctgacatttcatggccttctgagcccatgggctggagatgaatttgcaaagcccgggagtgtcctgggtgtgtgttcactccacacgcacgaatctgttagaggctgagtaggaactaggaggccaaagagaaccaggcaacttcccacagcctggaccgtacactagaaaagctagcctgggagagggggcatggcctcttcccaggctggcaggggggatgtgggggaggaccatgctccccagggccagtttaccaaaatatcaaaataccaaaatatcaaaagacttaaaactaggagtgagccaggtgcagtggctcacgcctgtaatcctacactttgagaggccaaggcaggtgggtcacctgaggtcaagagtttgagaccagcctggccaacacggtgaaaccctgtctctactaaaaatacaaaataataaaataataataataataataataataataattagccaggtgtggtggcaggcacctgcagtctcagctactcaggaggctgaggtgggagaattgtttgaacctgggaggcagaggttgcagtgagctgagatcgcgccactatatgatctgggcgccactctgggtgacacagcaagactccatctcaaaaacaaacaaacaaaaccgggagtgcctggacacttagtgagaactggacaggggccatgggtcgaggagcaaaataatcaccaggacttgtggataacaggatcatgtgggtggtgggtccgcatgggtgacagggacgtggggacatgtcgccaccctgacaggagcagcccaactcaacagccacggcaggtcatgccacggaggctcgaggcgttacgtggggatgttacatcaaggcattacatcattacgagatgtaacgctcgaggcgttacatcgaggggacgatggccatggggctgggcgtccagggtgggccgcagagggaagctcaccacgtggtgctctcatctgcccacagcccagcccgtcttcctgttggaggcatgtgacccctggaggacaagcatgaaacgccatagggctcccccaggtgctggaattatggcaccttgcagcttcttctccacgagttttaacaagcatgcgtacttttgtaagtggtgagtgtaacggaggttcacagatgcactccgctttggaaaccagtgcactcttgcccaggcccggtgagactctgaggacgatgtgtctaacctctgtgtctaacgggggtgtgggctctccctcctctggcgaccatgaggaccaccccggcaggacaaggtgtgcagagaactagcatggtccctggcacgtagcccctgcccagtgactggcagatgagaagctccattgtcgccccaggcgagtatggggcacaggcgcctccttgggttgtctgccctcccgggagccccagggtgcccaggcgggcctcagctgagtccaggcctcggggacagtccgtgcagcccctcctggggctgggggcgggcacttgtcccagccacgtttctgctgactgagcagccttcttcatgagctcacgcctttccagagaaatcccttaatgcctccattctgctggtggcatatatagggagggctcggccttggctccacactgcgctgcccagaggccccgctgactcctgccagcctccaggtccccgtggtaccaaagctgaacatggacgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggtaagacgtggcccgtggtgctggcctctcctcgctgctcagagggtggtggcctcggtgggtggagagcgatggactctggtcttgctccgtcaggcaggtggcctcgtcccacttcatccccttgcagaggctgggcgagagcctgtgtccccactgcagccacgtggcagagcttcccctggcactggggagagggtggacaagggagcagcctgaatccacctttgctttcctccatcagctcatgacccatgtgtgctttgtaaggcaccagccacatactggaaaccccaagagcagcccatccaggcatgcgtggtggcgaatgccagctcccgggttcctctggtctcctgagtcccggagacctgggagcaggtgggggtcatagtcctgaaagccagagagcagggcgttcctagcacctcctccaatgagctcggcctgcccacggctagcaaagctcttggcaagtttacttaggtgccctgccaaggctaaaaggacaggcaatggacgccccccccccccacccaaccacaggcctcctctctgagccacgggtgagcggtgcaggttctgctgttctggagggcctgagtcccacccagcacctcataaacagggtcctccccagggctgctgcagtaggcatcaatgccagggtgcaaaatgcctcagggagccaaggctgagccaggggagtgagaaggagcatgtggaagtgcgttttggagaggcagctgcgcaggctgtcagcaggctccggccgcttctatagacagcatgacaccaagggcagtgacctcattccacaggctgagtccagccagccagccaagcatcaccagccagacgattgaccctaacggaccaaccaacccgtaacgacccctcctaccataaccagtagccagccagcccataaccagccaacttatctataaccagccacctgaccatagccaaacaaccagccggcccaccagtagcattcagcccctcagctggccctgagggtttggagacaggtcgagggtcatgcctgtctgtccaggagacagtcacaggcccccgaaagctctgccccacttggtgtgtgggagaagaggccggcaggtgaccgaagcatctctgttctgataaccgggacccgccctgtctctgccaaccccagcagggacggcaccctctgggcagctccacatggcacgtttggatttcaggttcgatccgaccgggacaagttcgtcatcttcctcgatgtgaagcacttctccccggaggacctcaccgtgaaggtgcaggacgactttgtggagatccacggaaagcacaacgagcgccaggtgagcccaggcactgagaggtgggagaggggggcgagttgggcgcgaggacaagggggtcacggcgggcacgaccgggcctgcacacctgcaccatgccttcaaccctgggagagggacgctctccaggggaccccgaatcaggcctggcttttccccaagggaggggccatgcccacctgagcacagccagcccctcccggtgacagaggtcaccattcccgagctaatgtggctcagggatccaggttagggtcccttcccgggctgcacccagccgtcgccagctccatccctgtcacctggatgccagggtggtcttagaaagaaccccaggaagtgggagtgccccgggtggccgcctcctagccagtgtacatcttcacatgaaccctacctgaggaagccagtccccgacggcatagctgcatccgcttggaatgctttacaggcattgacaccttcgcctcacagcagcactttggaaccagtgtcctcattattccagggcacggctggggaacaagggggtcctcagcctgctgggtcccacagctagtaccgggcaggtggacgggagcttctccccacagtcaccctgatgccccgctcttgctcggctggaggcctcggatctccgtggtgttgagggagccggggcactggagccctggtgacctgcatctcctggcggagccgggaagagctcatggactgtcacagatggacagtgccccgcgggggctggagagcagagtggggctggaaggtggaactcttagccaaagtcttggtttcttttggccagggtcctctttcaatggctggagaaggtggtgctggggggtgaacgctgacctcctcatgtgctgcccctccctcgcctgggcccggtaaagcccccacgtagccccagccagcctggaacatgcttcctgagctcccagctcttggtctttgcacccagtggaggaggaggtcagcccagggagctgagtctgcggtttagggcgtccaggggacgtggaagcatgtgggtcgtctggccacattaggtagggctgcagagacctgggctagagcagtcctgcggggtctggaaggggaagactggctgaggtgcggggcctggtctggaatgatcctgcgattttggagtgaagccatggagcgggaagagacaaccccccgcggggaatagcccggcaagtggccacgaggccaggctgaggtccagagaagcaggggcatgaatccataaatcccagggggcctggccatgggatgtgctggctgcacccggcccctgtgagagcccccgcaggctggcccccttctgcagtcagtggggctggggcagcttctctggcatggggcgaggcagccgcctgcacagtggcccccctgactgtgcgcccccaccctctccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaacccgccgtctgctggtgctgtctccatcaggggcgcgaggggcaggagggcggcgccgggagggaggacagcggggtctcctgctcgcgttggacccggtggcctcggaacgatggggtcgcctgcgtcccttccttctcctgagctcaagcgcctccctccacactgggctggaaggagaggttttgggggcagagcctctgatgggaaagggactggggagcggttccgagagctgggggcggggagggacctggaaggggctgcagggaatggagggaggccgggctcctttctctgtccgcgccggcaccggggcgggacgccagccctggcctccttctgcggggccgtccggttctctcggggtctgctgggtcgtcctgttctctcgggggtcctgctgccttcggggctgggctttaagggcactcgtgcttttgaggaggtggaactcggcagcttcccctgggcaacccatcatggccccgagctggaggcggaagctcgctctgtcccctcccgggaccagacactgggcggccatgccagaccccgccacggggagggagactcggcctggggggccctggctgcctgctgcgctcaccgaggggcatccggggggccagagggcacccaaggggaagcagacgccacggcgggtgggccctgccagcgccctcagccaagtaaagcgccctcgaccccggaggccgaaggcaccgggaccctgaggcactgggacccccatggcaccagcaggacgaccacaggggcgcagcctccacccgggagaacacagacactgacaccaacgggttttcaaaaagtcagcaacaggcattagcgtgggcggccatagtgacgcccagtgacatcacgtgccacggacactgaacagcacacacaccacacactccacacacacacaccacacactccacacacaacacactccacacacaccacagacacacacacacccctcaacacaccatgccctttgtctctctttgtattcctctggccaggccgtggtgtgacgggttctgagtcctgggagtggctcccctagactccccccctcctcctccctccagcaggacctgcccggctgttgtgccatcgagtccccatttgtacagaagggggtgccctgtggttggcaacaacatgacccactgtgctttggggctgcggctggatgtttttgaaaatcggggtgtctggggctccctgctcctcctgggtctgtcccggaccagctgagcggacacctttgctctgcacagcctggcagccattgcagggaggcgggcccaccccaacatctggtagctccgggtcccgtcccaccggctgcacagtgaatggagctgtcactcacgcctgcagccttgcttgactgcgggtcctgcctggaccttgttaggggctggaaggtgactccctgaaaattatatggggtcctacccccaaaggctcagaatgggactgtgtttggcggtgggggctttgattaaattgaagtgatgtcactggggtgggccctggcccagtctggccggtgtccttgtaagaagaggagatgaggacacagacctacagagggacaaccccgtgagggcacagggaggagacactgtctgcaagccaaggagagacgccccagaggaaccggccctgctgccccttgaccttggactcccggcctccaggacccggcagaaacgatgtctgccattggagccgcagctgtggcgttgcagctgcgggaaccgacgcattcaggcccaaagacatagcctttggctaggccttggcagggtctgcaaggcccgtgggtggttcaccagatcctcgatcaggctccttggagagtcgcacggagcaccagggccagcccaggcagaacttcccctggctggtgggctgtctgatctcctctgctcccccagttgggtcttccagcagcacaggctcagcaaggacttgg

SEQ ID NO: 16963 - DNA, 18568 bp, Human
gaccttacctctgctttctccgaccacttctcccccaccccaggtacttcacagctgagagcctcttgccagcttccaactctccagcagtctttgttcccagaccgtgtcctgaggctgcactttctggacatgcccacctgctggactggcatctgtcttgtcacttctctggcctcacctctgcgaaaggaacacaaaagtcaggaccccagttcactctgtcaaaaggaaaagaatgagctgaaagctgagtcatgtaagcagctgcctttcctttcgttcctaagcagacggctacagatagaaggttcaacatccgcttctcttatgtaaagtgctgatttgctgaggagtgagctgtacacagtcgactgttcccaacctgcttcttttctcttgcaacgtgtggattaccacactgttccgctttcccctccagcccacttttcccctttaaatactgaagccctcaaagtcatctttggagaaaggcacagaccacagactgtttctgtgataccgtgttttttttcctcccaggcattgtccttaaccttggcaaaataaacttctaaattgattgagccctgtctcaagatactttttggtttaaacctctgaggccctactgtttctaatacaggtttccagtttgctcatctttcccaggtaggaagatgctctgttgccaagagaaatgcaattctaacacgcaaatccgcccaaacactagagctcagcattcagctctagccgagctaagaggatcccatggtcctgccccacagtctggggctcatcttgtggaggaggtaagtaaaataggccctgtctctctgacttctacctaatcagagttgatagttgcgttggaaattaggtaaatcgcaggtgagttgatgaatgtgggaaaccagatgaaaatggctgcttgatggggttaaaacgcaggagaggaatagaacccttccaacggaatggttccagccttgtgacatgaggagactgaaagggtatcccagaggcaggtcactggccttccagctccacctgtgggtggccttggccaggcaactgcaagagtgcagggccccggggaggtcgcacctggcaagcgctgagggagggtaaagcggagaggggtgtgagaagagaaaaacaacacagagcgtccgagctatgtgaggcgtgcgaggttaatccggcccggagagacaggtctatgcggcttcagcggtccccacccatgcctggcaattgtttaaaggcactattgctccggacccgctgccttcacccatgaacttcctttcctggaattatgatataaagaacaacgtacagccaattaatagcttgttattttcatgtaaattcttggtgagctatttaagaactgcccccctcttaagctttataaacccacttgtcactgttgcaaatcctatgttcagggcaacttgaagctatgctcccgggttgcaatcttcaaacttggcccaaataacctctctacttatatcaagtttgcctcagctttttttttcttctaggtcgacggttcccgccccgcaagggtgcagggaaggggacgcccgcacttcctagtgctcccttagctggggtcgagctgagcgccccccaccgagccccaggcggctctgtggagaagcccctcggccccgggttcggtctgcactgccagcccccagtccccggcgcgcaggatccagcagggccagcgccgggcgggcgagaaggcgagagagctagggccgggcggggagggcaccggcagggggcgcgggttcccaggaccgaaaaggcggagcctcccacgcgcactacgtgctccctacgcgcatgcgtcccgcccacgcgcaggcagcacctcgcctgactgggtagcgctgccacgtcggggcggggaagagcgtcgtcgcgtccgggtgacgtctcccgagggcgtcggcagggtcggcggcgtcggcagcagtgtcgacggcagcggcggcggcgggtgggaaatggcggagtatctggcctccatcttcggcaccgagaaagacaagtgagtgggagccccccgccgggggttgggcgcgatcggggcgcagggtggttgaggcggtgggagggcgaccggggaggcccaggcgggccggcgcggcggtggcgggggaggggcgcgcggcgggaaggagcggtggcccttccggccccttgcgcgccctccggagccgccgcctcgtgggccgcgcggcggaaaactggagcgggcagaatgaatggggtctcttttcggggcgccgcggccgagctttctccggccttggggtccggactggctgatcgcccgacgtccgggcctccgagtcgccgactcccggaagccgcctcgagccgcgctgaaagttgcctggagcatccgggccttttggacgtggacacgtttgttccaactttcggctgtgaatgtcctgtcgagcaagctctggtaccagcctcgccagtattcagtcgcttatctaacttagggtcctaagcgttggtgttttatccacttagccagcctcttgcctgtttaagcgaccgctgggccggcagtaaggagatatgacgagaaaaagtatggtggagactactggattaactatctaaccacaagagacgtgatccgctcttaacatacaggtgctcctggatttaccatgggattgcgttccgataaacccatcatgaatcgaaaatgcctttaataccccgataaacccatcatctaagttgaaaatttgtaagtcggtgactgttcttgaagacacaattctgatataaggaaaaagatgttttgattttttccttaaggttgcatgccttccctaatcaatcgttaggttaaaagcaaaacatttaatttcagctttaattgccaccttggcacgtactaatttccagtgagttggctgtagtttagactaaatggaatgttttcagacgtttgaaggataattcttactttgaaaacctaaagactcagcatctggcttaatctactctttagttatcttggcattcttcagtgccatacaaagttaacatgactttatgttttcaatgataaacccctaagtttgtcatagatgtttttaatgccacttttttcaaacgctatttaaaatgtttctcttttccaggatggagtctatcttgtaaaatgtcctcttcacacatggtagaatctcctgtgttgtttggatgaggaggctatatttctagcaaaattttaagccaaaatctaccagttatagtcactccagaaacatttagtgggggtcaactataggtcagtttctggagacttaaacatgggtaaaatttggatattatccttaaggaactcacggtatgatcttggcgaatgaatagaccagctctatcggaacaagagactcttctgagtttagggtgaagaactaacacatgtaggatcggggcatcattaatttctccttttcatatttgcatgtggcatgacttctgtcttgtaaaagtctatctccctatatttctgctataagcaaccacatttcaatctattgggctatactataaaggtcatggttttaattcagaaaagttgattatttaatctaggttacttgtgttttcttttcagggagacgtggggttttagcttccagggaacaggatcaactcctgaaaaatgaagctgatggttcatattaactttaattattatttaagctaagaataaaatatagatctctaccaattaaaaaatgtttagcttattatatgtttgaagttatagatgttttctagattcagggatatcctaatagcttgtctgtagtttaattgtgtggaataattggatattaattgttgaggcccagggcttgcccattctgaggtagtttttaaataagctttctttatttttagatgacttcctaaagatatgctattgtctaatcaagttaaataatctcaagacctgtaagtttgcaaatatatataatcactttcctctcctgataaatttggactttcccatctttattgctacctgataataaatcagtggctagtcagtcttcatggtccattagatttcactgaggttgaggcccttcaatcttaactctggattgactgtttaaaacataatggcacttggttaaaaaaaaattgaattttgaacaaagtctgtctggtaagatgtcctaattcatcagagatcggcttccctccctgacattgctggcacacaggcatgattgctggttccattggatatggatctggattgtcagcgtatttgaacagtattaagggagggttttgcagtagagacagaaggtgacgtaaggtggttcctaaggtgggttcggtcagtcccctaatagtttgttttcagtgtattgagaccaggagaattgatttacttcagacctattttttgaaactccctgttggtctggtgtcatgcgtttagagagactctgaacttcgttttctgttttccttagataatgatagcacttcatgagcaccatatgtgaagcacacatacgttctgtctgactctcagaacagtgccacattggcattgtcatcatttacagatgacatctgagagctagggtgacttgcccaagcccaagcagctggtagcagagttgggatcttaaccctcaccacaccggtgttttcaagagagaacttggtcgtggagaactggagaacagatactgcctaagttacatttagttttagactaatttaatactccatttaagaaacaaacagaacagctgtgcagttaggaaagtggaggggatttgaatgaggaggaggcgggttagagttagaaccgtctttgctgaacaagtagtgtgtttgcagaaagggaagttgaagttacgttgtcctaaaatacagcaaggaagaggaggtgcttaataccacggaaaaaagtctgtgtcatgtttctgtgaggttaaaagtaatttgatagtgtatgtcatgctgctgacatattccatgtgtttgatatcttcccagcaaaataatcagctctcattttcccttacagagtcaactgttcattttatttcaaaattggagcatgtcgtcatggagacaggtgctctcggttgcacaataaaccgacgtttagccaggtttgtttgcctttttttcatgtaaattataaaaacttcatgttcttttcaaagacagttaatttctacatattaagcaagtcattttttctctcgtagttgtattttccatttgtgttcataagtgtgttcttttatttaaataatagtgaggcaggtgatcgacttccagtggaaggtctgagaccaccactccttgtttttatcattagagaaactttaaaaatcagtttttgatgtttgtgtgttggctgtgcctgatatttgctgccctgccatcttccctaccccctctgatagacatgggtccagagggggtggccgtgccagccttgggttagcctcctccaggcaccagtggacacggagtgggctttctgctctttgctgtctccagacagtagaggtgatggagccaccttccaagttagcgtgattgtcaccaggcccatcatgctgctcgagcttctctggctgcgtcctcactttcacatccctagctgaggaaacagcgagtcgcatcacgtcatggaaacatgaaaaattaagctgaaaggtagaaaatgggccgtaaattgctcttagcgggtctgtttggttaattgaggagtgcctgttatcttgggcttagatccgctctgagttcagttcaatcaaaagttgtgagttttgatagttttatttttggttagttgaagaaaaggcaaaggttggtacactataaaggatcacttacggattaaagggagaaggcacctctaatcggagcagaaaacttgtgcccacgttgatgagaacatttgaaatttgaaaatcgatgcccaagtctttccagatggagggctggggaactccttccaacccacccttgaagtctaaatgtgcagcctctgagctgttgagtagctattatgcgtggtccctgggagctgccaggctctgcctttgagctcacatctgtctgtatacgttttcctgtaagcatttaagaaaatctaccactttgtgtaagtgagctgggagaaggaaacatgggttttttccggttgaagcccatggacgaccccacagcacacagtgtttttagaagggaagaggatgatggcttttccctccattatgctaattaccaagtggttagtataatagcagtctgtcttttgatagctctgaacatgagtttctttttacaaatttcaaaatcttggagaactagctttacattttctgtgtattgcaattgttttttctttaatgttttgatttatgaaccgaatctcccctaactaaaccagtggccatggattgtggtataaccaagcatcttaagtgaccacccagttctttgattttggggggtgtcccaagtgttgggctgagagaaatcaactgttccctattctaaaagttttctttaatctggctggaggcactttctttatgtttttctggatcatagattacctgagaatgtgaaatgtgaagttaatttaggcattccaggtcagtgctggggagagcccattggagctcgatggggtcagtagtatgtgtcagcttaagcatcctagtttgatgcgtgggtttgttttggttggttttaggcaatcctagccacccttggctttcccattagactgcattgcctctttacgttaagcttccttcattaaatagccactgccagaatacctgagtgagaccaactgaattttactgttgaataattgggctcagtttagcttttcatcagggttgtcatggtacggtcatttcagttcaaagctgagtcaagtcagctttgggaagcctcccaggcctgagttcagttgactcagggctgtacttggcggcttatggaagaaacggggccctgatgcaggtctgagtggttcagtgtggacagtttgtcagacctccctcttaggtggggtgggcttcccagctgcacacctttgactgaggaactcttcatacaaccactcccctttaaacagagctagaaatggagctggctggttttataaaaccaccacttacaaaactgcttcacgtggatattgttgagactaaacatttatttttctaaatcatgcgagtgattgctttagcttgtaaatctctagcataattcagggtgggtttctttataagctgcttacagtgatatggacgttaagattcatgtaatatattagcctactaacttaaacatggtttgttttttcagacaacttgattttaagaagaacggtacagtgtaaggtttcaagtctgcctgatccagtttaaagcacaagggctaaaaggattttttttccttaaaagaaggatcggaaaagagcaaatgttttaagctattgtattatgtaaacagagatcccaccaagaaagtgtaaatcagagccgggtgtccatgacagttgacagacctgtttggtgtgcctgttttgctaggagaccagagaacttgatgtactgcagacagctgagttacgcatttggttttgaaaaattatcttgtgtgaggaatatgattataacgtgaatttttccacatcttggtgtctgctagcttgaagtacaagaaaatattagtattctactatttatcttgcattaaaacactttaacattgaaaacgtgggactaatcaaaacaatacagtttcttcttggttgctggctgacttgacccaagtcactgctcaaactctgttttcataatatgatggttttggtgtactcttcagaagacaaatgtctgacttgcgggaaaaaaacaaacgtttagccatttgcaaacaaattgtctctttgcaattgtctaatatatgcacagcagccagtagaattcccctttttatttttttttccccgcagaccatcttgattcaaaacatctatcgtaatccccaaaacagtgcacagacggctgacggctcacactgtaagtcccacagttggagaaatttttttaaaacaatggtgttaaagagcccactcttaattgagacaaataatgttggcttctgagctgctgacatagagctgttgcaaacaggacaaggtgctggaactccttggcgcacacagcaagaacttgatacttggccacgttcaggaggcttatcccttctagggagggtcactggcccggccacctccattgattgacatttgtcatgagagcaggtccgtccatgtgaaacggatttcaacattttgagccattcattggtctttacagtgactgaacccctggcctttattaagttctttgtgtaaaattaaaactcttaggaatattaaggaatcaataaggtaagttgcccagtaagtgtgggttttatttcaccattataatttttcctccaggaagtggagatttcatgatatgtaacaattgtatttctctaatacagtaattttttccatcagtttatgtaagcattattctttccgagttcattaaaaattttctgccacatctaagaacattttggtgctagcctggcaaactatttgtgcttttacctgaattggaattttgaaaaggagagttttcacgttctgtaagcagaagtacaagatgggcatatcatgagacctccgttacaccgcagtgttagggattcaaggcagccgccaactgagaaaacgcctctgcttctccagaaaataacttgctctcttttcagcactgaatctcaactgaagcacttgccagaggcagccggttaagtgtttacctttaattttccataatataaagttgttgcgttttgtatttcagaccattgccctcttgaacatttaccgtaaccctcaaaactcttcccagtctgctgacggtttgcgctgtaagttcatacaagttccttccccggttccctgggcttgcgtgtcagagctcagtgtccactccatctggtctgccgtgctagtgtcaaggaccgcgtttcactagaggtggcaaggagctttcgtcccactgaccccatggaaacctcttttggagatttgaactcccaccgtgtgttaaaagggaaaaagtaactggaaagggtgccctttaaaacagtctagagctgggccgggcgcggtggctcacgcctgtaatcccagcactttgggaggccgaggcgggtggatcatgaggtcaggagttcaagaccaatctggccaacatggtgaaaccccatctctactaaagatacaaaaattagctgggcgtggtggcagatgcctgcaatcccagcttctagggaggctgaggcagagaatcgcttgaacccgggaggcggaggttgcagtgaactgagatcgtgccgctgcactccagcctgggcgacagagtgagactccgtctccaaaaaaaaaaaaaaaaacagtctggagctgctgctgccccttcttcctttactttggccgtcatcctagagggaatgtactggaattaaacgtcgagtcatattcttccctcttagagcaacaaaatttgaatgtttctctcactttctggaatttttaaaaagcaaactttttaagttattttttcagattttatttctcattagccttttttccttgaactccattttggagtgcaccctgtagttgtaagagcattgtgctgagagcgttccccaaatgagggtctgcagcttgcactgacccctgagttcctcacccaccagccccgtgccgacccgtctaacccgtgtgggggtgctccactcaaataggcccttggcagaaaagattgtccgttctgtccacacactgcctggatacagtctccagctctaggagatggaattggtttgctccatttagaaatagatcaaaactgggcattcagtagatggtaccaatatcttcctgtactgggaaatactaaatttagattgtgaatatttacctaatgataatttttagagaaggagatatcatagatgagtatgattgggaagttcagaaaactaaaatttgatttttacagccatccaactatagaatcattagaatttagtcatttatggataaattaaaatgaacacctggactcttgttaaaatcagaaagtccaaaccaaagataggcacttcccattcaccattctgttttaaagcagtaaaaattgaggtgcccttggatatccacaagcctaaattgagtacacccttgaaccagagcccctcagttaatggggtgaccgacatggggtagctgatcccagggggcattcccctctcgagctggccctgcactgggtggcctggggattgtgcttccttgcacagtggtgcacatttctatgtgtggatgagattttcttgtcaacttttcctgccaagacactaaatgcttttcagtgctaatactgacctgatagtagagatttctttccctgagtcggatggtagcaggatttacttggtaacccttggtttaaaatacctgtttttttgtttgtttgttttcttttgttttttaaggaaataagatcaataggcggagggaaattgtttctatatgcacttattaaataatttttgttaacaaccctgccctgggataaaagtgaatggaagtacatgactgagtaacagtaattaattctttgccctgatcgtttatttggggactgtatatgctttcttgactgacaatagaatgttgtattagttttcattgtgtctttatttgcagttcacagcacttttgttttgcatatgctacaaactaaaagtttagcaattacgttatattccaattctggagtccagattgtacaaattagatgaaattctaattcgtcattttaggaagaaatcaattacctaaaattactggctcttttcaacataccctttagtatgtaaaaaaataagcttcaaatgcgtgggttaaagttaactatcaatcccagtttaagaatgatatttctgtaagaaaactgctttattttccaagttgtagtatttaacataggctgagtcacaaataagtttttaattgtatcttaatgcagttgtctctgcctttcaagtcactttgattgaaacattttaagcagaacaaatatagccaataatttaaaataatcaccccaaaaccatttctcaaacctgctaaaactttgagcatgtgaataattttctcctcttcacattcttcttatgtgggaaggaagtgaatttgaaatattaaaatctgccctttggaataggctactttggccgtttataacttgatttctactcggggaggaaggtacattcccaatagctttccaattgggatatcctgtgatatgattggcaggctgtccgagtagttacacttaataaaatttgggttcgaaagcagattcctggaagttcaaaaataactaaaacagccccggataggttagaaagtgaacttaaatcattctcagaattagaaaataagaagttattttttatcttcaaagataaaaagggggccgggcacggtggctcacgcctgtaatcccagcactttggaaagccgaggcaagtggatcacgaggtcgagagattgagaccatcctggccaacatggtggaaccccgtctctactaaaactacaaaaattagccaagatcacgccattgcactccagcctggagacagtgagacgccgtctcaaaaaaaaaaaaaaaaaagataaaaagagttttgagcaagctcaaagacccgtgtgccagcagtcagatgcccacgttgggtgcacaggctaaggcagccggcccaatctggaaaccagtcaggcttttgccagcccctaatctagctgattggaacatgtttgttgatacaccagctctgtgatttctcaggtttagagaactctagaatttgatagagtgggccgggggcagtggctcatgcctgtaatctcagcactttgggaggctgaggtaagcagatcacgtgaggtcaggaggttgagaccagcctggccaacatggtgaaaccccgtctctactaaaaatacaaaaattagccaggcatggtggtgcgcgcctgtagtcccacctacttgggaggctgaggaaggagaattgcttgaacctaggaagtggaggttgcagtgagccaagatcacgccactgcactccagcctggagtggacagagactccatctcaaaagaaaaaaaaattaattaaatttgatagaatgatgatggggatagagtgtaaatttgccaaatttacccacgcaacagacatgattttacctaatacatgtgaattatgaagaataaactgatgaaaatagtttgggaatataaaacttaagaatacttgcgccgggcacggcggctcacacctgtaatcccagcactttgggaggccgaggcaggtggatcacgaggtcaggagttcaagactagcctggccaagatggtgaaaccccatctctattaaaaatacaaaaattagccgggcgtggttgtgggcgcctgtaatcccagctactcaggaggctgaggcagagaatcgcatgagcccaggaagcggaggttgcagtgagccgagattgcgccaccgcactccagcctgggcgacagagtgagactccgtctcaaaaaaaagaaaaaaaaaagaatgctttcatcagcaaaacattgtaacattccctttacttgagggcgtccacaataccgtaaggttgcgtgaactgtcctactgaatcttcatggttgcttggattttaatcacatcagaagaatttgagagcataccatggctggcagtccataaaagactagttaggaacatcagcttttaatcatcgaccctgctttcaggtttcattttaaacttatagaagaggggaagacatcagtgtgcttatttggcctttactctaaatcttaaaaggaagaaaattttaatatttcttagtttgagcccaggtgcggtgtctcacgcctgtaatcacagcactttgggaggccaaggcaggcggatcacttgaggtcaggagttcaagaccagcctgccaacgtggtgaaaccctgtctgtactaaaaattaaaaaaaaaaaaaaaaattagccgggcgtggtggcagtcgcctgtagtcccagcaactccagaggctgagacaggagaatcgcttgaaccccagaggtggaggttgcagtgagctgagatggtgccactgcactccagcctgggcgacagagccagactgcatcttgtgggtgtaaaaaaaaaatttgtagtttgagagtcaactttttcctcacagtttctgaaaatgtggcccttttgatgctgattaaagctggttgtgattttaacaccttagtagccagaatcgagactgtcatggggacatttaaaatctcaccacacttgacaccattcacaagtagccatgtggctcagtctcctgagtgctcctgcagagtgcagctctgccaggcttttctctagataatctcgtgtgtgttactgtagcagtttgagtttaaacacaagagttcactcggttaacatgttctaaccagcaagatttctgttgtttgcaggtgccgtgagcgatgtggagatgcaggaacactatgatgagttttttgaggtgagagaactgaactctgtgactgatagacctgttgatcttctgtatctgtttggaaggatttaaaatgtttctctgctaataaacatacatgagttatatctaatgacactttgtaatgtataacgagtcttaaaccactgtggtctcccttcaggaggtttttacagaaatggaggagaagtatggggaagtagaggagatgaacgtctgtgacaacctgggagaccacctggtggggaacgtgtacgtcaaggtaggagccagggcgagacggcggcgtggccgcttagtgtgccagggccaaggccaacaggcgaaagcgagacagtggtgcagccgcttagtgtgccggggccaaggccgacagaggatggggtgcctgtcgccatgcaccttgagatcctggatgctcaggcgcacagcagggctcaggtgcactggctcggcgcctaccagctgcgtcatatgtggcggtggccagcccacacgtgcgcccagccagcagaactgaaggacggaccgtacaccacagccatcgttatttcagtgtagaatatttagtacctgttggtttagaagctgtgtggactaaggaaaagttaggtttactcacatgtttggtttcttttttcttttttagtgaataaaactttatttgcctacacagccatatttgctcctttaaccagttgaatttgaaaaatgaaggcaacatttggcaaaatcttggactatcttgaagttaatctcattgaaaataaaggatttttcaattatcctgtaatactattccaccttactatacctgagtgtgtatatctctctctgatatacttggattggtaattgagaaagtcttattaaagcgtggatggcaagcacttctgtttttgtcttttcagtttcgccgtgaggaagatgcggaaaaggctgtgattgacttgaataaccgttggtttaatggacagccgatccacgccgagctgtcacccgtgacggacttcagagaagcctgctgccgtcagtatgagatggggtgagtgaggagtggccagtgacgtgactgagcacagttcggggccgtgtgcacacgaggtagtaaatgtctccttccaacccacccacagagaatgcacacgaggcggcttctgcaacttcatgcatttgaagcccatttccagagagctgcggcgggagctgtatggccgccgtcgcaagaagtgagtattcctgtgcccgttgttaagctcagtggcttctttctcccctcacaaccctcccccttccaaaaaaaaaattttggcataggtgtcgtttctgttttttaaaaggcagtgcttagaacatagtacatatttttaaatatccaaatgtcctctttggagaagaatattcacctgcacacaggtaacttcattatccaacttctcaagtagagatcagatcttagtaatcaagcaagagggcggttagctgggcagccgcggacatgaggctcgtggtgaaagtgggcatgcagtttattctcccagatattacgaagaagaagaatagatgttgtaacctcctttagatcagggatggcttccctgggacacattggaagaagaattgtcttgggtcacaaataaaatacactaatgatagctgataactttttttttaattgcaaaaaaaatctcataatgttttaagcaagttgatgaatttgtgttgggctgcaggttggacaagcttttgctttacatatttcacatgtccactggggtttcttttggttttgcttgttggttttagggcatttcattatgtcttgggatcgctggcatcctcccttcgggacactggcagaatcaggcccagcggtcacatctctctgatcctacatttaaatgtacgacaggtcacagagcagagaaaatcaagacgtcagaatcgaaccgattgagttctgagtctggagaggttctcatccctcttctgttaaacatggactagtaaatagatgggtggcgattgttttattgtcagcattcaagaagcataagagaaaaacaggcctgctctccccagcccaaaaacctgatggacacagtagctatgagcgcctgaagcgtggggtcagtgagggttgaagatggtatgtgtccagctcattttgattatgatttcctgtgaccatttgagttggttctagaagaagacagaagatgcaaggtattacacctgttcacttctaagttgcacatttttttctcctgaaacttttcacacctgaaatcagggtgtgtctcagtcacggcgtgcagtctcttcagcagtgtttttccttatcagtgccgttggcttgaggagctgcgcgtgttgagagagtgggtgtggttctgtgctgcgtgccgtggtttggatggcacggttttctttattttccttggttgcaggcatagatcaagatcccgatcccgggagcgtcgttctcggtctagagaccgtggtcgtggcggtggcggtggcggtggtggaggtggcggcggacgggagcgtgacaggaggcggtcgagagatcgtgaaagatctgggcgattctgagccatgccatttttaccttatgtctgctagaaagtgttgtagttgattgaccaaaccagttcataaggggaattttttttaaaaaacaacaaaaaaaaaaacatacaaagatgggtttctgaataaaatttgtagtgataacagtattcttggtgtaacttatttcttgtggaagttctttaaatttctttttctttataaatctgctagtcatcttggaggtaaagattaatatccatccaccactttgagtataaatgaaataatattttttatcttagggcatgaaataaaacacataccaggtgagatctacatgctaaataatccggaatttctcgaggctgtcatggaaagccttttggggtttcttttctaactggttagtgaagaagtgcttagctataatcagtagacacgctgtagactgcactgatgttgggaagaaggctgatctgtggtgagacacagtgggtgggcccgacccatgttaccttctcgttcctgcgagtttgtgtcaagaaccccatgtgttcgtgggagggagcgtggatgctcacacggcacactgagggccagtagtccgtgtccgtgtttccttatgccaatggctgtgggagacacagaagcctgcggtgcagatccgcctttagacactctggtattactttccccaagctactcgggtggcgcgtgctggtggtgtgactatggtgacagccagctgaccggtctggggcacctgccacaagtcagtgctgggggctgagcatttcattcctaagaccaaaacgttccaagtgaggccatcccaaaccatgcccacgtgtccacatacctcatcctcaaaaacctcctggctctaggtgggagtcacccaggctctcctgccctgctctgctccttgtgggggctcagtgacagatcctgctggtggagtaggggagtggctgggccctaactacacacccagtgaagattggcaggacatactacttgaccatctcatgaaagcccatttgtatgtgatgaagttcaagaaggtgatggtgtcgattcacctgggaggctgaagtgagctatgatcatgccactgcactccagcctgggcaacacagtgagaccttgtctcttagaaaaaaataggtttgtatactatagtagtgggcagataattttagatgggttggtggcagtgtttggcgatgtgggtggtgggcagaaattttagatgggttagtggcagtgtttggtgatgtgggtggtgggcaaatggtaattttagatgggttagtggcagtgtttggtgatgtgggtggtgggcaaatggtaattttagatgggttagtggcagtgtttggcgatgtgggccgtttcgtttatgtccttatactcgacatgtttccaaaaaaagtacaaactttttttttcttttaccttaactttggtcagtgatggccatttattaatttccactcagtctgaaggagggaagatggcaaaagttgtactttatatttcttaaccgctaagaatcagaaagcttatttaaaatatacatgactttgagaggctgaggcaggaggatcacttgagtctaggagttcaagacctgcctgagcagcaaacatagacccccatctcaacaaaaaataaaaaaattagctgggtgtggtggcacatgcctgtggtctcagctactcgggaggctgagatgggaggacccacccaagcctggtaagccgaggctgcagtgaggtgtgattgccactgtactccagcctgggcaacagagtgagaccctgtcccaaaaaaaaaaccagtaaatgataaaatgtgaatcaaaatgccataaaaagtgtcttcagacattgtagtaagaggagctcacagtcacacaggaagcctgtcaccctgctccccactcccccaccccagtgtgggtctatgatgcggttgaggtgggaaggtgagcatgaccctgagtgcccatgaggcactgctgcccctctggtgtgcgtggatcatggttgagaaagagcagcccagtgaaatgagtccaggcggtccaccagtggcagatagagttaagcttttatacaggtgctagggccaggcagattgtttttaaaaaggaagaatata

SEQ ID NO: 16964 - DNA, 133358 bp, Human
caggggaagaggatgaggaattcagaggagtccaggacaatcccgtgtgtccggctggaatctgaatggctggtgggaaccagcaaccaaaagaaaagaaaacaggtggcagtggagcagcagcagagaacaggatttcggggaaagaaaacagaactttttttggcatcctgagtgtgaggtgccaggtagagaagccaggctagcaaggcacatccgagctgcaagtaggaatgggctgggacaacaatttaggtttagaaaccaccagcatatatggggtacctggaactgtgagactaaacaaaatctcttggggagattcttaacagaatcaaagtcaggaattttggtctttattcctttttctatcagacttcccaggaaagtgtattttctttttttgggtagtctggtgatttctcttaaaaataaaacaaactgagaatgtcagtgatgggggagataatatctgttcttttaagcagattctaaatgtattagtaccatcagtaactaaataaaactttatcttaaaacctctattacacattgtagttcatattgtatgggctcactcaagagtttatagaaagtatttttggatcaggtaaatgaaatcatccaacagcagtgccgttaaaatctaaactacaaagccctgtgtgatctggccactgcctacatctccaacttcatctcataacactcgcccccccaaccccaacttattggtctttcaaaccactcctagggcacgtgaagctctttcctgcctctgcataggcggtttccgctcatttctcttcagatctgagctgattatcagcccagagaggccttcccagaacagcctatcaagaagagcaacctccttccctttttgctattatctggttttctttttccttttttcttttcttttctttttgagacggagtttcgctcttgttgcccaggccggagtgcaatgctgcgatctcggctcaccgcaacctccgcctcccaggttcaagcgattctcctgcctcagcctcccgagtactgagattacaggcatgcgccaccatgcccggctaattctgtatttttagtagagccggggtttcaccatgttggtccggctggtctcgaactcccgacctcaggtgatccgcccgcctcggcttcccagagtgctgggattacatgcgtgagacaccgcgcccggcctgctacctggttttcatttcctttactacacttacacaaggtctactttatttgcctgtttgcctccttgctttattactaatagatcctcgagggtagtgattttgtctgtcttctctcctgcagccccgtcacgtaaaggtgctggtcaaaggaaggcggcaatcaccgaccggacaccagggcaaatcagggcagcccagtgattcgagatgccggctggggaatcggacccatgtgggtcttttctcagcttccccgcttactgtgactttcataagtaacggaaccccctcaacccgtttccttaagtgtaaaaaggcactagacacagcaagaagcggttccggcagcgcggaaaccgaagcacacgctgggtgtcacgacaacacgtggaagccgcattccgtgccggggccctggccctagccccagccccggcccccggcccgccatgtggcgcggctgaccgcggccgtgcgcccacctgtctccctctgcgtcttcacgctgatgtactggcgcagcttcttcaccgctcggtcccggatgcccttctcgctggacgccagccgctgggcaaattggatctcggccggctgcatggcgggggccatcgcgcccgctggagcatccccggccgcgcaacccgcggtgccgctgcagccagccgagcgctgcggagcagccagccaccgtccgcccgggccgcgactgcacagaaggcggcggcggcggcgcgcgggctgatggcgtcacaaaggcgccgcggctcgcagcgcgctctgggagtgagcgcggcagtggccctggcagctggcggagcggcccagcccgtgtgcacgtggcgccggcgctgcctttcggttgccaaaattcaggctgtagacggcgaggttagccagggttaggacttgaccaggaagagacggaaggctgtttgtaaacggtctaggattttttgtttgtttttgagacagggtctccctctgtcgcccaggctggaatgcagtggcgcgatcttggcggtgatcctggctcactgcagcctcgacctcccagactcgatcgatcctcccatctcgaccgcccaagtagctgagactacaggcgcgcgccatcacgccccactatttgttatttttttgtagagacggtgtctcgctatgttgcccaagctggtctcaaactcctgggctcaagcaatcctcccgcggcggcctccctgatcgctgggattacaggcttgagccgccgcgcctggccacggtccaggatctttaatcccatttagcacacctcgttgagccagcagcttacctgcgatctccgtggcgtggagtttttaactgtggagcccccgggcccccgggtggagttgagactggaaggaaaggccggcactggggcctgttgagcgggtggagggctcgccttcctccagtgcctgcagaggcttgggcagatcggtgcgcccctaccccggagccctggtgccagtgcaagggcgcccgcgcaggcgtcccgaggcctggcgagcacgcgcgcttccaggggagttgggcagggcgggctgcttgctaattccagagagggaagaaatcttagctttgggttcatctaaaacccgaggccatcctatattttgcggactcagcgggcgtgctggggcaagttaatggactaggtcactccacacgtagcgggggttatctcagttgctccgctcagttgtctaggcgacctcccgaggtgcctgttgacacaaaaattcaacccttaacgtaaaagcgcctgaatccgagcgagggaaggcgcgcggaggcgaggtttccagcaaagactgcccatttgaacgcagtcccccttagtgtagcattcctcgccaaacaggaaaggacccatccgatttattttacttgacacttacatcaggggctgactttccttctgctttgcagataacaagtttaaaaccccggctaagccagaagagccaaagagggacctcgccaaggccactcctcgctctctaggccgagaatactgcgcaaattctgggaggtttgggcctggcggctctccgttcccgacccccggcgtggattcgttcccgcgctttctggcgtgaggggtcagagggcgcgccgacgctcaggcgaacggagcggaggcggcagcggccatgggcgaagcgggcgccgctgaggaggcctgccgggttagtgaggaagccctggccgacgccagcgtgtttgaaccgtcgccattcgctcccctcagggcctcgccccgtgcgctcggagacggctcgctgtcgcgtgcttgggggaagcctggagacttcctcccctaacggcgtgggctgggccggagcggggtggagacctggggcgggaggcgacttcgcctccaaacccacgcggggacccggtctgtgaggctgcgcgtggtgggggcactcagtggcgccaaagcgggcatgggagcgtgggatggatggtcactctcttctctgctccgtggaagcccagttcccctccgaaggccctggccccctgcttcgggacttagcgtcaggcttagagagaatctgccctccatcgattttataactgtaactgattgcatgcgatggagaaggcgcttggactggggccagatccgtgttcacatcctgcttccacccgttattaattgtgctgcattgagagtcatctagctcccgtgccttaatttccatctagacaatcttggaggcttggggtgaatagtagatgagatcacgggcggagggcttggcaaacccagtaggaaaccagatgacttccttttcctcctgattagtttggtgctgcagtgataaaaagttgcaggcgttttctttgacttttaggaatagagctcttgtatgacttttctttttcgtggtcttgctctgttgcccagactggagtgcagtggcacgatcatagctcactgcagcctccaactcctgagctcaagccttcttcccgtgtcagcctgctgcgtacaggcgccggccaccacacctggctaatttttgtatttttagtgagatggagtttcaccatactggtcaggctggtcttgaactcctgacctcaggtgatccacccgcctcggcctcccaaagtgctgggattacaggcgtgagccactgcgccgggcctcctgggcacgttttcatatttttgtagtgacagggtctctccatgttgctcagactggtcttgaactcctggcctcccaaattcctgggatttcaagtgtgagccaccatgcctggcctgtttgtccttattatttttaacatctggctccctttttgaaggctgaagcttcagctttcaaaatgtttgtatgtacataaaatatatctatagcagaatatacagtaggtagagacatgatttgaaacaacgatgcacataagaggtgtgaaagaaaagcaagttaacttgagctgttgttttttttctcatgtgaagagaaatataataagatctgcttgttcttttagcacatgggaactaaagaggaatttgttaaagtcagaaagaaggatctggaacggctgacaactgaagtgatgcaaatacgggacttcttacccagaatactaaatggggaggtgctggagagcttccagaaattaaagattgtagaaaaaagtgagtcttcattttcagcagtcattggtggtaacagtaatttgttctagcagatttaccctaggtaaataattgtaaacgaattttaaggtactcttacagtccttgtgatgatatttgggagagtctgatgacctaagaaagggaggtttcctcagtgtagtgacttggacatatgtaagttggtataagttggttgccagttttctgagcatctattaacagcttctctttctctctctcttcattggcagaagaattttatacttttgataactgaaaagctctattctgaaaattaagtacttactgtgtaagttaaggatcttgccaaatggaaaccttgcatggagtttacttgtcagtagagatagctggaagtgtgttcacttatctttaggtggatgggtgagccagtatctagaactgattgaagtttaggctttctggtgtccattcagacttttgagatttgagctgagctgttatgttgaataccagtttaggagcctattgaagttcctggacatactctgagattgtctcagcacttgcttgattgaggccaaatcatgattaaatcagcctttgacggtaaaggccaatttactgcatgacatttggttgttatccctccctgtgtgccctctagaaaaggtgcatccagggggcccaggtagctgtagcacttgtccagacaagaagatagctcaccccgagaatatgagtttctggcatgtgcaaacgtatctggtcagtgggccagccacatccagttagaagggacagttctcatccaccgtaccttgtcctgtttatattctctccgaagtccttggatccagtcttctctgccctgtggtgtgctctgggaggtagatccctacagatggggctctcctggttcccttgctggctgccagtggggctcaccaatggaaggcattgctgggtggagagagaggttggggtgtttcttcctgctccctccctgctttgctgctgttttgtggcagtagctgcatccctccacaacagagactcctgtctagaggcctcttccgtagtcctagctcttgctggactgcccctgctcctgtggctgtagggctgttgctagtccctgggtacctcgctgtcccttggtggttctgttatctctgctctcccctctgtaagtggtcccttcagaaaagtctcaacatctgggttgatttctctttcccactgggactctgccagatacatggcgtgtcattggttgccagaatgccaggtcattgacttctaatttctctagttttgatttcatgctcatccagcaactttctgagattagtcattccttgtgcatttatcttcaggaaaggaaggtaaataggcatacaccagtagcagcgtatggcagcctgctggttggttatattctcactgtaaattaataaactggcattctaaaaaatacatcagggtctcatgagttagttaacatgagtgtctttagtgatcagtcccgctgccaaaatcaaaccgagtgagggccacaaacaaatctgtggtcacttgatcacagtctgcctttgggagatcttatctcatagtcccggcctttcccaggctatagagtcacctttttccccatagtctctctggcaattcctgcttattcccctttgctgaaatttatccttctctgctttgcagccttccaatagggcttgagactcaggcctaggccccgctcattgcctcaccccatggcttctccctaggcagtctcatgcacactcacagcttcagttaccgtcttgatgccagtggctgctggatttactctctagcccagaactctccaagctcacggccttgtgcctgactccgacttggcatttcttcctgcttgtttcatgattatttcaaattctaaatgtctgccctagcctaatcagtctaaggtcgccaggaacagacccacagtctgacagagtgaggtttatggctctttgcagtgaggaagaccataccagaacaccgagaaactgtggggcatgtcaacaaaaaagaggatagagttgttgtaggacttggagacagagtggtattaggtgaagcataaatgaagcaaaatagaactgtgtctaaagggaccaatattaagtctgactgcgaagcggacccaggtcccgtttccttgaaaactacaacgttcaaatagacgtggaacattgttctagaaatcccttacttgaagctctgcagtagctggaaatagggttcttttctgtgtcacagtgacttagatcctgcaggcaagagtgggatcttcttacttgtataatttcaaagaacaaaatttgtgcgagtctgggattttacagaataaggcttctcagtgaataagaagttagcagtcactcaaagaagaggtcattatgacactttacagttgcattgtctttgagagatattttctgttaacttggcacctgactttatctgtgtttgttattccagcctgacagaagtcaggacagacttttgctttctcggtgcaagctgatttttacttcctgttgtcatatctgcctcatgctatctgttccctgcccctgtcttacactggcctgcctcagtctccccagagcaccaacacccagactagagacccaggagtcttccttgttacctgtctctcttcctcactactccgcatgaaacctgtccgctagtaagtcttgtgagtgttacttcatggatgcatcctgaatcatcagcctgcgtctgtctccactgctgtgttctgcctcctcctggcggtctcctcactgccactctccagtccctcagacacactgtagcctgagtagtttgtggcagttcaatctgatgatgccattcacctgcgtaagtcttcagacgcttctctttgtttttaggataaagagcaaaaacctaaaaaccccacccagactcattatcatccaaaaacctaagcaaaaccatactacggcttaaaaggctttatattattgggcacagccccggctcagagtcactgcctaatctgactacctcgacatgatcaatcttcctttgaaatgttgtcatggtaccctatgcttccttcagacacatggttttatttccattttactttataagctgttgggagtgcagggcccctgattttatctgtcattatctcggcccctgattttgtctgtcattatctccctggctgattattcggtcttgagggagcaccctactgtctctgcatgcccttctttctttctctctctctcttccttccttctcccttcccttccctcccctcccctccccttcccttccccttcccttcccttccccttcccttcccttccccttcccttcctttcccttttctctctctctctctctctgtgtctctctttctctctttcttccgagtctcactctgttgcccaggcttgagtgcagtggcatgatctcagctcactgcaaccctgcaacctctgccccctgggttcaagcgattctcttgcctcagtctcccgagtagctgggattacaggtgtgtgccaccacgccagctaatttttgtatttttagttagagaccaggtttcaccacgttggccagactagtcttgaactcctgacctcaggtgatctgcccgcctcggcctcccaaagcactggattacagttatgagccactgcgcctggcctgatgcccttctttctagtttgcagtcctatctcatgaaactcacatgtgctccaggaaacgtggtgttaacagaaaggaaggatcagattgggctgggctggttccaggaggtttactgtggcctcctaaggcatcttttatctaattttggcttttgagtttttaccatttagccaacatcaagaaaaataaaaattcttctttttataaggcctagatctgatggccctccccaagccttcccacgagcctgtcttcctagactaatcatgctagacatgactctaagaatagagctctacagaggaaattcacgattgtactgtggcagcaagagccgtttgacatactgattcttctactctcccactagccctattgtccagtatccactccttttgcttctagaggttaatgtgcacttccagttgttttttttttttttttttttgatggtgtctggctctgtctcccaggctggagtgcagtggtgtgatctcagctcactgcaacctctgcctcccgggttcaagctattctcctgcctcagcctccagagtagctgggaatacaggcgcctgccatcacgcctggctaatttttgtatttttagtagaggcaggatttcaccatattggccacgctggtctcgatctcctgacctcaagtgatctgcccgccttggcctcccaaagtgctggaattacaggcatgagtcaccatgtgcttccaatcttaagcagtgactaaaggcaacctgaaggtaggaatgaatacaggcagggaaggagtagacctgatttgagaagtttcttttagagtgtggatatagttttgtttggatgggcttgggctatacagtaacttgtaagccagctagaggattgaggtgacacatcaagtagcgaatggggcttgattttgactctagcccagcatctccctttgggaggactgggcaaggtaaatggcagtttgcaataatactgacgaaggtgttgcctgagagtcttagggagttgatgggtactggggagaggcatgatttgttaggaggagaaggggagatattctaggccagggcggtggcatgtgaaagtcacacatgggattgagcaggaccgattgcaggttcatcagctagtgtttgattgctgtatggaataaggattgggggtatagcagaattagggatggaaaatgaacagtttatggaagacaatcatagattgtttttaatttgagatgagagtcaactggaaattaccacatggaaataaccatcaaaatagtgatcaaaatgacgttttttaggagaatggtttttataggtgagtgtaggataggtttgaagaattgggtggaagatgaattagagcattcatcaaggaaggtcgtgagttccattagtgtgtgggactgtggctgtatggatggaatggaagggacgtttgattagtcttggtggttaagtcaggacaaagtgtcatgatttatgatcggcagtgagagtatggagatacaggatcatctatatactgcctgctgattagtgtctacaaaatgtggacagtaatgcttacctcataggctatggcaaagcttaaaatgagataagctctgtaaggtgtgtgccactgtgactggctcataggagtccctggtaaataacacctcctcagatggtgtgggaaactatgtgaacccttggggaaatgaagagagactccaattcacagcccagcagcttagcttctggctcggccattgtcacttcatgagtttgggaaaagtttagggaggttcgagtaagactcagctatgtttgcaagagatgtaaaccgggccgggtgcggtggctcacgcctgtaatcccaacactttgggaagccaaggctggcagatcacttgaggtcaggagttcgagaccagactggccgacaaggtgaaaccccatctctactaaaaatacaaaaattagccgggtgtgatggcatgtacctgtaatcctggctactcaggaggctgagacaggagaatcgcttgaacccaggaagcagaggttgcagtgagctcagatcatgccactgcactccaaactgggtgacaaagtgagactccatctcaaaaaaaaaaaaaaaaaaaaaaagcaagcctgaaaacactataggaacctccatttgacttgttaaggtagtggcacttaagtacttagtaagatatcaccctctgttttctttcatcccttcttgtgctttattcatccaacagtggtgaataaatcagtgggtatcaaaaatttgtttaaaactaggaaaatcctattttttataaataaaattttatgggccgggcacggtggctcatgcctgtaatcccagcactttgggaggccgaagtgggcggatcacgaggtcaggagatcgagaccatcctggctaacatggcgaaaccctgtatctactaaaaatacaaaaattagccgggcatggtggcgggcgcctgtagtcccagctactcgggaggctgaggcaggagaatggtgtgaaccccagaggcggagcttgcagtgagccgagatcgcaccactgcactccagcccgggcgacagagcgagactctgtctcaaaaaaaaaattatataatagtatatgatggttctagatgtaaaatagatgaaaactgtatcttctgggtatttgtttttaaaattaagttttagaacattgacttataaaatcagtaagtacaatgaaggtggtgcgatgaaaacacaaatttagtatcagggattttggaaggtacttggatgatcactttcagcatccagtttgtttttagttttgcttgtgaagtcgcaagaagacacaatcccacagataaggagttgcagatggtggttttgaagtagttcacctagcaacatgaagacactttctaattaaactgatatgaagcttgaaataagaggagtcagatatttttgttttacaattaaatcgctaagatcgagcaattctttgctttccttgattggcaattgttcattttggagagaaataataaaaaagccattcagtctgtttaaatcttcattgtcttacagaaaacacttttcatgcattatgctgcatttgacaatttggcaccttagtggcagtcagatattcactgacagtctcagaggagctggaattatttttgtatgttgacagcacacctaaaatgttggcctcatttctgaaataattaaaatgttaaataattttaaccttttaaaatttgtttatatgttttttgatgttaatgtgaaccagccttgttttggtcattgaaaatatcagcagtgaatgcgaactagtgtagccatgatacgctggtgagatatttgaccaacagatttttctttctttttttttgagatggagtctccctctgtcacccaggctggagtacagtggcatcatcttgactcactgcaaccccagccttcctggttcatgccattctcctgcctcagtctcccgaatagctgggactacaggtgcgcgccatcatgcccggctcatttttgtatttaaaaattttttttcaaaaaaataaaaaaaaccccaaactgaaaaacaaacaaaaggccaggcgcggtcagcacacctgtaatcccaactacttgggaggctgaggcaggagagtcgcttgagcccaggaggcagaagtgacaatgagttgagatcatgccactgcactccagcctgggcaacagagggaaactccatctcaaaaaaatttttttaattaaataaatgaatgatgagcaaatgaggcaaacaaaatgttaatagtaggtaagtctgggtaaagagagataacaggaattttttttggcattagtttttgtgaatttgaaattacttccaaataaaaattgtaaataacattgtaaaatggagatattaattgaatgtttatgggactgtagttgttccccaggtactcttagattcttagcagtaggatttgaaaaccactgcgctatgtgatttctaaagtgtaggatattttgagattaatttcctgagagtttgatacggggtacccccatttcagttctgggaagaattatttgtagtctgtagaaataagaacttgagaaatatccatgaagagtagaaccaaagagtcagcaccaaaaaaggattattactttgactcggagtttattgtggcccagataaaagaacatgaagagtgtgtcacatccatatcctggcagggaacaaaaggagtaaacggagtaaagtgaagagattaaagtgtgatcagggttgggggaaccagtgcctggagaaagaagcatccgggaactaacgagtggagcgccattgcctcccctgggctgaaggagcagaagggagagaggtaccagacgtggcgagaggcgttgctccagacaagatgcttgacagcacctgggacctcacccaggaggatgaagcccagcagggaggatggagtggggagacatgtcccatccttggtcatcttctctagtcctccagtttcctgcggggctgctattgcatccaacaggaagccataggacgagggagccttgttactgtgggtcttcacatctgcctcttggggcacagatcagggtggagattgtccagaacataggaaagtagagggaaaaaaaacacttggggagcttatggacagagaaggtggcaaggtggtcaagatggaggcggaagaggtgtgtggtgttttaatatcacccgtgaccgctctgctgttcatgtcatatatgtgtgtcagtgaatgaaaagcaaaattccctgactctggtttgggaaatcaacagaattaatttgagttcagcaagattgattttagttttttttttttttttttttttttgagatgaagtcttgctctgtcgcccaggctggagcgcactggcgtgatcttggctcactgcaacttccgcctcccaggttcaagcagtcctcatacctcagcctcccgagtagctgggactatgggcgtgtaccaccacgctgggctaatttttgtatttttagtagagatggggttttgccatgttgtctaggctgctcttgaactcctgacctcacataccaggtgataaagaaatggtaagataaattgacgccgtttgtgcagttttctttgattagtgttttagaaacccttattttcctttctagctttctgtaccctccctgtgaataaattgagcatcaagagacacagccattctcatgttattagacctgtattaagaaaggattatggactgcgtgcagcagctcacgcctgtaatcccagcactttgggaggccaagatgggcagatcacttgaggtcaggagttcaagaccagcctggccaacatagtgaaaccccatctctactaaaaatacaaaaattagccaggcgtggttggtggcaggcgcctgtagtcccagctactcgggaggctgagttaagaggatcacttgaacctgggaggcgttggttgcagtgagctgagatcgtgccactgcactgacagagagacaccgtctcggggaaaaaaaaaattgttgtttcagaagatacatagatgtttaaatggtctatgatttaggttgtttgtaatattcactgttcatattatttctgtctctgggcttaaaaaaatataaaagtaatatattcttattgtatgagaatgagacatacagataaagtagccatgtgtttttcttggttcaaagattagcagaaggaatgtataaagaagtgaaataaatttatgtgacaaatatttatgtattgcctactatattccatatagacatttggagggtgggcatagaagaaaacctatgcaaatccctgccttcagggtgcttttaggtagcatgcatgcagtggggccaagttgaaaatgcaaggtcagggttctgttccgaggcagcagcaatgctcccatctggccacaaggtggcggcctcatacagcagaagggcacttgtcacctccccaggagcctggcgtagatgggtgtggcctccctgatgactgactggaattctatgagattgcctatcgtagagtgggatgttttaaccctgtccctttggtatgttaacttacactagggttgcatacagctgtctggaacaagtgattatgaaattaccgtaatgcaagagagccgttttgggtggtcaaagttaattcccacaggtttttacacatgataaggcttgtagagatttcctgtctcttttaccatgtttgagtaatataccgtttaatagtagaagccaaatttaacagttaaatgcaaagaaaaaattttaaatcacaaatttcatctcagtttttcagtttgttcatttttgtctgtgaccataggtggtatttcatatgattgtagtgtgtatgtgtataaataatgtatttccatttaactttgttacaaataatgcaagtatgtagtttttaaagcatagtgcttcctagttgattttttggctgggattaggataaaatcaagaattccagtgaaagtcattgtggcacaatatttcttaaaagagcagaaaatgaaactgtgatttgagggagaggaaatagtccaaaggcactctgctctatttctgagaaccacttttttttttttttttttaagagatgggagtcttaccctggctggtctcgaactcctggcctcaagtgatcctcccacctcagctttccaaagtgctgtaattacacaggcataagccaccgagccgggcccctaagaaacgcattttatgagaagctttgccagccaattttatgatgtttagctggtctgaatatttacttttaggttctaatttttcttctaggacggggtctctagaaaatttagagactagcttgctttcttccttcctttttaacatttcctttagagctttggggatacacgtgtggttctaagcagtccccacaagtgtcttattctggcttcctcttgtcctctcagacccctagattcgaaagccctacccgcttctcgtttgtttgcagatagttgaggaagtgtctgtgagctttttctcctctagggtggagtaatgttccgttttccaggcgcctggctctttgaggctttctcactcatcgcaagtgacagtacaagaatgaaacagataaccagagttgccttgtgtttttctcagttcaaggattaggagagggaatgtgtaaagaagtgaaattccttcatgtgacaaatattaggtagctgccttccattactctccatttttttgctttttcacattcctgtggatgggttcccttgtttgctgttgctggtcatgtgttgcatgttcattttattttattggtgatgagagaccaggttatcgcccagaagtagttctcaaagtgtgggtcccagacaggcagcatgagtctcatctgggaacttgttagaaatgtaaattctcaggctcaccccagacgttccaaattggaaactgtggatggaacccagccgactctgtattatcaagtcctccagggattctgatgtacgctaaagtttgagaatcattgtcctaaagcatcgctactttaatcaaagaagttagaccattagctcttagcaccctcaaatcttggtatatgttggcataaaaactgatgatttcctagcttttgagatcaaacacttaaaaatttgtattatatatttgttttttcgagtgtcagtatttctgcaacataaaattttaaatttaaagttgatagtacttttgcttgatttattgacgtggatttttttgggatttttgttggctgttgttgactcatcaactaaatgagtgcggtggagaggaagtattacatagtttccactctttcactatagcattttctcatttttatcactgttctttccctcctccagtgcctactactgcagttgttcccattgagtcagtctgccagtgggtgacactagctttgtgaatcagcctgtgctggcgccgtgcactccctgagctgccttctgcttttcatggagtagcgacaagtctgtgccatgagacagtcgggcttctcagctctgccttccatcctttaaataacatgttttcttgaagccttgagtactagtctggcagtaaagtgaaaccttaaaaacacaaaacagaaaacaaccaaagtcctttgtgctgtgggctaaaaactgagatgaacttagagaacaggactgttagaatattggttattcaaggacaggctagaagtcaagaaatgcaaatattctcacctaagaaatcagtacacattttactaagtcaagactgggcaaaatagatgcttagggagagattagtgacttgaaatatcttgagtaattttatgtctttctcctagacctggaaaggaaagagcaagaattagagcagctgaaaatggattgtgagcactttaaagcccgcctggaaaccgtgcaggccgacaacataagagagaagaaggtaccatgctcagggacagactctcaccaagccagaaagtggggctggcttacagcctttcacttatgataagcagtgggactgaattttttactcttaatcctcaataaattgtatttgtaaatgtatgtattctgagtgggttggaatgtagttgaacagatggattttataaccatttaacacgtagatcattcacttggtatcttttaacttttatgtttaaaaatctgccctacaacataaaggttcataattatcttagttcattttgtgttgctataacaaaatatctgatactgagtaattaattttttttttcctttttttttttgagacagagtcttgctctgtcgcccaggctggagtgcagtggtgcaatctcggctcactgcaagctccgcctcctgggttcacgccattcccctgcctcagcctcccgagtagatgggacaggtggccgccaccacggccggctaagtttttgtatttttagtagagacggggtttcattgtgttagccaggatggtctcgatctccagacctcttgatctgcccgcctcagcctcccaaagggctgggattacaggcgtgagccatcacgcccggcgaggctgagtaatttataaagaaaagaggtttatttatgtcaagattttggtggctggaaggttcaagattgggcatctttttctggtgagggcctcaggctgcttcaaatcatgacagaaggggagctggctgtgtgacgagatcacatgatgagagaaagcaagagagagaaactgaggaagccagactctttaccaacctgctctcagggaaactaatccattcctgtgagagcaagaactcactcaccctccagagagcacattaatcgcttcatgaggaatccactcccatgacccatacacctctcactaggccccacctctcaagagtgccacattggggatcaaatttcaacatgagtttgcagggggacaaaccatagcgatgagagtctcggaggaaaaaatcatgtacataatatcttatagttggacatagatgtattaaatcagaagtacatgtaattaatttggggattattacattttagccagttatattttatataaatattagagaaactaatatttcttaaaaattgcttagtttaactttttgtgtggcataacttccttttccatagaactagaactattctgacactttttataaaatttggggcctggatatatttttattttggatgataatagtactaacaggccaggtacagtggctcaagcctgtaatcccagcactttgggaggccagggtgggcggttcgcttgcggtcaggagttcgagaccagcctggctgaggcaggagaattgcttgaacctgggaggtggaggttgcagtgagccgaaatcgtgccactgcactccagcctgggcaacagagcgagactctgtctcaaaaaaaaaaaaaaaaaaaaagaaaagaagccattccagtaaatgcatactgagaagaaggaaacagccatggtaaagtagcattgaaatcgctagggttttgttgccctggaactttgaccttaaaatgtgggaatattttacccaactattccctatttatagttaaaaatcttgttgaatagtccaatttaatatagagggaagcccctgcaaggtgaatacagagggaagcccctgcaaggtgaatgcagagggaagctcctgcaaggtgaatacagagggaagctcctgtaaggtgaatacagaggaaagctcctgcaaggttgctgtaacaaggccatttctcttctagcagctgccttatctgtagcctttgctgtagtctctgttgaggcctgtacggatcatgaggagggactctagaaacttattttatttatttatttattttttgagacagggtgttgctctgttgccaggctggagtgcagtggtgcaataatagttgcagtagcttcgacctcctgggcttaagcgatcctcctccttggcctccagagtggctgggactacagagatgtgccatgacatccagctaaatttaattaattaattaatttttattttttacaagaacaattctattgtataatttttaaaacaatttttaaaatttttttatagagatggggtctcactatgttgcccaagttggtcttcaactcctgggctcaagtgatcctcctgctttgggcctcccaaaatgctgggattacaggcatgggccactgcacctggccctggaaacttattatagaattgaggacccaggaaagaatccagagactagatcctcaattagattactgctagtaagtacttttttttttttttttttgagacagagtcttgctctgtcgtccaggctggagtgcagtggcacaatctcagctcactgcaacctccacctcctggatacctgggattacaggcacgtgccaccatgcctggctaatttttgtatttttagtagagatgaggtttcgccatgttggccaggctggtcttgaactcctgacctcaggtgatccatccactttggtctcccaaagtgctgggtttacaggcgtgagccaccgtgcctggctgctagtaagtacttctgtatgagtgaaaaattactaggaaaaggcagaagttattgagttcaatatgtaagaaaaggtcagaaacaaagtatggaacccaaatcataaagtgtgatgtatgagcaagcagcttctgaacccctagagaaaggctactcaaacaaggaagactttgttcctggccatggtggagatgtttcctccacagagattttgttgggtcagtggaggaggtgcactgggtcttgatacctgcttatgatgtgaggaggctgggccaggaaagagtcctggcagtagcaacgtttgaactttagaggaaaaagatcccagcttcctggtaaaggcacaactgttggagaatattggccgggcgcggtggctcacgcctgtaatcccagcactttgggaggctgaggtgggcggatcataaggtcaggagatcgagaccattctggctaacacggtgaaaccccgtttctactaaaaaaagaaaatacaaaaaattagccaggcgtggtggtgggcgcctgtagtcccagctactcgggaggctgaggcaggagaatggcgtgaacctgggaggcggagcttgcagtgagccaagaaacttttaaaagaaaaattgtagttaagctaaaatacagaatgaactacagaaagatattgaggaaatcttgggagttttgtgcttgataaactgttatgtatgagtattcctttaaacaggaaaatatatcagggtttgattattgtttctttaaaacagcattattgaggtatattttgtaccacaaaaatttttttgcattgtaattgtatagtttgatagtttttagtaaatttatacagcttttttttttttggttaaaattttttggtccaatcccactggaaacaaaaaaatttttttgtgtttacttatagattcactagaagtttcaaaaagtccagggaagttatctatacccttcacccggttttccctagtggtgatatcttgcgtaactatagtagaagataaaaaccaggaaattggaattggtacaattaacaactttcaggtttcaccagtttcacctggacttctttgtatttcatcaattctgtatgtactcatttgtgtgtgcatgtatgtacatagttctgtgcaattttatgacatttgtagattcatgtaaccaccaccacacttggaactgtaccattgccgtaaggctccttggtgctacccctttatagccacatccaccccattccctctgccttgcccctggcaatcactaatacattttccatctctaattttgttatctcaagaatgtcataacgtagaataaccttttgcgactgacttttccttgagacagagtctcactgtgtcacccaggcagtgacatgcagtggcaggatcatggctcacagcatccttgacctcctgggccaaagcagtcctcccatgtcagcctcccaagtagctaggtccacaggcacatgtcaccatgcccagctaatttttaattttttttgtagagacaggttcgctatgttactcaggctggtcttgaacccctgggctcagttgatcctttggccttgtcctcccaaagtgctgggattacaggcatgagccatgggtgcctggcagagactgactttcactcagatacatccaagttgcatgtatcgttagatatttttattgcctcatattccatggtatgtatatgttgcaatttgtttgcaatatgttgtaattcctccactgaaagaagtttgaatagttcttacggtttttttttctattactgataaagacactagtaacatccatgtataggtttttgtgtgaatgtgtgtctttatttttgtgtgataaatgcccgagagtacaattactgggttgtatggtaagtgcacatttagttttggaagaaattgccaaattgttttccagagtgtctgtaccattttagagtcccaccaaaatgtatgagtgattcactttctccatgtcctaaccagtatttggtgttattctattttgaattttagtcattttgataggtttgttgtggttttaatttgcatttccctaacagctaatgatgttgagcatcatttcatgcatttattttctgtctgtgtattctcttttatgaaatgtttttttcgtgtcttttacccatgttctaattggattttttctttttttacttttgcgtttgagctcttgatatattctagatagaagtcctttgctgagtatatgttttgcaagtcttttctcccagtctgtagctgctcttttcatcttcacaggttctttcaaaaagcgaatgttttaaattttaatgaagtccaatttactgatttctccttttatagactgttttcttgttgttatgtctaagaatttttcacatagctctaggtcaccacaattttctcccattcttttttcttaatggttttatagttttacattttacatttaagtctatgattcattttgagttaatttttgtagaaggtatgaggattaagttcaagttaatatttttttctttggcttatcgttgtccagttgcttcagcactgtttctcaaaaagactctctctccttcattgaattgcttttgcaccattgtcaaaattcagtcatactggcctgggtctgttgtgggttctctactcaggtactttgatctgttcctgcaccaataatacattattctgattactgtagcgacatagtaagccttaacactggataaaatgattcttcccatttcattcctctttttcagagttgccctaactattctagcttctttgcttttccgcataaattttagagtaagcttgtttatgtctacaaaaaccttgctggaattttaatagaaattgtggtacgtttgtagatcagtttgtagagaattgatatctttactatgttgaatctttcaattcataaacatagcatgtctctccatttctttaagttgtctttaatttctttcatcagcagtttacaattattttcagcatctagatttgtgttagatttttacctaattattttcagcatacacatttgtattagatttttacctaagtatttaattttatttggagtaaccgtaaatggtattgtgtttttaattttggtttccattttttaattagcacatagaaatgtggttgctttttgtttgtttatcttgtcccccaggctggagtgcagtggtgtgatcgcagctcactacaacctctgcctctcaggttcaggcaattttcctgcctcagcctcacgagtagctgggattacagatgtgcgccaccatgcctgggtaatttttgtatttttagtacagacacagttttaccatgttggccaggctggtctcgaattcctgacctcaagtgatccgcctgccttggtctcttggtgctgggattacaggtgtgagccaccgcacccggcccctgtagtctttctgaactctttttgacttctaggagttcttttatggatttcttgagattttctacatggacaatcatgtcatctgaaaataggggctgttctagttcttcattctgctttgtataccttttatttcttcctctttccttcttgcgtagccaggccttccagcactacagcactgtgctgaataagagtggtgagagtggatatctttgccttgttcctgatctcaggggaaagtattcaatctttcagcgttaattatgattttagctgtaggtttttgcagatgcgtttataaaattgagaaggttcccctctattcctagtttgctgagttccttttttctttcttttttttttttccagagacagggcctcactctgtagcccaggctggagtgcagtagtgtgatcaaagctcactgcagccttgaactcctgggcccaaaggatccaattgcctgaacctcctgagtctataggcatatgccaccatacagctaattttttttttttttaagtttttgtagagatagggtcttgctgtgttgccaaggctggtctccaagttctctctcttgtcaagtgaacctcccaccttggttccttaaaatgctgggattacaggcatgagccactgggcctgactgagaatttttatttatttatttatttatttatttttataattactgagtgttggattttgtccaatcaacttttagaacatttccatcacatatctgttgcaattagtccctgctctcttgcacagccccaggcaaacactgatctttctgtctctttagatttccttttctgaatattttgtaggaacagaattatataatatgtgtataatatgtagtcttctgtgtctggcataatgttttgaaggtttatttgtgttatagcatacatcatttattcttttttattgcaaaacaatattccattggatggatatatcacattttcttcatccattcaccagttgatgggcatttagattgtttccagttttctttttttcttttttattttatagatgcagggtttcgccatgttggccaggctggtctcgaactcctggccccaagtgatctgcccgccttggccttccaaagtgctgggattataggcgtgagccacttcgctcgtcctgttccagtttttgactgttatgaataatgccactataaacatttgtgtacaggtttttctgcggtcgtatgttttcatttttctttatttcttttttttttttttttttttgttttgagacggggtttcgctctcgcccaggctggagtgtagtggtgtgatctccgcttactgcagcctccacctcccaggttcaagcaattcttctgcctcagcctcctgagcagctgggattacaggcttacgccaccacacccagctaatttttgtatttttattagagacagggtttcaccatgttggccagactggtcctaaactcctgacctcaagtgatccgcctgcctcggcctctcaaagtgctgggattaccatcgcgcccggacacatttatatgttttctttggttaaatatctcttcaaatcttttgcccatttttaattgggttgtcttattgatgtgtaagaattctttaatctggacacaagtccttttttagatatgtgattagaagtactttctcttagcctgtggcgtgtctttttactttctttataaggtatcttttgaagagtagaacttttaagttttgatgaaacttactttattattattttttaataggtcatgattttgtgatatctaagaaatatttgcctaacctatggtcataacgatttttttgagaaattttacatttatgtttatgattctctttttttccccttcgttttttcttttcttttcttttcttttcttttcttttcttttcttttcttttcttttcttttcttttctttcttttttttctttcttgagatggtgtcttgctctgtcacctaggctggagtgtagtggtgtgatcatggctcacttcagcttcgaccttccaggctcaagtgatcctacttcagcctcaccatgcctggctatttaaaaaaaatttttttttttttttgtagagatggggtctcactatggtgcccaggatggtctcgatcctcccgtctcagcctcccaaggtacaattagccactgtgcctggcctatgattctgtttttttttttttttttttgagatggagtctcgctctgtcacccaggctggagtgcagtggcacgatctcggctcactgcagtcgccccctcctgggttcaagcgattctcctgcctcagcctcccgagtaggtgggattataggtgggattacaggcccgtgccaccatgctcaactaacttttgtatttttagtagagacggggttttaccatgttggtcaggctagtcttgaactcctgacctcaagcaatccacccacctcagcctcccagaatgctaggattgtaggtgtgagccaccgcacccggccctatgattcattttgaattattttttttttgcatatgaatattcggttgttttagcatcagttgttgaaaagactatcctttttccattgaattgcattggcacctttgttaaaatcagttgacatgtcagtgtttcactgatctatatgtccatccttatagcaataccacaatggttctatttcggtaggtttatagttagttttttcctctaaatcaggcactgttagtcttctaacattgttcttctttttcagacaattttttagatattctgtcttgaatttccatagaaattttagaatcagattatcactttgtacagaagtctgctgagattttgatagggattgtgttgaatctgtagatcagtttgggaagaattgacatcctgccaatttttgaacatggtgtatctctttatttagctctactttctctcagtaatgctttgtagttttcattgtataggtcttgcaccttaaaaaattattcttatttttgatgttactgggaatgctatgattttctttgaggtttgtttgttttttttttgatattattatactatgtgtggaaccctgcgttggggaatatcctcctgcaactaccaaatgtgactgtagtgagcaaagtccttcctggttcttctcagtagtctttttgtggtcgtgcagaagaaccaccatatcctgactaattgagatgcagacagcttaagttgtgagaaaagctagaattccaaaaggaagtgctgtgacatagttttcttcatgtgtcaccatgacttgtgttcagctacgtacactgaaaggatgaatctaggagtccagattgttgctataatgaagacattaaaaacccggagctgacagatcacatgatgcagtattagcatgtgccagaggctcagtggccatttttttcttaaatacatgtgtgcatatacgtatgaatgtgtatgaatctctgtgtgccaaacgcattgtctccaggtaactatgagtgggccaccctaatccaagttatgaggtcaacagttttgatttgtggctccaaagctccctttttcctccagggggtgaaaagccccctctactttgtcttgtatttatctctctaaaagaaaatctacagcatttaatatactttaattttgtggtttatgtaactaattacatttggtataaatgaatttaactggggttttatatttttcagtttttgtcttattaaatcaggaaatgctatcaccttttaagggaatttcaggtacctggtgctggtggttggagaggacaggaagccccccatcactctagcagtacactcaaggtgaatcctcgaagtgtgcttgtgttgtcaggagggccatcaggacggccattccctgtgtttcccttgtgaagagtgccatggtggagacttgcccagctacaggtcacctcagacactgctggtgggagagtaggaaactcttcctagcctccatcttcttcttagactggcactggcttgctgcaccagggcatgaataggactcccagccttcacacttctttttgcccctcctcccatctttcctacctggtcttaggttttaggttttctttccctgtttagcttcacagattgtattttatatttactggcacctttggcaatattctcatgaggagttaaggatacgtttatacaggatgagtttttctaaagtacttgtttttttacaaatcctgatgtccaagtgccttttatttggtgtctgcctctggcagatggcgttttttcaatggagtgagccatttggaggaggcagtctcctgtcttagaaatgttgctttctgggtaaattgctttgtgaggttgtttttgttcagaagcctcggttggtgctggttctgggtatagttacttggggcttgagatatttcatgtagttacttaaagcagatgaattcagctctgtgggtttatcaaccataatgtggtagtatgttctttcctcagatatttctcaaatatttttgcctttgaaatttcttttgtagatacagattatggttctcttaggactagctttcatttgcaactattttctataattatacatgcatttctttaataaatatctttgtgaaagaggaaatgtaataaagatatatcaaggttgaatgctattatttatttttcaattttgttttgcttttaggagaaactggctcttcgacagcagttgaatgaagcgaagcagcaactcctgcagcaggcagagtattgtacagaaatgggagcagcagcgtgtaccctcttgtggggtgtctccagcagtgaggaagtcgtcaaggccattttgggaggagtaagtatggtcagtgggctctccagatattgttgattactgcttgtgtaaattagagcatatagcttattaaggcatttaaagactaagtccatatctttccattttcttttgttcactcatcagctagttattgaatacttatcgtatatggttcattgtaacctgatgcaaagggaatgaaataagatcccttctctccaggagaccttgtggtatatgtggacatattaccacttcagtattaatactttacatgtgtttaagaagatcaaaagtgcttttatatatattatctcatggttaatatagtatttattgaatattgtgttatctaacatatatacatgtatgtagatgtgtgtgtgtgtttatacatacacacacacacacatacatatagatgcagaaccttgagcaacatggaggttggaggcgctgaccccctgcacagtcgaaaagccacatagaacttttgactctctctactgttggctggaagccttactgacaacataaatcgttgattaacacattttttgtatgttagatcatcatgaaggtcttccccctcatcatcttcaaattgagtaggctgaagaggaggaggaagaggagtggttgggttggcattgctgtctaaagggtggtagaggtggaggaggtggaaggggaggctggagcagcagacacacttggtgtaacttttactgaagaaaattcttgtgtaagtggacctgtgcagttcaaacccttgttttcaaggttcaactgtgtgtgtgtgtggcagcgtgtgtgtgtgagcatgtgtgtttgagcatgtgcatgtgtgtgtgactgtgtgtgtgtgtgggagcatgtgtgtgtgggggagtgtgtgtgtgtggggggggagcgtgtgtgtgtgggagcgtgtgtgtatgggagcatgtgtgtgtgggggagtgtgtgtgtgggagcgtgtgtgtgtatgtgggagcctgtgtgtgtgtgtggggggagcgtgtgtgtgggggagtgtgtgtgtgtgtgtgtgagcctgtgtatgtgggatcgtatgtgtgtttgtgtgggggagcatgtgtgtgtgtgggggagcgtgtgtgtgtgagactgtgtgagtgtgtgtgtgggagcgtgtgtgtgtttgggggagcgtgtgtggggggggagcgtgtgtgtgtgtgggagcatgtgtgtgtatgtgggagcctgtgtgtgtgggagtgtgtgtgtggggagcgtgtgtggggggggagtgtgtgtgcctgtgagcctgtgtatgtgggatcgtgtgtgtgggagcgtgtgggtgtgtgggagcatgtgtgtgtgtgggagcgtgcacacgcacatgtatgcatgcgtgcaggcatttgtcagggaacttcacagaaggggataaatttgaaatgggccttgatgaataggtagaaatggcagaaaatgggtgggtttgttttaggacagtgagtaggtcagttgacacagtggagagttaatgtcatagagtagtggggaggtaaagcttaaacgtaggttgggatgtgactttgggaccttgaataccaggttggtgattcattctgtaggtgggaagactggattttccctaagggtttttcaataaaagtgataggataagagcagaattttagaaagattcacctgacagtgggtgaggatggattaggaggtggagttgtggcacatcgcgtctacacaggatgactgatgaggtggtcattctagctggtctggctggagtgagctcggccctctgcaggggagatgggaaagaaggaacatgtatgagagctgtggcagttgaggcagatgcgatggccgggcagagtgggcacctggaggggacaagaggagccaaaaaagatcggtgtttgactctgggagcatggcgtgatcatgactggaaatgaaggtgaagagggggacgtgtggcaggaaaccagtgagaaattagttactgctaatagaaataacagttgtgtttgactttaggtggaaagactaaatgtgtttttaaaagtttgttgagctttattaggtttaatttacatactgtaagattgtaaatgtacaatttagtggtttttagcaaatttttagagttgcattaaccatcaccacaacccagttttagattatttgatcatccatgaagttttcttatatcatttgtaaatgcaaatatttccaattttttaactgggttaaaatgtacattggttttaaaattcttcttcagaactctagcaccccaaaggaagtaactcaaaggttcaaacttggaaatgctttttgccaagtgatgaagatttaaactaccagaggagccagtctttacctcttttacatgttttcattaagatttttttttttgaaaaaagttatgctaaaggtttgaacacctctggtttaatgcccagagcaaataggcagcatgtttttctagtatatttttattacattttgagtgaattcttcccatttactttcatcatcatgtacatttgtcctatatcatatttatgcgtgtgaagagtccaccaatcttcagggtagtttttgttgctcctgcatgcctcaagctgctttctctgttcttttaatgggaacttttaatgagggaatagattttacaatattctacaattaaaactagaatcttctgtatcctgcacttttaaaatgttttcacactagtgtctgtaaaaagatatgacactctgattttcaaactttcaggataaagctttgaagtttttcagcatcactggtcaaacaatggagagttttgtgaagtcgttagacggtgatgtccaggagctggattcggatgaaagtcagtttgttttcgctctggctggaattgtcacgagtaagtgcaggcgcacctgagagatgttgcctgtttgcttccagaccactgcagtaaagcaaatactgcaataatacatgagtcacatgaatgtttttggtttcccagtgcatatacaaattatgtttacactatactgtagtctgttgtatgtacaatagcattatgtctaaaaaatgtacaaactttaattagaaaattcattattgctaaaaatgctaatgatcatctgagccttcagcaagttacaattttttgctggtagagggtcttgccgtgatattgatgactgctaactgatcagggtggtagttactgaaggttggggtggctgtgccaatttcttaaaataaggaacaatgaagtttgccacattgattaattcttcctttcatgtaagatttctcagtagcatgtgatgctgtttgatagcattttttccacagtagaacatctttcaaaattggagtcagccctctcaaaccttactgctgctttgtcaactaagtttatgtaatattctgaatctcttgttcttatttcaacaatgtcttagcatcttcaccaagagtagattccatctcaagaaaccactttctttgttcttccataagaagcaacttatcctttttttctgccaccacgtctgtagttacttactccactgaagtcatgaacccttcaaagtcatccatgaggattgaaatcaacttcttccgaactcctgttaatgttgttattttgacctcctcccatgaatcatgaatattctcttgttgcccaggctggagtgcaacggcgtgatctcggctcactgcagcctccacatcctgtatttaagtgattctcctgcctcagcctcccaagtagctgggattacaggcatgcgccaccatgcccagctaattttgtatttttagtagagatggggtttctccatgttggccaggctggtcttgaactcctgacctcaggtgatctgcccacctcagcctcccaaagtgctgggattataggcatgagccactgcgcttggctgaatcatgaatattcttaatggcatctagaatggtgaatcctttttagaaggttttcagtttacttcacccagatccatcagaggaatcactgtctatggcagctgtagcgttatgaaatgtagttcttaaaaaaaataggacttgaaagttgaaatttctttttgatatatgagctgaagaataggtattgtattagcaggcatggagtcaacattactttccttgtacctctccatcatggctcttgattgaccaggtgcattgtcaatgaacagtagtgttttgaaagaaatctttttttctgagcagtaggtctcaacagtgggctgaaaatattcagtaaaccatgctggaaacaggtgtgctgtcatccaggctttgtttttctatttctagagcataggcaagagtagatttagcataattcttaagggctctaggattttcagaatggttaaatgagcattggcttcaattaaagtcacccgcaccattggcccctaacaagagagtcagcctgtcttttgatgctttgaagccaggcattgacttttctctagcggtgaaagtcctagatggcgtcttcttccaatagaaagcgactttgtctacattgaaaatctcttgtttagtgtaaccaccctcggcagtgatcttagctagatcttctggataacttgctgcagcttctccatcagcacttgctgctgcacgttgtttttatgttatggagacaacttctttccttaaacctcatgaagcaacctgtactagcttccagcttttcttctgcagcttccttacccctgtcagccttcacagaattgaagagcattggggcttttctctgaattaggctttggcttaagggatttttgatgatttttgatcttctgtctagaatacttgggctttctccatatcagcaataaggctgttttgcgttcttatcattcatgtgttcactggaatagagcttttaatttctatcgagaactttgcatttgcagtcataacttggctgtttggcacaagaggtctaactttcagcaggtctcagctttggccatgccttcactaagcttaatcatttctagcttttgctttcagatatgtatcttttccttttgcttgaacatttagaggtcattgtagggttattaactgtccgaatttcagtattgttgtgtctcagggaatagcaagttcctaggagagggagagaaacgggaatggccagtcattggaaaaatcagaagataagtagcatgtattgattaaatttgctgtcttacatgggtgtggctcatggtgccctaaaacaattacagtggtaacatcaaagatcattgatcacagatgaccataacagatgtaataataatgaaaaagtttcaactattgcaagaattaccaaaatgtgacacagagacatgaattaagcacacactgttggaaaaatggcaccaacagacttgctcaatgtagggttgccacattccttcaatttgtaaaaaaacagtatctgcaaagcacaataaagtgaatgcaataaaacgaaatgtgcctgtaattcttttcagctgtagtgactgttacagagactggtgtttacagtcagggttgagagtgtgtaaacatctctcaggagtgttttcagatattaatgctggggagcaccctggataatctgattccatagttctgggataggtaccgggtatgtttattttggaaaatcaccccaggtgattctgataagtatcagttattaagaatgaatgatctgaaggaaacagatgagtttgcatgttctgtgtagttatgtaccttgacagaaaaaaacaagtaagtttagctgcttttattcagaatcataattttactgtctggctagctaaagtaaaagccttaagctaagcttaagctgagctctttgctgttgttttagtataataattatataattccaaaaacctaaattgcctcttcagtaaaattctcctaaaagataataaagtaaacctttccctgagagttatgataaaattccgtctcagaactatcataagggataaagtccaggaactaaataatttctcagtatagaagcaaggcatggtggcttacgcctgtaatcccagcattttgggaggcttgaggcgggtggatcatttgaagtcaggaagaattcgagaccagcctggccaacatggggaaacctgtctttattaaaatacaaaaaaattagccaggcgtggtggcgcacacctgtaatcccagctactcagtaggctgaggcaggagaattgcttgaacctgggaggtggaggttgtagtgagctgagatcgtgccactacactccaccctgggtgacagagcaagactccgtctcttaaaaaaaaaaaaaaaatttcttggtatagaaagaggtggaatgtactagtgagtattgaggctctttgttctgaagtcagtgaaatggttcaatacattgctgtgacttatcagccttaacgagattcagaaaatatgactaagtacagagtttatttgtgcacagagcttgacggtggccactcagaaacaccaacttcaaaccagtggggtcagggttccaaagtgaagaagatatcactgatataggcagagacagagaagttccagcaggattagaacattttccatacaagaccagtgtgtgtgccacagtgatttgactgtttatagattgctacattccaaggagggttatctgaggaagtcttatcttcagcagtttggtcttaattatttacaggaaagaaaaatgcagaatttgcagccgcatatctacattcctcacaatggttgggataatttaaagtcccaacagctttaagtttgaattatttaatttcagacttttttttttacattgatctttaatctctgctttatttgctttattattttcccatgctgttcttaggaaaattctctgctgttaaagtgagagaaaattttatttttcttttggtgttattcttttattgaaatcctaatggggtaggtctgtgtagacatttgtttcttaatcctttaaaacttgatgatagttcttgcggggtggatgctgagactgtgatgttttctggctattccttactccagtgcagggcagcattctatacgttcatcatggcacctacagttgtagcaggcttgcattgccctccctttaaaaacattgtttgaaggttgtcttttaacagaaggcatttgcaaattaaataatttgcgttttcttctctttgcaagtgaccccaaaggcgtatgacctatgtgacttgtcatgttgctggttgtgaatctgagctgcctgaattgctggctgacatgctggtgaggcagtgggctgtgagtgaagccgccctgttgcccagcattcaagctcagcgcggctgttttcctgtgtttgtggtggtttacataggaactcttatgaagagttggatagtgggcacttatatttgcatgttaatgaatttgactgggaagaatattttattaaagtgctgatttgcagaggcttgggggcttatgagtctcaaataccaagactatcctgtggggataggtaatagagaccatgggttagctctcaaatggatccttttccttctgaaacaaatgttctttttaaaattttacatacagtgaattcattctttagtttttttttttaaacctttttgcagttctgtaaatttctacaaaagtatacagtcatttacccaccacaattaggttgtggaactaattccttcccccagacttcctgcacgccatccttctgtagtccagttctccactcatcaccagcccaaggcaaccactgattttgtgatttgttcagtattttagctggggtttttttattttttattttttttgctgccttgtatggtgtccagcatatgccccaggtgagcaagtgcttgcttcatgtatctgcttggaggctgttgtctttcgtcatttttcagattggttggctgatgtccagccttagctctctaatgtgttcaagaagacctgtgattttggtaaattatctctccctctgcccccggaaagaatggggtagctgttaccagttttctgtatcctaagctaaagctggaaatcagaaatttatttaaaccttgaaattgttaaatttctactcaactgtagtcactgttctttaatgataggttagtgtagtgcagaggtttggctcagtgaatctacttcccaggatgtcagttctctggacatctgtaaggtggaatagtaacatctgctcttattactttacatattgtgaattttctactgaaccgtagtaaatgatagcacattgatatcaatgtgattgtttccagtaacttggataagagggcaaatgaagagtgtgaaagagacggaaatcttcacagtcctgtgaagattaactgcttaacttcctagtgaaatcttttaaatgctttttctgcttttcagtgatttgaaaatcatgattgtactccttgtctctggtttatgtattcaaataatgttagataataattgcagcatcaaaattactttttgatgattgataatttgggggcaggactggatccagcttagtcttccagggaccttcctagttacacaaagttaccagcagagcacctttgtgtcagtgaccgtggctgctcttggcctgccaatccctcctcctccacacgctcacaccaacacatggaggcagtgtggcgtgcagaaaaggccaggtggggcttgaggcctcatgtccattgctgcttctgccactgactaaccctgtattcttgaatatatgaccttcggtttttgtcttctgagaagagtctgacactagatgacaattatggtatcccagtcctagaattgtgtgactctgcatgtggaagaataaggtgccagttttgagcttaaacttactggtcttctgttgtcagagtctaagtcagcagtgaagggtcaataaacaggcatttgggttgtttccaccttttgactgttatggataatgctgatacgagcatttgtgcagaagtttatgtgtggatgtatgtttcagtttttctgggtatctacctcggggtggaatagcagggtgtagtaactctgtttagctttttgaggaactgccagacaggtttccacagtgactgtaccattttatgtgctggtggctccctttccccatgtcttcagaacagcccatctttttctaggtgtgcaggagtccttgttgctgtttttggttctttgagcacccatttgtttctcatgtaccttgatctctaggagagatcattagcattgtcctgtttcccccattgtggttgaacctcctgaaaggtgaggttagtttggagagagttgatttacaacttgagcactgatcaacattattttttcgtcttttttttgcggaatcacctgttgaatcatctgtcaggacaatagctgaacagaaacttttaatgcaacaggtagcaaacaaatataatttgaggcactataagaaggaagaccactctggaaccttgacccaggtgacttcatcaccagccttgtattgactctgtacttttaagatgagaccctcttaacaaacagcataaagtcaggctttggtatgggagtgtcgtctacaagatctcttctgggcatggacacttgttggactacggagataaccttgaggctctcgaggtttcattaattttctgcattttttagttttaatttcatgtatttatggtctgatctttattatttctttccttctagtatttttgagtttagtttgttcttttctatttccttggtgcatcattagattgtttatttggagtcattctacttttttgatacaggcatttattgctataaacttccctcttagtatcgcttttgccatgtcctagagattttggtatgttgtttttccattttcatttgtttcaagaaaattttaaatttcttcccaattttttcattgacgcatttggttgttcaggtgtatgttgtttaatttccatgtgtttatatagtttctgagggtcctcttgctattaatttctagttttattgtattgtggtcagaaaagatacctgagctgggcatagtggcccatgcctgtaatcctagcactatgagagactcaggtgggaggactgcttgaggtcaggagtttcagacgagcctgggcacatggcaagatcctatctctacgaaaaaaaaaaaaaagctgtttgatatgattctactttttgaatttgttgagacttgttttgtggtataagatgttgtctgtaatggagaatgttccatatgctgatgaaaagaatgtatattctgtaacagttgggtgaaatgttctgtaaagattcaggtctatttggtctagtgtgtagtttacctctgatgtttctttgttgatttttttttggtctggaccatccggccattactgagagtggaatgttgaagtctctactgttattgtactgcagtcaatttctccctttagatttattaatgattgatttatatacttggataatgctgtgttgggtgcatagatatttacaattgttatatcctctagctgagttggtccatttttcattatatagtgacttggtctcttttcacagtctttgacttgtagtctattttgtctgatatagatgtagctactcctgttttttttggtttccagttgcatagatatctttttccacccttcactttcagtctgtatgtgcctttatgggtgaagtgggtttcttgtaggcagcatgtagttaagtcttgtttctttccattcagccactccatatttcttttaattagaaaattgaatctgtttatattcaatgttactatcgataagtaaggacttattactgctaatttgttgcttgtttcctggttgttttgtaactcctcttcttttttcttgctttcttactgtcatcctttatggttaagtgattttctctggtgtgttttagttcattgctttttatttttagtgcatctattacagatttttgctttgtggttaccatgaggcttacaaaaaaatctttagatataacaggttattttaaagagatgacttatctttgatcacaaaaaataatagaaacaaagaaaaaactaaaaatacccctatactttaactccatcccccatattttgactttttgttatctcaatttacgtgtttatattacctgtcttttaataggtcgctgtagctctgattgtttctgtttctaggcttcacactagagttttgcatggattgcacatcatgagtacagtattagagtattctggggttgtctgtgtaccagtgtgttttatatttattttatatattatttaagtatttctttttccagtgggttttataccctcaatttttttctttctgcatgttagtgtgtttttctttcagtttgaggaacttcctttagcatttcttctaagataggtctggttggtgttaaattctctcagtgtttgtttgggaaagactttattagtccttcatatttgaaggatggctttgctggatacgatattcttatatagtgttttctttctttcagaaccttgaaaatatcatcccactccttcctggcctatatggtttcttcttcttcttttttttttttctgagacagaatcttgctctcttgcccaggctggagtgcagtggcacagtctcggctcactgcagccttccactcccaggttcaagtgattctcttgccttagcctcctgagtagctgagaccacaggcatgtgccaccacgcctggctaatttctgttttcttagtggagacagggtttcaccatgttggccagactggtctcaaactcctaacctcaagtgatctgcctgccttggcctccctaagtgctgggattacaggcatgagctactgtgcccagcctggcttgtatagtttctgttgagaagtctgtcaccagatgaattggagttcctttgttacttgtttcttttcttttgctgtttttaagtttctctctttatttctgaatgttgagagtttgattagtatataccttggggtacactcatttaagttgactctggtgttctgtggttttcctgtagctggatatttatatcttaagttttggaagttttctgttatttctttgaataagctttctaccccttattgttgctcatcaccttgttgaacaccataattcttagattgggtcttttgaggtaattttctgtatcttgtaggtgatcttcattcctttggttttttctttttctcctctctgtgtttttgatagcttgtctctgagctcagtgattctctgcttgatccattccgctgttgagagcctcaaattaatttttcagttcagcaaatgtgtttctcagttccaggatttctgtttgatggtgatgatgatggtgatgatggtgatgatgatgatgatgatgatgatgttgattttttagagatgggatcttgctctgttacccaggctggagtctggtggtacaattctagctcactgcaacctcgaactcctgggctcaagcagtgcttccacctcagcctcctgagtaggtaagactacaggcgatcaccacagtgcttggctaattttttatgttttttgtagagatggggtcttgctgtgttgctgaggctgttctcaaactcctggccccaaggcccctatctcagccttccacagtgttgggattacagtcatgagccactgtgcccagcagtttgattgttttaagtttcaatctctttattaaatttctctgacaaatttccgaattacttttctatgttatcttggagatgactgaatttccttaaaactactattttgaattcttggtcagagagctcatatattgccatcttgttagagacagtcactggttccttgctttgtctgtttggggaggccgtggttccctgtttcctgttgtttcttatggatatatgtctatgtctttgcattgaaagagtatttattccagtcttgtctgtctgggttattttgttttttattggatatgtttacttagagattctttgtaatttacttgttgaatttcttcctttttttctgctaggttgctgcctctttataggcactagatggtgccttaagcccaggtttaccttggctctagggaaccatcagagtattgcccatcccgaatgggggaggtcacaaagaggataacccggcagtgtgggaatactggcaaggcgtctgtgcccaggggacctgtgggacataccttctactgtgtgcatctgctgaacagccgctctgatttggtgtcttctctggccaagttacagagcagcgtttccagggctgggaatagtagttctgcttccccactttgcctctggctatcctcagggatagtttcccttcaggtacttacagtggttcccatgggttgaagcagggacaggtcttctgccagggaacctaagatggtgggacagtagttgttcacctccatctgctttttccagtgtagcaactgagttgtggaaattttcctcacgcttggtgctgggcacattatggagacgggtgtcacaggtatgaaagtccagttgtcttactgtctgttcagagttttttcacttgtctgttgccgtgagagctgtctgagcctcatatttagagttctgggatattgctgctgataatcttggagctgctgtatgttcgtttttggttttcttttgggaggcagtgaagccaacttgcttctatgccaccatttggaactagaaactccttgttgcccatattttaattgggttattttcctttctgttactgagttgtaagaggtatttgtaatatactagtaccttatcagagatatgattttgaaatacagccatacctcagagataccgtaggtttggttccagattactgcagtaaagcaaatagcacaataaagtgagtcacatgaattttttggtttcccagcatatataaaagttgtgtttacagtgtactttagtctgttaagtatgaaattagctgggtgtggcggtgcaggcctgtagtcccagctactcaggaggttgagggtgcagtgagctgcgattgtgccactgcactccagcccaggtgacagcgtaagattcaaaaaaataaataaagaattttatagctttaattttttcttttttttttttctttttttgagacggagtcttgctctgtcgctcaggctggagtgcagcagtgcgatctccactcactgcaagctctgcctcccgggttcacgccattcttttgcctcagcatcctgagtagctgggactaaggcacctgccaccgcgcctggctaattttttttttttttttgtatttttagtagagacggggtttcaccatactagccaggatggtcttgatctcctgacctcgtgatctgcccgcctcagcctcccaaagtactgggattacaggcgtgagccactgcgcccggccagctttaattcttatattcagatctttgatccattttgagttaatatttgtatatggtgtgtggtaggtattcaacttccttcctttgcatgtggatatccagttgttttagcaccatttgttcaaaagattattcttttatcatttctccattgatttgtcttggcacctttgttggaattcagttgaccataaatgtgaggatttatttctgtactctcaattctaccattgatttatatgtctatcattctgccaataccctattattactttttttgctcaaaataagatgaaactattacagtctaaagcaaaagtatcagacatagtacgtctcaactctgtatatccttttcagcacaaataattgacaccagattctttttttttttaaatggggtctcactttaattgcccaggctggagtacagtggcctgatcataattcgctgtagcctcaaactcccgggttcaagcaatcctcccacctcagcctgggtagctgggactataggcatgagccaccacacctagctaatttttatttttatttttgtagagatggggtctcattatgttgcctaagactcatctcaaacttctagactcaagtgatcctcctaccttggcctccaaaagtattgggattataggtgtgagccactatgcttggcccagatttatttccttttttgtttgagactgagttttgctctgttgcccaggctggagtgcagtggcaccatctcagctcactgcagcctctgcctcccgggttcaagtgattcttctgcctcagcctcttgagtagatgggattacaggtgcatgccaccacacctggctaatttttgtatttttagtagagatggggtttctccatgttggccaggctggtctcaaactcttgacctcaggtgatccacccgccttggcctctgaaagtactgggattacaggtgggagccaccgtacctggccccatttcttgaattatgtaattactatactaatctctagaattacctataagcacttttaatgaaaaatgaacctagaaaaatcattttaacagaaaaattaactggcagttttttagttttggtagatggtaacaaagtcaattctgtaggccttgaattgactcacaggcattctagatagattaaatatcagtaagcaaagtacaaattaccatgtaaaacaaagaaattccaacagattgacaaatactgaagctgtgtaggaatttattcacatttattttactttgtagttcatgttttagtgatatttaatgaaatgcagcattggcatttgcagttaaaatactagatatatgatacagacttcatttaccagtacatttgttgtgttgggcattgttgcttgctatgagatacatatatatatattttttttcttcagcgatgtattagtaatgtttctattttctattgctgtgtaacaaacctcctcaaaatataaagtcttaacatttatcttgctcgtgggtctacagtttggtcaggcttggcagggacagtttgctgcttctgctctccaacatctggggccttagctgggatgactcaaatcgttgagggatggaacagctgggggctagtggggtgtctttctctctcttctttcctcatagagtctcaaggcttcttcactgtgctatttcttatcctttttttccttttttcttttttttttgagatggagtcttgctctatcacccaggctggagtgcaatggtgtgatctcagctcactgcaaactctgcctcccaggttcacaccattctcctgcctcagcatctggagtagctgggactacaggcacctgccaccgcgcccggctaattttttgtatttttagtagagacggtttcatcatgttagccaggatgatcttgatctccagaccgcgtgatccgcccacctcggcctcccaaagtgctgggattacaggcgtgagccaccgtgttttttcttttttttaaagacagagtttcgctctgtctcctaggctggagtgcagtagtgcaatctcggcttactgcagcatccacctcctgggttcaaatgattctcctgccttagcctcccaagtaactaggattacgggtgtaagccacgacgcctggctaatttcgtatttttagtagagacagggttttgccatgttggccaggctcatctcaaactcctgacctcaggtgattcacccaccttggccttccaaagtgctgggattactggcgtgagccaccacatctggccttcactgtgctatttctgtgtggtctcttcatcatggcagccttagggtagctggactctttcatagtgactcagggatcctagagcaagtggcaggagaccaaagtggaaatcttaaggcttcttcctgtccatccttggaaggctcatggtgtgcattctgctgcgttctacttgttacaagtgagtcgcagtgtaggtgactactcaagggtctgaacatgaggccaggcccacctggtagccatctctggagtcaggctaccaaatagttctatgttgcttgctatgatatatatatatatatattttttttttttcttcagcgatgtattagtaatgtttctattttctattgctgtgtaacaaacctcctcaaaatataaagtcttaacatttatcttgatcatgggtctacagtttggtcaggtttggcagggacagtttgctgttgctgctctccaacatctgggtttctgctgggtttcagtatattatctgaagttatttacatgaataatgctttcccctgaaaagctacctaaaagctatcttttatgtgtttctgatgccaaatgcttacttgctttgtttttctcctaaaatatttccttagtaaaactagaatgtgtcatattctggaaaatgtacctatcaggttaaaattcattgaccaaagaaggtaagtttatgtcattgaaaggttctgtcaataaagttatggctgtcatcaaagcgtgtacttgaagacactgcaccaatgatatagttaaaatgctgcaaagacaagtagaaagggggaaacatctgttaggtttagtagactttactatccctcttgtggtccatctgagaccaggtgaacaaaagtaaatagtaatgtcaaagatctgagttcatgaagctggccgggtaacatgaaattttatattctgccatcagattacatccagtcaaaggcagaagaaataagtgataaaattcagcttccatttttgataattcttagcaagccaaaaatagaagaagacttctttaaactgataaagggtatctaccagaaacagatcagacatcacacttaactgtgaatttttagaagcgtttccattaaaatcaggagcaaggcagtgctgctgccccatctcttttccaccttggtctcgtcatttggcttagaaatcttagtcagtttgaatcatgctttactgtcagacccaactaaagaaaactcttaacaaacacatacataaatgcacttggatcattggatacttcgaggtatttggaaatgttgatggagccagtaatggctgcagcactgcccattgggagcagtgtaattactcggtctggtcttcaggccgattcgcagggcctcaggcatgaagaaatgggatacttgctgttccacaatgggacataaaattgagaaaataagttttcttcaaaatccattttcatactcttttttgactacatataatttcagtttgtatcatggctaaaagttattagcaaatatagattgaatattccttatctgaaatgcccgggaccagaagtgttttggattttggaatacttgcattatacctactggttcaacactctaattcaaaaatctgaaatctgcaatgctctgtgagcatgacctttgtgcatctttgtcagtgctcaaaaatttttagattttggagcattttggattttgggttttcagattacggatgccattaaaagtgaattttcacatcctcagtcccagataagataatcagcccccaccttatgtttggaccctgactgcccacagctgtttaatgcagcactctggagcatagtgaccgcagacttggttagattccagggctctgtttcactctttcggcgcttgctaatcacactgcacattacttgatatttcagtaactcttgtggttgtcagtgattctttctgagctgtcatttttgttgataattttttttttttttttttgagacagggctttgctctgtcacccaggctggagtgcagtgtcatgatcatggctcactgcagcctctacctcctaggctcaagcaatccttctgcctctacctcctgaatagctaggactacaggtgcacacaccgtgcccggctaatttttaaattttttgtagagatagggtcttgctgtgttgcccaggctggtcttgaacttgtggcctcaagcagtcctcccacctcagtctctcaaaatgttgggattacaggtgtgaacaaccatgcctagcaatttcatttataaatgcctcattttcagctgtgttttcattaggtcttttaggagaaaatactctgttctgcacaaaattgtctaggttctgagtcataatgatcttgatgttttgtttcattttctgttgcagatgttgctgctatagcatgtggtcgtgaattcttggttaattcaagccgggtgctcttggacaccatattgcagcttctgggagacttgaagccaggacagtgtaccaaactcaaagtgtatggtggataatgttaaaaagttaattctatttacatattaattagactgtgctgattgggcctctcttcaagtaaacacagttaattttggtggtagttttaaaaactagaagaaataaattcctggagaagttaagggcgtgcactgtctcttaaatagcattttagaaaataaatttaaggaaggaatgttctcaccttagagcaatcagtgagtcccagtattatcacatggtacttcatgggtatgtcaaaatgaatttaaataggtatctgtcttccagctactaaaatctgtatttgttttctatttttatgtaacaaattatcaccaacttggtggctaaaacaacaccatttattatttcatagtttggcaagtcagaagtctgagtgggtttgagaggttctctgcataggtcaaaagtgaggtgttttccagggtgggatcttttcagagaatctaggggaggaatctgcttctgggcactttgaagtggctggtagagtccagtgtcttggtttctaggagcgagttccctgtttcccagctggctggtcagctgtgggtcagctgctgaggcagcttgcattgcttctcacagggaccccatcttcaagccacagtcgctcattgaatccttcccacgtttccagtctctgagacttcctcttctgctaccagcaagatgaaactctctctgcttttattcttttgttaaaaagtttacttcaagaaggcaaaaactctgcttcttatagatttgtgtgtttagatgaggcatacctggataaactccttttgattaactcttgagtcagctggttagtaaccttaattacatctacagaatcctcttttccaggcaatgacataatcagcgtgtgataatttatagtcccagagattagggcaggaaatcttggggagaggggcagtgtaggattctgccactcacactgttcgttctgagtgttgcctttgacttcttagagcatctttattttttaattatttttttaaagagaccgagtctctacagaccttgcctaggctggcctcaaactcctaggcgttcaaataatccttccacctcagcctcctgagtagctgggactacaggcatgtgccaccatcccctgctgtggagcacttttttttttttttttttttttgagacggagtcttgctctgtcacccgggctggagtgcagtggcgtgatctcggctcactgcaagctccgcctcccgggttcacaccattctcctgcctcagccttccaagtagctgggactacaggcgcccgccaccacgcccagctaattttttgtatttttagtagagacggggtttcaccgtgttagccaggatggtctcaatctcctgacctcgtgatccacccgccttggcctcccaaagtgctgggattacaggcgtgagcccctgcgcccggcctagcacttttaaaaagtaagagcttctgtaaagtctgtgccaggtgcttccaacacctgtgtcatcctggcctcggtgtctcttgattgttttttcccatgagagttgagattttcctgtttcttcatatgccaagtaattttggatttatcctggacatttacgtgatcactggtcttgtttaaatccttgggaaatgctggtgtttatattttcacaggcagtcaacccctttgggtcagattccagccagccttttctctgtttggtttcagtgtgtcgtcctgttttcagagtctttacagtgctattggaactgcccctcgtgagtgccgcccagtggccagtctgagacctgggtggtctggatcttaggttcagagtctttcagatactgtttatgatcagatccacacaggcacaacttgggatgaggccaggaatttataaacaactttttggggtcacttttctgagctgttaactctctgggtacactttagttacctgggactgcctttttcagtcccccacctggaatgctggggcttcatataccctgctgtgtccaagtgcctgcaactctgccctcatcccgccctgcggcaggagttgagaagctcttagagctttcaggtgtaaggaaaaaattcctttcccccagagtttgagttacctgggggatgtccccactgctaccgtgcttggttgctggcaggagacccctttcccactccttgagcctcactagagaccttctcctggtgctctctgtgtggctcagggctacttttgggttttggagctccctcgagtccaggccagggacactaaaggaaaaagtggtaaactctctgctggtttagtggttcttaaaattttgatcttcttcccctatctgcctgctactgtttacttttcagagtcctcaaatagctgcttcatgtattctctttggaatttatagctgcattcagtggaagcgagactggagggtgtgttcaggccatcttatccagaaccaagctttctagtccattttaatattttgtgctaacaaatatctatacatacataatacatataatacagtgtaacatatatgcaaaaaaaattttttttttgagacagagtcttgctttgtaacccaggctggagcacagtggtatgaacatggctcactgcagcctcgacctcttaggcttaagttatcctcccagctcagccttctgagcagctgggaccgtcagtgcatgccaccatgcctggctaattgttaaattttaaaaatttttttgtagagacggggtctctccatgttgcccaggctggcatagatggttttgtttgggggtataattttacaaattgcttgtggatctagttcattccttttaagtaccttgcatcaaaggagatgtaatatttggattatccttccctgactgatgggcatttaagttactttcgggttttacttgacaaatataatgccgtagtgagcatccttgataaactctttgctaacctgtctgagagttctccaggagttttcccagaggaaatatttgagaagtagtacatggacattttcaatttgataagatactgccaaattggtcaccatagtgtacatttctacctgcaccatgtcagtgttcgtgtttcccacgtccttgtcagcactttgctatttattatattcctctaaagagaaaaaatatatgtgtatatggagagagaggtgccgggggaagagggggagagacagggtcttgctgtgttacccaggctggagtgcagtggtgcaatcacggctcactgcagccgcgacctctggggctcaagtgatcctcccatcccagcctcccaagtaactggggtcccagctactctgcacgccaccatgcgcagctaattttttttttttttttggtattttttgtagagacagggtctcaccttgttgcccaggcttgtctcaaactcctaagctcaagtgatccacctgcctcagcctcccagaatgttgggattacagcgtgagccactggacctggccttaaagagtatttttatcatccacctatcatctgtctgtctttgtccttctctcccttccttcagatttagattgccagtgaggttgaggctcttcacatgtttgtaccattccagtttttcctttgagtcacctgtctgtgtcttgtgcccactttcctgttgggctgcatttttcttagtgatctgctgtaggtctttgtgtgttctggatactaatccattgcctcttttgcttctgtggtctgtacaaggtccatatttatgggccagctaaagtcccccttcaacttccaaggcaaagctgtgtgtgagggctgggtcacttctagcctctccggttccagtccctggagctctgtgcctttgggtcctggtgagctcttgttgattgcagtgggagatggggagaattgccttcagagccattcactgactttcttggcagtcttccatttggccactgagcaaagccgcgtgtttaccctctatcctgactcgggatctcagcatgcaccagcctgagaggggccttccccctgggatctttggctgccttccaacatgctcatggcttgttccgtctcaccacatctccaaggcactcttctcccctcttttcacctcccccacttcactaacgcccacccttgagtcctctggagccccaagacctttctcatactataaatcagcctcttttcttcctggcctccccctgccttgtgtatagcttgcctctctctggggaactacactttcactgccactttcatgatcgaaggtcactcattttcagcagttagtaccttagacccagagataggggttatttttttcctagttgcccattttttaaaaaaatttaaatttaaattttagattcagggggtacatgtgcaggtttgttacaagagtatattgcgtgatgccaaggtttgggcttctgttgaatctgtcactcagatagtagatatagtacccaataggagatttttcagtccttgttcctctccctccctctctccttttggagtctccagtgtctcttgttcccatctttatgtccgcgtataccaagggtttagctcccacttataaatgagaacatgcaatatttggttttctacttctggattaattcacttaagataagtggaggcagcctccagctgcatccatgttgctgcaaaggacatggtggtggtctttctttctggctgcgaagtattccatggcttgtatgtaccacattttctttatccaatccactgttgatggacacctgggttgattctatgtctttgctatttttgttttgtttagttttgtttttgagacagggtctggctgttccattcacactggcatgcagtggtgctatcttatctcactgcagtctgaaaatcctgggctcaagcaatccttctgcctcggcctcccaagtacttgggattacaggcatgtgacatcatgcctggctaattaaaaaaaatttttttttttttggtagcgataggggtctcactttcttgcccaggatagtcttgaactcctgaactcaagtgatcctttcacctcagcctcccaaagtgctgggatttcaggcatgagccaccacttatctttgctattgtgagcagtgctgtgataaacttataagggcaggtgtctttttggtagaacaattttattttcctttggctatttaccaagtaatgggattgctgggttgaatgctaggtctgtttttagttctttgagaaatctccagactgctttccataggtgctgaattaatttacattcccaccaacagtgtatacgagttcccttttttcagtggttttgccaacatgatgttttttgactttctagtaatagccattttgactggtgtgagatagtacctcattgtggttttgatttgcgtttccctgatgactagtgatgttgggcattttttcatgtttcgttggctgcttatatgttttcttttaagaagtgtctgttcttgccctttgcctgctttttaatgaggttgtgtgttttttcttgttgatttgtttaacttaacttccctatagattctggatattagacttttgttggatccatagtttgcgaatattttctcccattctgtaggttgtctgtttactctgttgatagttttttttgctgtggagaagctctttattttaattatgtcccaattgtcaattttcggttttgttgcaattgcttttgaggactcagtcaaattctttgcctaggccgatatccagaagactatttcctagattttgttctaggacttttatagtttgaggtcttacatttaagtccttaatccatcttgagttaatttttatctgtggttagaggtagtggtccagtttcattcgtttacatatggttagctatttttcccagcaccatttattgaacagggagtcctttcctcattgcttatttttgtcaatgttgtcaaaggtcaattggctgtatgtgtgcagctttaatttctgggttctgtattctgttccattggtctatgtgtttatttttgtaccagtgttatgctgttttagttagtgtagcctggtagtatagtttgaaggtgggcagtgtgatggctctagctttgttcttttttcttagcgttgctttggctatttgggctcttttttggttctataagaattttagaagagtttgttctaattctatgaaaaatgatgttggtaatttaatagcaatagcattgaatctgtagattgctttgggcagtttggacattttcatgatattgattcttccagtccatgaacatgaatgtttttccagttgtgtcatctatgatacttctttcagcagtgttctgtagttcttcttgaagagatctttcactcccttggttagatgtattcctaggtttttgtgtgtgtgtgtggctgttgtaaataggattgtgttgttgatttggctctcagcttgaacctttttttttttttttgagacagggtctcacccttttacccaggctggagtgcagtggcataatcacggctcactgcagcctcgacctgctgatctcaagcgattctcctgcctgagcatcctgagtagctgggactacaggtgtgtgccaccacacctgactaatttctgtagttttttgtagagacagggtttcgccatgttgcacaagctggtcttgaactcctgagctcaagtgatccgccttccttggctcttcccaaagtgctgggactacaggcttgagccaccacacctggcctccagttctgtgttgaataggtgcggtaagagtggatatctctatgtcttattccagttcttaggggaagtgtttcttctagctgcccatttttatttttaatgaaatgtcccagaatgctcatttttaaaaggctgtttctcttccaatctcatgcgaatttttttcctccttgaaaattcaagcaaccagttgctctcttcacatccagcctttctcatcactgtacttttctgaccatccaggcatttcccttgttcactgagtactggcttgttggtgtccccctccccatttcctgctatcttgaatgacttgaacatgtttaggggtgattcattcaacaatctaatttcaaggccacctgcctttctcagctcccaagatttgctgtgcccttcactgtggcagtagtctgccttgggccagaccctgcacattgtcatcaggtggactgtctggtaaacattgctgtagcactcaggccatacctcctctcctccctgcctccttttcctaccattgttccctctaaactgcaagacctcctgctcctcctccctcctctttcctcctgctcacaccattgcctccatggcctcccctccctccagctcacccagccccagtgtgcatcacatttcctgatgctttcaaccttggatcagcccagccatccttcttctctgttcctacagctggggctgttgagtgaggtttgggaagaagctttcttgtgtgcacggactctcgtcatttctcccggtttccagcaccctggaatcctcttctatgtcctttctcagctcccactcatttccacactggtggaggcagacctcgggtgtgatcctcacggcctccctgctctgctcttccttggtaggtgggtgtcccggcaggcggctttacttcctgctctgctcttccttggtaggtgggtgtcccggcaggcggctttacttcctgctgcacagagtcaagggtgtgagtgtggccgcctcagcttggccctcccttgtttattccactcccctttgctttttcttctcacgtgtcagaggcacgtatggcctggatgtgtgtgtgtggtgtgggtgtgtatatgtggcggggcgtggggaaatgaggatgtatttgggtgtggtgtatgtgtatgtgggtattttttggggtgtatggtgtgtatgcgtttgtgtggggcatgtttatggtgtgagtgtgagggaatgtgtgtggtgtgtgtgtatatatgttggggggaggtgggtgtcatgtgatgtgtgtgactgtggtgtgtttgtatatgtgggactatgagggattgggatgtgtgtattttgtgtgtgggtggagatgtgggtgtggtatgcatggtgtgtgtggctatgtgagggggatgtgtgtgtgtggtatgtgtatgttgggggatgtttgtggtgtgtatgtacatgtggagggtatggggtatgtgtgtttgtgggaggtgcgtggggggatatgtgtgggtgtgtgtgtgggtgtggcgtgtgggggtgtgtgggctgcatatgtgggggtgtgtgtatgtgtgtgtgttggagtgtgtgtgtggtgtggggaatgtgtggtgtgtgtgtggtgtgtgtgtcggggggtgggtgatgtgtgtttgtgggctctttcagccaaggctggggcagttagtgcagtcagctggtgtgttgtgtgtggggtgtgatgtgtgtgtgatctgtggtgtgtgatgtgggtgcgtggtgtgtggtgtgtgtctggtatgtgtgtggtgtgggtgtgtgggctctgtcagccaaggctggggcaattagtgcagtcagctggtgtgtgtgtggtgtgtctgatgtgtgtgtggtatctgtgtggtgtgtgtgtgatgtgtgtgatgtatgtgtgttgtgttatgtggtacgtgtgatgtgtgtggtgtctggtgtgtgtgtggtgggtatgtggtgtgtgtgatgtgtgtgtggtgtctgatgtgtgtggtgtgatgtgtgatgtgtgtgtggtgtgtagtgtgtgtgtggtgtatggtgtgtgatgtctgtggtatgtgatgtgtctttgtggtgtgtgtgtgatgtgtgtggtgtgtagtgtatggtgtgtatgtggtgtgtgggtgtggtgtgtgtgatgtgtggtgtgtgtggtgtgcgatgtgggtggtgtgtgtggcgtgtagtgtggcatgtgtgtggtgtggcatgcgagtggtgtgcgtatggtgtgtgagtggtgtgtgtgtggtgtatgtggtgtctgagatgcgtgtgagtgcagtgtgtagtgtgtgtgtggtgtgtggtggtgtgtgtgtgtggtgtgtgtgtggtgtgtgtgctgtatgattgtgtggtgtatgatgtggtatgtgtgatgtgtgtatggtggtgtgtgtatattggtgtgtgtgcaatgtgtgtggggtgtgtatggtgtgtgtggtgtgtgtgtggggtgtgtatagtgtgtgtagtgtgtggtgtgtgtgtgtatggtgtgcgtgctgtgtgttgtgtgtgtggtgtgtgcgtggtgtgtgtgtggtgtggtgtgtggggtgtgtatggtgtgtgtgtagtgtgtgtggtgtgtgtgtggtgtgcgtgctgtgtggtgtgtgtgtggtgtgtgcgtgatgtgtgtgtgtgtggtgtgtttgtggtttgtgcatggtgtgtgtggtgtgtgtgatgtgtgtgagtggtgtgtggtatgtgtgatgtgtgtgagtggtgagtggtgtgtggtgtgtgctgtgtgctgtggtgtgtgtgtgtaatcctcctgcctctgtgttgagccttcctctgggatgtgccctgttgcctgtcatttcttgctccagtatttccagcgctcctgctccactggctcctgtttagccttttgtcttcccaggccacggctgccctttcaaaccactagccagcctgcgtttaccatgacatgttgcattttcccagaatgcagagctggctcatggtgtgttctttttgcctcccccagaaatccctgtgggccctgcaggtcagtggtggatcagactggattctgctattgggccacatgtccatgtcttttgtggcaaacattcatagggttgtacatgggacattgttgtgactcagcctctgtgagttttttcagtggcatagcctccccagccatatggtttcgggctgttcctagtttatctgcctttttttgtgaagaccctgtttttaactctccaaatctaggaacttccagcatatggtggccagacacaccagctgaccttggaggcccctcaaggtggttggtgctgccagcaggatgactggattctgtttactgtagtggtcatagcttttcagtcttagccatacctcatgggtaattttccccattcccatcagcctctcaggtgtctgctggagatggccacttgacagaactgtgtgcagggtgagctctgtcagccaaggctgcggcagttcagtgcagtcagctggtggcatgcccctggcagggttctgtctgtttcatctctgtgtatttctccttagtcattcagccatggaatgacatgtgtcaggagtgtcccccttcgtcaccacctcagtccatttccttcccctccggccactggtcacccaggcttgtgctcccagggcctggtgtgggcaggatctgtgctgtgcctggaccttgggattgcggggggccctgagcgctgtcctggcactgagctgcatgtggagggcccagagtctcctttctacggctcctctttctccgctgctgtgacatgaccctggcgtttccatcctccttgatacttggtaacacttaggcaactgcaattattattttttttattagacttgtggatttctccagcgtttaaagtttcccttcctttttttgtacttccttatggaggccgggttattttttttcctcactgcccacgctgcctatgattttaccagtccttgagtaggccatgaaaggccttttcacatctacactagcggcttctcaggtcagacctgctggaggtgttattgaaggggatggcagaaggcccagagtttaaggtggttcttcatcccgagtgaggagagaggcctctggggtgggagctacccacattcctgaatggtcacttggttctcaggataaccctctccttggatttccagttggggtgtagtgtctgtgatgagaacacctctgcttttactaagctgaggtaactgacacagtgcatttcactgtcaatgggccagagaatatttggcatgtgtgggagaacagtggctcagcaaggttttctcatccaggcacagggtagagggttacagaaatgcctcttggagtttgggctctatgtggttcctgtttctcgaagttactgttggtttatcctgcccagcatcttccccaggtgttaccagttgaatgtcatcagtgagagtatggcttgtgaaagtttctgggttctttgtgcagatgacttcagaagcagctctgagctctgcaggaaaaccagctcacctttgtgggcaaatgagggtgatggtatcgtcccatttctctgtggagtagctgtgtggctgcatctgcaggttggagccacccacaagctcccgttttccaaagaattcgtctggaatagtcacagtgcagattgcatttttcgaagatgcttctagaagtgtttccacaaaatgtcttaagacaatagcagccttttagaactaagtgtggagaggaagctgtgaagcttgtaccacactttgttcactagttgctttgtttgtctctctcccgtttcctgtaaacttctggagagtgtggagtccaggacagagaagatgctcagtaaatgttgcatgatgagtgagagcaaatcctcactttctgggtgtggttctcccttgtttgttattaaaagttctacagagtgttactgtgcattttggtggcccgatccctttttcacataagtattggctgaaaagaaatcttcagacatgatggggtttctaaccagtttccagtcaaagctttagtaactctagataggaaagttatcattagggatcttgtaagataattttaagacattgcattacaattaattgtcctaatgaaggaagtatgttttcaagacaaactgtatctagataatgttcaaattcctaagtttagagtcctcatcatttccagatattaacaaaagtcaatatctggaagtcatttggggcctgtgaactaatgtgtattatttccaggtggtacagctttcagctacaatgtgcttaccagccactgaattggtctctgttgagttataaattggtagatggtgctgtgaacatcggctcttctgaaaggcatttttgggttttaccctgtctagtttggtcattctgtgtacattttaagaaaaaacaggtatagctaagtaatttgcttatttggccttttcaataaggaaaaggcaaataaccaaatacacaaataggcaaaagaaaaaaatcaggcaatttatagaataaaacacgcagcagcttcataaacatgggaaagattcttgctctccatagtaatcaggggaaagcaaattataaccctaataagatgccttttcggtgcctctcattgaaaaaaaaatcacagtctgatgattacaagcttccgattggacgtgaagccacagtgaagcttacacctgtccatgtgctgctggagggtacgtggagccagctggcctgtgtctgtggaggctgtgtctgcacatgccgaggacagagtccccgtctgcatgtgtactccagagaacgttttccataggataccaggatgcttgtacagaaaatgttatagcagtggtgtttgtaatagcacaaactaggaaattacctaaatgtctacaagatggagaacagataaataaattgtgattagttaaaaagttggcatatatcagtggaaataggttggagctatagaaatcaacataaacaaatctcaccatggcgtggaagattgcctgcagtatgctgctgttgatgcagacgtgcaaagaaaaaagattccatacctaaagtattagcaatgcgtggctagtttaaatatcagacatagctgtggttacacctccctgaagcacgcctttgggtagcgttcaccaagggaattcaactctggttatagggtttctttcttaaccagggaggtgggtattgtattattctttatatctttttgtatgtcttcattgtaacataatagatacaaattgacatacagatatttgaggatgacatgatatagaccacaggtttttaggttctaacttgactgaggaaagaggcacagaatctaaagtctgttaagtcattacttactgtactctgtctaatgaaaaattggtaggcctcttaagtttctgtcaagaataatttggtctaaaaatgtaatattgctgtgccaattgctttctcaaattacatgcagtcttttgtaagaattttattacttattgtacagtagaattactttatggtgctaatttgactaccttagattttggtcagtttagcatcactgattggcttgtttctgagcagtgaacttcacagatactcctttttcttgcttatttttattgctagtttgttttgaagtactgggcgtgtttattctgttactcgtaggttgcaagttatattttcttttaagatgaagaataaggtggtcaagttgtcacttttacctttagtgactcagttgtgttggcctgtggaggagtgctttcttgcttttcacaccttgtgcttgttcagccctgagaccttgtatatttaggtaaagagaacttgctttttatcgaagatgagttactcgtgttgcttatgtagcatttcgagttcaccagtacctttattttagccatattttcagtccttttaaatgtcagatgtgtcttagatgatcaagactgcagagactgggaagttgctcttttggagcctgttagtcccatgtataacaggttttctgctgaggtttgtggcaggaagcagaatttgcctactttttttttttttttttgtcattggaagaaaaagtctaacacttagtacactagtttgagaaataacattttctttcttccttttttttttgagaccgagtctcactttattgcccaggctgtagtacagtggtgccatcttggctcgctgcaacctctgcctcccgggttcaaatgattctcctgcctcagcctcccgagtagctgggactacaggtgtgcgccaccacgcccagctaagttttgtatttttagtagagatgaggtttcaccatgttggccaggctggtctcgaactcctgacctcaagtgacctgcccgcctcagcctcccaaagtgctgggattacaggcatgagccactgcatctggccaagaaataacatttaatatttcaatactagaagagtaaaatgaatgggcagtctctttagacttgataattggaaacttgatacactatttacaaatatttttggttggaatagaaatgttatattagacgaaacatttgcataagaaacagttttttgggtttattttttgctaactcttgtgtgacctagaagtctttggtcttctgtgagatgtatcttggcagtgacgtgaggtctcaggtggcaacatggttgttgtaagtatgtgtttcattttagcttcttaaggataactgattttgaccaaatatgaaaatttaaagacatctgccaacttgggagttgtttttgccaccttaaatctaaatggcagtcagcaaagaatttcaactggccatcttttcagaaggtttccctgtattacagttattaccagatgctagctttgctttttaagacatacagaagattggtttatcttagtttcatgctgtaaggcagaggtcagcaaactttttccgtaaagtgtcagacagaaaatattttaggctcttggggtcgtacgatctctgttgcggtgactcagttctgctgttactgcctgtgtgaaagcagccttgggcaatatatttaattctaaggaattccaactctctgtgtttgtgatctgaagcaggaacttttcttggaatactggattcgacacctcactgaattctagttaaggtgctaaattttcctcatgaacactacatttgagtagcccttaatacctcattaaataggttactagtgagtagcttttgaattcatgtaaaaattgtcagtgaaacttgaaagaacttgcagtgtggcttattttgtagcccgctgggaggctgaggaccttgttttgagaactgagcaccctgttctggagggtgcttgcatagctctgtcttttctggctccagagcattgccagggactttgaaagtacccatggtcggccagggatggtggctcatgcctgtaatgccagcactttgggaagccaaggcaggtgggtcacctgaggtcaggagtttgagaccagcttggccaacatggtgaaaccccgtctctactaaaaaaaaaaaacaaaaaaacccacaaaaattagccgggtgtggtggtgcacgcctgtagtcccagctactcaggaggctgaggcaggagaattgctggaacctgggaggtggaggttgcagggagccgagattgcaccactgcactccagcctgtctgtctctctcagcgacagagcgagactctgtctcaaaacaaaaaaacaaaaaaacaaaaaaaaagaaagtgcctatggtcacatgggtgagaaggaagaccttagcttttatatattttgatctttaatcactgggagttgattcacttttcagtagataaattgagtgcttattgtgtccagtcttactatactagtttgtgagatgataaagataaggcacggagcttgcttttgacaaagtttagtggggaaaccagagattttaatagagaactacaatagaaattttctatggcatgcatgtgttacatgtaccatagtatatttagttagtccctttataatggacttggtcagtattactgatttttccttttgccttaggctccagtatgtgaccagttccatctttatttaaaattttgggctgggcacaatggcttatgcctgtaatcccagcactttgggaggccgacgtgggaaaattgcctgaggccgagaattcaagaccagccttggcaagatggcaagacctcatacaaaaaattaaaaaataagctgggtgtggtggcacatgcctgtagtctcagctactcaggaggctgaggcaggagaattgcttgagcccaggaattctaggtggcagtgaataatgactgtgccactgcattccagcctgagtgacaaagtgagaccctagctctaggaaaaaaaagtaaaaaattaaagttttgcttattagggcatttttaatatatttttttaaaatattgcattacatttttaaaaatatgggccactgggcattttgatactcccttaaatttacacccaaagcaagtggcttactctcctcatcctagccggctgtgctagttcagtgtttatttgatagcatgtgtactggaggtggcagaaggtaggttgtgggggctctggactctgttatcttttcctgaagggaattatgtgtgtcctagctggctgtcagctttgcctgactcatacctgagctctggctctctggatgtggtctgcagcagagctgtgcctcattcctctgccttgcagctctccctctttctctgcctcacacttgtgccatttagaggccaggaccttggagggttttcatgcacattttagtgctcccttgttctgaaaccctcctttctaggtatcttcttccctttctttccaccctggtgaccctggactctgtggttttacttctcaagctggtcatccccaggtttctgattgagggtcgctgcctggtgctatgtggccttgtctaaacctcaatatatttgcctctttataaaaaaaaattctctttttttttttttttttttgagacagggtcctgctctgtcacgcaggccagagtgcagtggctggcaccgtcacaaccctgcagccttgacatccctgggctcaagtaagtctcttgcctcagccttccgagtagctgagactctaggcatgtgtcaccatgcctatctaatggttttttttctgttgttgtttgttttttaatgaagagatgggatcttgttgtgttgcccaagctggttttgaactccgggctcaagcagtcttcccatgttggcctcccaaagtgctgggattataggcatgagccacccctcttctttcaagggggcacttctcttcagtttctgcctgcctttggctgctttccattccccttaaatggttcctatattttgttcagaatttgtgattcttattggtggagggttagtccaatgcaagttactctgccattgctgcagctatttttttctggaataagtattaaaggctgtgtgtgtgtgtgtgtgtgtgtgtatttcactagcatcacaagttttatttttgtatattcattcttgttcagtttcccaattttcctcataatttctttgacttattcttatagagatgtactttcagttttctaaatgttggagttttaaaacctacttaaaaaatgatttttaacttaattatgtggtggatcagagaatcagcttaatgtattaagtgctataagaggtgccttaaaatctaccattattgtggactggtcagcattttcttgtagttttatcaatttgtgcctttatgtatttttgaggctatattattaggtacatacaagtttaaaatgctaccctcctgatgaactgaacttttcagtatgaaatatttagccttgccgggcgtggtggctcatgcctgtaatctcagcacgttgggaggctgaggtgggcggatcatgaggtcaggagttcgagagcctaaccaacatggtgaaaccccatctctactaaaaatacaacaattagctgggtgtggtggcatatgcctgtaatcccagctactcaggaggctgaggcaggagagtcacttgaacccaggaggcggaggttgcagtgagccgagatggcgccactgcactctaactctgtttcacaaaaaaaaaaaaaaaaaaaaaaaaaaaaaaaaaattagcctcttaatttttaaagatgctttcccttcttttaacattattattatttttagttattatttttgagatagggtcttgctctgtcacacaggctggagtgtagtagcactgtcacagctcattgcagcctcgacctcctgggctcaagtgatcctcccacctcagctgctccagtagctgggaccacaggggcgtgccatcatgcccagctgtttttgtattttttgcagagacggggtcttgccatgttgcccaggctgacctccaactcctgggctcaagctgcccgcccacctcagcctctgaaagtgttgtgatgataagcctgagccactgcactcagtctgttttcttttctgttaatgtagctacctcagccttctctttcttcttttttcattagtatttgtttgatatatcttttcccattcttttactttcaactttctgcaaacttttttttttagagtctcactctgttgcccaggctggaatgcagtggtgcgatcttgcttcactataacctctgcctcctgcattcaagagattctcctgcctcagcctctctagtagttgggactacaggtacacatcaccacatgtggctattttttaatattttcagcagagacagggttttgccatgttggccagggtggtcttggactcctggcctcaagcagtttgcccaccctggcctcccaaagtgctgggattacaggtgtgagccaccactcctggcccctttctggaaacttttgtttcaggtgtgtttctttgaaacagtccatggttgcattttgtttttcctttaatctaaccatctataatctatgccttttaataggagtatcctgttcattaacatttgtgattaatgaaataattggatttatttattctgtcatattttgtttttctttttattatgatttttccaagttatctttccctccctacctctctttctccctcgcttcctccctccctgtctccctccttcccttcctcccaccgtctttcttccttctctctctcccttcttctcttttcgttccttttctattctttctttcaacagggtcttactctgttatctttctttcaaagtcactaagatcttttctgagttcattttattcttctagtgtcttgaaagtttacccttgtttctttcagtgatagccccttttttaaagcatgatttgatgtatttggtatacttgaaagtaattaatgtctttctcacctaaacagtagaaggatcttagaatgctctaatacttacatcctggattatatgcattcatggactgtatcttagctctgttgaaaagtttcaaaaatcccatagagtagacattttaatgactgcttttaccccccagtgtttacttctgtacactcacatccctttacttactccctccttgtatctcagaacattcttccaacgtcattttcctttttctgaagtctgtccttcaaattctttcagttcagatacatttaaaaatgtctgagattttctttgacaacatttttactttacctcttttgttgaaaatatttttgctgggttcacaattctagctttattattattttctctttacccttggtagatatagagagcccagcttttggtgtaattactcttttataggtaatatgtcctttctctctggctgctttacaaaatttgtctttaattttctaaagtttgattgtgatgtgtgtagatttgtatttattttttatctttcttgagatgtttttgtgcctcctgaatctgagggtttatatttactcatttctgggaaatatttttgaaacatttttttccttcattctttctgttctttctttgtggaccctatttggaagaatgttgaacttttccacctttgcctccttgtacttttatctttctttaatctgtttttctttcttgctgtagtttcttaagctgtcttttctgtttagtatttctccttttccatgtgtctaattacccttgagttttacattttaattattgttttcatttttgtacattctgctgttatttttgaattggctggtcattcaaaatagtaatcctagcttcttgattatgtttttaatttcttttaaaattatcttcacccattaaacataccagttttatattctgcagttgatacttctagtatctgaaaaatttttggttctagccctgttattggttctttgtgctggctgttgcttacctggtcttctttttctcatgcgtcatattatgatttttgttatgaactcccatttgctagtatgtatttgtgggaattctttgaagaccaggttgaggatcctttcctttaatgtccaggaagctgggggagcttctatcccaggtctgttttatattaaaattactggcttggggatttttcaggcctgccaaaaatgtgaattcatgctaagcttgaaagtttcctctcttctggtttctgcagggcctgtgaaatgaatgtccgtgtctctctgaggcttttcgctcggtccctctgcgtgaagccactgtaactgaagctctagtcttttggaattgtagcatcttttgcactttcctctaagattttgtgctcttactttgttcctgatcagagatgttttcctttgatttcttgcaaattcattcattatttcaaaggctttgcaaaaaatatttgtctagcctttttattgctctgcagtgtaaagtgtttgggttctctgtattttgcagtatttgcagaaaccaaagtcctgtagtttctgactttcatcagactctgcattgccagccacggttcaatcccaaaacagcttataaagtcctgtcctattcagtaaactgctctgttggttgtgagggatggttgggttgtagtattcttcattccttgtactgtgattatgtagtcctgtggcctgacctggctacctggatgtcatgcgtaatgttcattgaatgaaaatatgtcattaggttttagatggctgaattgaactttgagagtatagtactcttacaaattgagggtaacctgtatgttaatgcaggattggtaataaaagaaatgaatcaataaatatggtttgtgaggcttcccgtgggaccctctctgcaatcgagactcttgattatgtgaggctatgaaaggcggtattatgtgatatcattgctgaagtttcccattttcctgtagcctcacgtagacagatgttattaattcacattatagaattggacatctaaaatgtgagggaagctctaaatacgttaagttcctcttaactagtaggtatgtttagggtgaaatgtagtgtggatggagcattccaacacctttttcttttacatttcaggctaatgctgatgtccctatacaatgtaagcatcaatttgaaaggcttgaaatacatcagcgagagtccaggattcatccctttgctgtggtggcttttgagtggtaaggggggtggttatctgtccagctgcttgtacgggttatgcagtagtcctcccttatccacggggcatacgttccaagtttcctagtagatgtctgaaaccagagatagcaccaaatcctctctatatactatatttttaaacattcatacatctgtatgtaaagtttaatttataattaggcatagaggttatcaacaactaataataaaatagaacaattataataataagccagcaccgctactcttgtgctttagggtcattattaagtaaaataagggttacttggacaacagtgctgtggtactacagcagttgacctgatgacctagatagctactgagtgacctaaagggcgcatagcatatgctggacaaagggatgattcatgtccctgatgggatggagtgggatggcagcatgagatttcatcatgctacgcagaatggtgtgcaatttaaaacttaagaattgtttatttctggatttttccatttgatgtttccagaccatggttgactggctaagtgaaactgtggaaggtgaaactgtggataagaggggcctactgtatacctgttcttctgtagctgaaggaaattttaaagtattagaaagtaggattgattgtaagatgttctttcttttaaaaaaagtcaaattttagaaaatttcttggtatgttaagtttactctagttctgtttctgaagtattgctttcaatttggttataatttactggtgtccctacaacacaaagagaaattgtctcttataaaacagcaggtaaacagcatcagcctatcccattctctattacagcacagtactctatgtgggtatgtggttctgtcagataaaagagaagacccattgttaaataatttgggtaaaaagaaattggaaagacactgcagctatgaagagaagtacacatgtatagtatgtgtgtgttttaaaatttctttaaaaagctatctttactgcatcctttcctcttcacccttaactaccaatctaacctaaagttctgtcccaatttcatcataatttttaacactatatgttgtttaatgagtatacatttcacccatgtataaaaataaattaattttccttatttttttatgattcaaattaacctcttttttttagtgtcagttccatttggtggtgaatgcttttttaaaaaatagctttattgatgtgtaatcgacatgtaataagttgcatatatttaaagtgaacaattgataagtattgatataaatgtccacctgtaaaattattatcacaatcaaggtaatgtgcaaacccatcacctccaaaggcactttgtgcccctttgtggtccctccttcctgctcctctccctgctttccagagagtgactcgcctcctttctgcgctgtagttagttttcattttctttgattttatataagtggaatcatagtttgtattcttttttgccgtgcttctttcactcagcataattattttgagatccatccatgttgattttgagacccatccatgtctatccatgtgtctattaataggtcattattttttattgctaaatattccatgttgtggatatgccacaattgtgtattcattcagctagtgatggacatttgggttgtctccagcttttgactactatacataaagctgctgggagcattcttgtacaagtctttgcatggacatatgcttttgtttgtcttgggtaaatacctagaagtgggatcactgagacatgtggtaggtgcatgttagtttttatgaaactgccaccctgttttccaaagtgcttgtaccatcttacattcccagcagcattgtattagtgtatggtcattctctttaattttagacattccaatagggataccgtgatacttcactgtggttttaatttgtatttttgttgtgactaatgatgttgagtatcttttcatgttttgccattcacgtaacttctttgatgatatctgtttgtatgttttgtttattttaaaaaaattggatagattcttactgaatattgagagttctttatgtattcggtttgtgtcctttgacaaatgtgttggaaaaatattttttcccagcttgtggctcatctttcattctcttaagagcatcttctgaagagcagaagacctatcttaattgtgataaagtttataattctttttcttcgaagaagcatgcttttgttgtagaaattttttcctaaatcagtgtcacaaaggttttctaatgtgttttctcctagtagttttatagttttgcatttcacgtttaggtatatgatttgttttgaattggtatctgtttgtggtgagagtttttgttgttgttgttgtttttatttttatcgtttgctttgtttttttgcataagactttctatctagttgatccagtaccatttgttttgaagactttgttctccagggaattgcctttgcaccttgttgacagtcagttgacaatacatgtgaaggtcattttggattctgttctgttccattcatctatttttggatcattatgccaataccatgctttataataaatcttgatagctttataataaatcttaaagtcaggtagtataagtcgtccaactttgttctctttcaaggttgttttggctatttttaagccctttgcctttccatatgaatttaaaaatcagctcgtcacttgctaccaaaaagaatcctgttggaatttttattgggattgtgttgaatcaacagttcattttgggggataattgacactttagcaatattgagacttacaatccatgaacacaagtatatgtcttcatttatttagatattgtcgagacacaagggtcactcctgtttcttcatgtgttaagagcagaggaactgacctcctttgtttctggctagcttttcaaggatgtgtgtatagcagacatccttagaggacagagatactgtctccttccagagcaaaaagggtaggtttgtttacccttatgtagtaaagataatgtttccctctagggcaaagttcagccagagcttggggttcctctcctgtgacacagcccacacagcatgtatgtggccttgtggaattgggtcttaaactggcataaatgctctggctatggctgttgctataacaagttcttggtctcagactcaagagtttgtgtcttctgccagtgtctgtaagactctagcatgctagcttgttagcttgcaagcttgcaagtagggtaaagccctagaccctccacagtttgagggcaggtccagggggctatgcttgtactccattgacaacacttacccaccagggttggatacttgaccagacagcttttttcctctcaagaatcatagaatcagaggtggttcctagacctgacctgtaaggtaactattcaggctggttgttacgggccgtgagcaagcggacagtgtcagtctgtgggagaggatgctggtggtgccagggagagaataattaaataagaatacctaatacttcttgagtaccagtcatggctttaagtgtgttacgtttgttacatttatgtctgtcagtaccctgtaaggtaaatactgtttctgtatcatagatgaagaaactgaggcatggaagtgagtaaggtgccaaggttatatagttatggggtggtggagctgagatttgagaccccgaccgcctggctccagaccctgtttcccaacaacgctacaggactgctgctcagcaggacatgtctcgggtggaagccttagtgctggatgacttcttatttatttatttatttatttttgagatggagtttcactcttgttgcccaggctggagtgcagtgatgcaatcttggttcactgcaacttccgcctcctgggttcaagcgattctcctgcctcagcctcccaagtagctggaattacaggtgcctgccactacacctggctaatatttgtaattttagttgagacaaggtttcaccatgttggccaggctggtctcaaactcctgacctcaggtgatccacccgcctcggcctctcggagtgccgggattacaggcgtgagccaccgtgccgggccagtactggatgacttctcacatttagttgacattaggtctggctttgcttggcttctgggtcagttgccctgaaacaatatgccagtctctacttaggctaatttgcagccagtaatcctactttctcataaaaagaggagtttagcctaaatgttctctatggcccttttagctctggtcctccggaagtttccgggggtgagtgaaaattgtaatgagtttcatcttaatttatgcagttctgtcagtagcaagcaacccaagtttctgccactcatcagagagtgtgttctttgactcaggtggacttttcctgcttaagctttggcttatggataatatgaggtgcttgttaagttgtgttaatgcaatttttttttgcttctgggacatcatcccaggctttcctttttttttttttttttttttgagacagaatttcgcttttgttgtccaggttggagtgcaatggtgtgatctctgctcaccacaacctccgcctcccggcttcaagcgattctcctgcctcagcctcctgagtagctgggattacaggcatgtaccaccacgcccggctaattttgtatttttaatagagatgcggtttctccatgttggtcaggttggtctcgaactcccgccctcaggtgatctgcccgcctcagcctcccaaagtgctgggattataggcgtaagctaccgtgcctggccatcccaggctttcttatccgtgaaaataattactggttctttcaacacagtgagcacagcccaacccctcataaatccattgcaaggtcatcttactttagaatctttagaatcatttgttctaaagtcaaacaaaacaagatctgtttaagcctaggatgtttgactcctgagttatgtatgggattactttaaatcttaaattatagaatttcatatgtgttttagaaggtgaatatatagtttactatagaataggaaaataggaacaaaaatagttcgtggtgctggtggtagtgggactgttttcagaatttagactgttttcagaatctagaatcataactgcttaggactaagagataatttgaaaactggcttcttctattcctttggttttaggtagatctagtttatgaaaatatactggacagataagaagctcttctaatttttaaaagatcgaggaaaaggagaattgtttgaacccaggaggcagaggttgcagtgagccaagatcgtgccactgcacttcagtctgggcaacaagagtgaaacttcattaaaaaaaaaaataagatcgaggaaaaaaaagatctcattatccctttcagtaatcagttcctacttttatcaatttctgttaagaaatttgatgtattttaataagtacacgagctttggactcattcaacccagatttgaattgcagctttcctgcttgtgaacttacctaaccttttagaatcctgcttttctgatgtataaaatgagaatttctacctcaaggatcttaatgtatattaaaatgcaatagtgtttaggccaacacctaatgtagtaggtgttaaataggtgctagttttcctcttttatttctagtctaaatatctcatgctttagggataaaagacttgaaatgaaaaaaaaaatctcatgctgcaatgaaaactcattttcttttgtttgcttgctgtaaaggtggcaggttactttcaagtatctagacttccctgattcagagtacgagaccagttgctattaatcatccctgactaaatcatctcatttcctttaacgtttgctagatttcatttgtcttcccttcgttcagctacatggctggctttttcccaggctttgtccacattcttcacattcctcttaagccacagaactggcatagaactcgagcaaatagccgacgaggacagagtgtattgagatggtggccacatgttacgtaactgttaatgcagactagtattgtgatcacaggaaactgcatttcctaccatgttttcaatgctaaaagggcagataggcggttatttccatcttacatctatttggcttgtctgagtaacacaaagcattgatcaggttctccagatttgtgccttcagcccagacctctgtcccgagctctagcctcatagattgagctgtctacttgatatctccacatggacatctaataaacattcacattcaatgtgttcagactaaacccctaatcttccctcacaccaaattctaatttctattgattacaattctatttttctagtgtctcagacttttaaaaaaccttcgagtgattcttgactccttgactccttttaatctcttacgccctcattcagtctgttaggaaatcctgatggctctactttcaaaacatctccagaatctgatcaccagctagcactcccacctaggtgttttttttttttttgagacagagtcttggtcagttgcccaggctggagtgcagtggcacagtcttggctcattgcaaccctctgcctcctgggttcaagcgattcccctgtctcagcctcccagtagctgggattacaggcgcccatcaccacgcccagctaattttcccacccagttttgagccaccatcaccttgggttgagagcttcctataggtctccctatgttccatccttccaggccatgaactgggagccaggggtatgatggaaaaatccctgaccacctctccttactgaacagtcaaaatgcggagtgagacacaaaaaaacattttacttacttatttgatacagtgtcttgcagtgtcacctaggctggactgtagtggagtgatgctagctgactgtaaatcgaattcctgggctcatgggatcctcctgctccagcctcctgagtagctaggactacaggcatgcaccaccatacttggctagtttttacaacatttttttgtagagatgaggtttcactatgttgcccaggctggtcttgaactcctggtctcaagtgatcttcctgccttggcttccgaaagtgctgggattacaggtgtgggccactgttcctggccgcaaaataaataaataaataaataaataattaaataaaattatacctagagcatgaaagtcaagtgaaagtgggaggacagagaggttaacagagaacttaacttcttgctttgagggtatttttcaaacttgtcctttagtttccatggctcccagggtgtgggggataggagacaaagccccggtcccacctcaggtgagcatcctgagaggaaactcccaagggtctttcccagcagtgtcggggtaaactgaagatactcgcttaatccgaaagttttttaaggaaaattgttttgacctttggcattgagtgtagtggggggaaaatctcttctgagaattagtaggctggttttcatgcaggtttgaagcttttattcaagccacctaggtggtccctaagagagttaatttttatatcaacttgattggaccatgagatgcccagacatttggccaaacattaactctgggtatgtctatgaggatgtttctggataagattaacatttgaaccaggagactgagtacagcagattgccttcagccagttgggtggctctcatccagtcagttggagccccaacagaataaaaaggctgaataaaagggatctctgccttgactgtttgagctgggatgtgggccttttcctgcctttgaactcaaactgaaacaccagctcttgggtctcgagcctgctggctttcacactggcactacacattggctgtccagagtctccagtgcatggactgcagatattgggactccctcatctccctcatcaggtcttcatgtccctcagcaggcccttcatctccctcagcaggtcctcatctccctcagcaggcccttcatctccctcggcaggcccttcatctccttcggcaggtccttatcccccttagcaggtcttcatctccctcagcaggcccttcatctccctcagcaggcccttcatctccttcggcaggtcctcatctcccttagcaggtcttcatctccctcagcaggcccttcatctccctcagcaggcccttcatctccttcggcaggtcctcatctcccttagcaggtcttcatctccctcagcaggcccttcatctccctcagcaggtcttcatctccctcagcaggtcttcatctccctcagcaggcccttcatctccttcggcaggtcctcatctccctcagcaggcccttcatctctctcagcaggtcctcatctccctcagcaggcccttcatctccctcagcaggcccttcatctccctcggcaggtcctcatctcccttagcaggttttcatatctccctcagcaggcccttcatctctctcagcaggtcctcatctccctcagcaggtccttcatctccctcagcaggtcttcatctccctcagcagtcccttcatctccctcaggaggtcctcatctccctcagcaggtcttcatctccctcagcaggtcctcatctccctcagcaggcccttcatctccctcaggcccttcatctctctcagcaggtcctcatctccctcagcaggccttcatctccctcagcaggtcctcatctccctcagcaggtcctcatctccctcagcaggcccttcatctccctcagcaggcccttcatctccctcagcaggcccttcatctccctcagccggccctcatctccctcaacaggtactcatctcccgcaacaggccctcatctcctgcagcaggccctcatccccctcaccaggccctcatcccccacagcaggtcttcatctccctcagccggccctcatctcccgcaacaggcccttatctcccacagcaggtcttcatccccctcagcaggccttcatccccctcagcaggcactcatctccctcagcaggccctcatcccccacagcaggccctcatcccccacagcaggccctcatctcccacagcaggccctcatcccccacagcagggcctcattccccacagcaggccctcatcccccacagcagggcctcattccccacagcaggccctcatctcccacagcaggccctcatctcccacagcaggccctcatcccccacaacagggcccctcagcaggccctcatcccccacagcaggcactcatctcccacagcaggccctcatcccccacagcaggccctcatctcccacagcagaccctcatcccccacggcaggccctcatctcccacagcagggcctcattccccacagcaggccctcatcccccacagcagggcccctcagcaggccctcatctccctcagcaggccctcatctcccgcagcacagacccttctgaccactggctaaggtgagacttggcagtgccagctatatggctgtggccacagcagtgattttagtggtgggtgtgtgctctgagctgggccatagtctttctccaggagttttctggcttcagctgctgaagaacagtgttttttttgcctttcttgggccgtgaaactattggatgtgactctagagctgcctgtggccgtgttcctggccacctggagaaaatttatctgtgttgtcagttgctgaagccaagacataaatgctgacctgagatgcagaggagccctatggcttgcagtcagctttatccctgtccaggtgggctgtatagcttttcctcagattttgagttatcccagcatctttcataagtgactccttttatccttctttcttttctttctttttttttttttgagacagagtctcactctgccacccaggctggagttcagtggcgtgatcttggctcactgcaagccctgcctcccaggttcacgccattcttctgcctcagcctcccaagtagctgggactacaggcacctgccaccacgcccggctaatttttcgtatttttagtagagacagggtttcaccgtgttagccaggatggtctcgatctcctgacctcgtgatccgcccgcctcgtcttcccaaagtgctgggattacaggcgtgaaccactgcgtccggctgccttttacctttcttaagctaacttaagcatcatcttccttcccttgagggcagtgtgcccactcccccaactttgattccacatcttttccatggcaccagttgccttctgatatggcatctgattcccttcagtgtctggcatttggctatatcacgtaacacagagaaaggccagagggtttagtaactagtgaatattcagtgatgtgtcttcataattcttttcaacccaaatatgtggcattgtcagaatactgtatatgttatgattctagtaagcaacttctttattatgtgagctgtggatggccatttgatagaaaagcaaaatatttaagatcttcaccgacaaagaattttacatgtgaatgttttattatgttggtcaagtgtttctcttgatagttttgcgttagcccagtgttgagccttttagtgtaaacacggggctaataacgtgagctactacaaaatgtggtttttatcttttaaaaaatgtctcaaacattattgacttgaaacttctccttcagaatgtccaatagaacaaaggtgtcagcctttccacaagagaatgctgggactgttttctttgattaatcaatgcttacatgataactttaacaagaaacataatgtaaatgtttgatttttcactgttgatataattgagtggtcaaatggccacttcgtacgtcaaaggatgtcaaaaaacatttggcctgcatatgtccagtctgacaagctgagcgcaatagaaactttagtgtagtctggtcaggatacaattaactcataggcacattgagaaaggggagtgagtttacatgaagatgaatttggtgtgtgacatggtcagtctgacatagtaaaaaaaatccaaatggaaatgtccaagaagtagttggagacaagaagcttagagttcacaagaaacttgctagtgacatgggtttgggagtcattctgaaaaaggtgacaaacagaaagactggcagtgtagggaacatgacacggggaggctggccgagaggcctgagcagagggatgtagggctcatgagagccctgagctaggagacaggtcgaggcatcagaaagcaggctggcccctctcctcctgtattctggtttgtgattctgggtgagtcccttcacttccatgatattctgtcatccacaaaatagagatataaacactgttcctgtctgtttggaacagggtggctgtgagaattgagtggaacagcaattggaaatgctttatacattttaaaaagagggacagaaaccatttctttgagaagaatacaatggctgttagagtcggaactcaaagaaaacaagagtgaagagaagcatttggcaacagagagttattgatgaactctgaaaaggttcccatagagcacagggtcaggcacaagggtggcttaggaggaatgagcagagaagaaagaggggcgggtagtaaggttgatgctgctttggggatttgttggtgaaaggagagttttgtgtgtctgtattaagggtaatcagattctaattttcaggatttcagtctaaaatgaaaaataagaacaagaattaactattttacttcaaaatacactgtggctttcttcatattttcttgggctaggagttcaccgtcccctgcagttcatctttagacggtggcatctgtggcatcaaagtaggctactaaaatataatgcttgctccatttttgttgtttgttttactgtaagccacaaatattggaataatttttataataactctgcatgaattcttcattattctttaagaaaagatgtcgtcgaatgttcttcattaactcattgatgaaggatctgggtgtttaggattgttgttgtgagattagaaaaccgcagctaatgaaatcttccatatgatttgtaagcctcccagctgtgcatacagtcaactgatgacaatcttagttacataatgtcttggaaaccctttctattcagatgtcaaaagaaaccctttaggagatgaaaattggggagttagcatttgtcaaatatttgtgggttatgtttcttggatacaaatataccatttgtgtaagtgctgaaattgttaagaaaaacttggacatcctgggccctgtcaaagtcctgacatcccagaggcggtcctggccgggctggaaggtacacaactagtcttctcttctggctcatgcccctcctaagccagagtgccctgccaggccacagagacctgggtggagcagacagccatggccctggacagccacacagcttcagcccagaaacagcacagggtaggcgccctagccccatctaacctgggaggctgtgtaggagacctctgcttacattctgtggggctgtaggacccttcagaggctttcttatagttgtgtcagtgacagcatgctaaggttatcacctgtgtgttgtgcaacacagagccatccatgagagagcgatgagggtggtacagtgccgagctcgtcgcagcatggagaaggacctatgttgcctttcttcatgattgatttggttgtgtctgtgtagaatggacaccatggatggcttgttctgcaccctttttccctttcttcatttctaacagaaccccaactttattccgggctccatcctccctttcgtggatcatatgactcagggaaagagaagggagtttcatagagagagagaaaaaaagagaatgcacacacacacacacatctctagggaatctcatccctagagattgtattaattgggcaggagtatggagcagggcccaggcatcaggatttgtaagtctctctgaaggatcctaatgtgagacagggttgaaaatggatggtctgagccagccctagccatcttactgtgtgccggtgatgggtttagggctcaaggcataaggtggtcagtgcagggcatccttctgccaacagtgcatggtccatgtgacgcacgttcgtgtgaagagagtccaccaaacaggctttgtgtgagcaacaaggtgcaggcaggccgagtccaaaaaaggagtcagcaaagggtggtgggattatcattagttcttataggtttgggataggcggtggagttagaagcaattttttgtgggcagggagtagatctcacaaagtacattctcaagggcggggagaatattatgaagtaccttcttaagggcaggggaatatcacagagtccattatcgcaagggcagggagggtgtattgtcataaggtcagttgatcagttagggtggggcaggaacagatcacaatggtggaatgtcatcagctaaggcaggacctggctattttcacttcttttgtggatcttcagttgcttcaggccatctgggtgtatacgtgcaggtcacaggggatatgatggcttagcttgggctcagaggcctgacagtccagaggtgggcacatgacctgagtagctacatccagatccaagggatgggggagagacttcttcactggagttgaatgaggaagcctgtggccccgaatgccagccttacagttgatgctgttggggcaggcagagaaaataacccaggccttccataacataattgagacattggatccagccctggacttctcgttttaagaaataataaatgtgattacgtttaagccactttgagctgaagttttgtacttttagctgaagtattttgtacttccagttgaagtattttgactgtttctgtagtaatacagtcactaagtgtcctaagtcaattccagatttattgatatgcagaataaagggaaataaagaaggcgtgataattggaggtaacatcttcattttcttaaaaacatatcctgccagcaccaacttacttgctttggttttcttaaaatgtgaagacaccaaatgcaaataaagaggtgaacagagccccctgcatgtggttgagaagtggaggtcgagggatggggtggtggagtgccaacctgcatgtcagctgtgggtttggggcaagctccttgaccacctgaagaatggtgtcgctgacatcacttcagagcaattacgagaattaaattcgttgacctacatagagtacccagcacaggcactggtgataggcttaggttgaaccacatgaaattgccagtgtttatccactttagaccaatgaaaatgacaatttcacatggtttagctgaataatttctttaataatgatagctgttattaataataagtgaaattgggaattgaggatgtctgtgagcataactaaagcattaatttggcttcaaataatgttcagtgaaagtttttaaaaactgaaattcgccatgtttcacttcactttgcatgttttaagacctttagacaaatttaatttttcaagattttgcagcgtatttgtaggaatacagaagattataactgtgtcatcctttaaaatgcttagtgttaccaaggcaagcttttcatcaatgtgatgtggtagtggagggttgccttctatatagtgttgtgtagactgtacatgactggcgcctttgtcatgaacagcaatggaagcaaacgtgaatatagcacgttgacttgtgcatttactatgtgacagctgctggactagagcctttccttatgggatttggtgtaatctttatgccagacatagtttatatgtggggacactgaggcttagtagtgtagaggctctgtgtaaccactagtaatgactagtaagaggtggaaatgacttaaattcatggtttatagacaagtttaaggcttgcagacaattaggaactcacaaaacaaataggaaaccattgacttattttccacttagaaattgaagtcactgatgtcttggcccaggaagatggcctcacatctgagattgatatcattacatactgttgaatatgagaatttggaaatgacttttttttttttttttttggagacaaaatcttgctctgtcatccaggctggcgtgcagttgcgcgatcttggcttactgcaacctctgcctcccaagttcaagggattctcctgcctcagcctcctgagtagctgggactacaggcgcacgccaccacacccagctaatttttgtattttcagtagagatggggtttcgccatgttggccaggctgatctcaaactcctagcctcagtgagccacccgccccagcctcccagagtgttgggattacaggcatgagccactgcgcctggccgacttttgaatgatattttaaatatccttagcacttaccactgtcttttagtgtgcactaatcttggctattcttttaactataaataggaagaaagctacctttaggagttttttagtctatagtgggatcctaacattagctcacgctgttgtccagctgggtttgttaagatgcacttcctatttatttggcaggattactcaacagtagtgtgtttcattttcttttgggctaaagactttcctcccaaagtaaaaatgcagtaatatgtgtgaaagtagtttgtaagtggtgaattgctagtcaagtgtaagttatttttatcatcctctccttctggaaagaatcaggccggcagtttgtcccacagtgttaggtatcagctccccacttcttgcaattgaagagctacagtgtcttctcaagtttttaaagggagtctgaaagcttaggtggcgggtgtaattctctgtgacaggtttatgaatttttccacggagatgtgcaggcttcaaaataaattgccctttcagcatgaagggatgaggctgcgtcacctcgaaaggcgagcatgctcatgcagcccagtggagcgtcgtgttttcatattctgtaacttttgtggctgacttagtgcacctgttatcagaactgtgatataaatatcctgtaacatttgaggaattccaaatcccggaggtccaaacattttgagttccatttcttaaaatgggaataagacatgaaggagctgcctgaaaagcacagcaggagctgcgtgagcagcaggaggggagggaaggccctgctgctcctgtgccctggttgcctgtgcgcatgcggtgagccctgtgggttctgtcaggcctgggagtggaaggaagcagagcctgaggccctgagctgtgtgtctgccatggctcgtgctgctggcacttttgagccatcccttcatcgggagagaagaggaagcagctgggttgacggcacccccgtcccaaggaggctgagccgagaggaagccgtctcagaggaaggaaaagcaagatcagcctcgaggacagctgctccccatggagggcggccctgtgtgccctgtggtctcagtgtgcgtcgtggatgttggggtcggggaggactaggccacagcttttaccagaattgaaaaagtgcttagggctgggcgcagtggctcaagcctgtaatcccagcactttgggaggccgaggcgggcggatcacaaggtcaggagatcgagaccatcctggctaacatggtgaaaccctgtctctactaaaaatataaaaaattagctaggcgtggtggcgggtgcctgtagtcccagctacttgggaggctgaggcaggagaatggtgtgaacccgggaggtggagcttgcggtgatccgagatcgcaccactgcattccagcctgggcgacagagcgagactccgtctcaaaaaaaaaaagagaaaaagaaaaagggctgaaactcaaaaaaaggtttaggaaccattgctcccaagataatcacccaacgtgtagatttgctgatgtcttcagaggagtcagccagtgcatggcaactgactgatttttttattgtttcaaatttaagtgctaaattgaatagttgtaggttgaaagggcgagatgatgtagctgtgctgttttccaggggaaggcaggatgctggcagtctggtaagagatcctgctgggcctgtggtctggcctcctccccctgtgagagcgccacagtggtcttggtcatgaaaggctgcctcgggccctgctcactcacagaggctcatggagcagaagcccgtcgatggcttggcctcgaggctgtcttcactagtgactgggatgctcttgtcccatgcagacaagatgacttcttcctagtttccaacgacttagcaaacgaaactactcatcacgaggttgccccgaaaggttgggaatcgagcaaagtggaaggaagtggggagctggatgcagatgagccccgagatgcccaggtgtcaccctcccccagcacagtgccagctctactgatgaccccttcctgtgctgtcctccacaccctcccccagactgccaggtgccccttcatttcacagggccttccccccaggacgccaccagcacagtttgtctgtcccctgtgagggagaaggcagagaccaagtcctggtcattgccctgtgctcagttgtgacccagagctggggaagcagcagtgtttgatctgcatttatcacatgaacgaaggtgttttggtctggccttctgaagattacagcagggtcattttgattagagttttgggtaattcaggactcttcatatgttactggttggatttctaatttattttccaagatttctaattatgtacattctaagtctgtgggttttcctagtttcactctgagatggtagcattgttgacagttctcaaggggagccttgggctcctctaggctgtccctgtagctctgtgaatggaacaccccgccatgggcccaccacacagctggctcggcagtacagctgcaatgggaagtgggcagcgtcagccccccgtcacactgggcagcagcattagaaaggtggctcttctgtggtcaaagagctagtagacaggggagccaggatcaaaccctgctttttctgattccagagcaccatgcttggcttacccatgcagagccgtggcagcggacagctggggacacacacgttctttcattcactcactcatgggctcattcatgtattcaccaaacacttagagcctcgtaaggaccaggtgcaccgctagtgttgtagaacaagggaaacttctcactctcacagatttaatgactgttcattgctatactccaatcttagtgtgttttgtcattgtttagcattgtgaaagtagaattgatttgggtgtaatccaaaagttttatagcatagagaagaaaagtcaaagataccaagaacatctaagccccaaagattggaactttttcactttgctaaactgtcaaatacaggaaaatgtgtgtgtgtttcagagggctctgactctgaagacagctcgttggaaaaggcagcatctgcagctgtcatttttgccagacatcattggttagttttccaacagagaggagagagctcagcagcactcgtccttgtcctctcggacacctgagtgccagggagcagctggagaggaggcgttgctgctgaagccctagggagttctgtccactggctttgtagtgggccttccctgtgtgcgcttgtgctggatgtaggaaatgtgggcaacttcacatgctccctctctgctgcacttcacacctctgtttctccctcacctgctttcctgagggtgcgtcttgccccagggtcctgtccacagcaggccacttctccaagcttacatgttctccgggcagtcacgtctacacctatgactgtcactgctttctttattacagtggcactgaagtatctaactcaagcccaagtctttctcccaagcgctgggctagcacatccagtgcctgtgcctttccttcacatggacctcccacagccacctcgtgactcccagagctggacatgtcgtgtttcccctggggctcgccctgtgttctctcttgcacatcctggctgatggtatcccctctcctcccccaagcctggcctttcccttcactcccactgtggaggtccagtcaggccatgcgtcctcttgctcctggctgttgtaacttccagaatgtctgctgtgtcctgcagactctgattgggtccagactgtgagcatttcttgttgggtcaccaggggatctgttggtggttccctcggctttggacctagtcgctctgattcagccctctctctccccgctgttttgttagactgatctttcacagtcggattacaccactgacatccccactgaaaaccggaaggggctctggtcagggtccatgatctgacctcctctggcctcaaccctgggcatcctcatcaccgtgtccctctgttcacactcctcacattgccttgttgggtttggactcagaaaggtgagagcttttcaggagagaaacagactcaaaatgtgaatctgagagagctctattttgagctatgatatgaagcagaattgattccatcttcagggtagagcatgagggtggcagtgaatagaggggctgagccgccgcacactccccctggcctatagaaagggaaggcagagttgctgaggggttcggagttgcttggtgaagggagagcctggaaaaggagcagaaaacaagaccaagaggctgaggactgagtagaggccccgagagccagtgtccagatgtctgggctccttgaagaaagcagaaccagtagcattgtggtgctagaagccatattgaaggaaggctagggatgacaagcacggagggagggccccacgaggtatgcagtggcagcaggtaggagtgaaatgacacagtgtcagggcaaagctgcgtggacagagggcggaggggctgtccaggagtgagtcaaagcagaggggcttccacagagtgctgtggaggggagaggcttcgtggactttgtggggacagcatttgtatctgggtacctctggaggatttctgatctaatttgcgatgaagagaatgcttatatgtctttgttttaaatatacacaaataattcagtatacatgactaatggcatatgtacatatatttaaagtaagggacgtaagtattgctttgtcccacattgtgttatcacaataaacaaaaacatatttgctgacacaaactctaatatttaaaacgtattctccataaactgaacttcccagaaaaccaaaccaaaaggtaattcttgaaaaggtaattctttcaggccataagtatgtgataatctgcatggccaaaggaagcagagtagccaatgagagccctaatagttattattacatttgtacttgttttacatgtattatacaatgtgctgtataaaactctttgagatggatgtactttgtattatattgacaaggaaacaggctcagagaatgtgaaagatttacttgccaaggccagtcagttaggcagtaccccatttggcattcatatcctggcccctgactataaaccctctacctcagcttgtgtgttttctcctgtgccatgccgaatttataaattaaacctacgtttaatttgaaacgtaaaaattatgtgttgccttcattttaatagatgaggaattctgagaattctgtttgccagtggtatttctgttatggttactgacatctgcttattttaatgtattttgacatgtgtggaagtgggactaatctggttgtgattcaggctctgcatatgtatcagagctgacccatctgccatgcaagtatattttagaaaaggagcaaattcctggctgggccaagtaacaccttttccacttctcctctgtgtgtgatctgttgtctacagtatcatgttgaaaaagttgagaagcgattttggaaagagagaagtgaggaatctgttgccagagtgtaattgagaaacagatgagctaatggaagaagccaagatgttacattccattataagggagttgtaatttactgtgaaggttgagggaatagcatctttttggaaagaaaaaagtcagaaatataaaatagcctactatataaagttttatgactccatctcataatcatttaaatgggtagatactttatgttcctataccttcaaaatccagcttgaaaccaccttccagagggcctttccagatttcacgtcctcaagtctgatcattccttcttctgtatcccatggtgaatattacaaatagagtcatagttgtaccttctgaaactgtttcattgtaaaatcccttgctgggtgtggtagctcatgcttgtaatcccagcactttgagagggcgatgcaggtggatcacctgaggtcaggagttcgagaccagcctggccaacatggtgaaaccctgtctctactaaaaatacaaaaattagctgggtgtggtggcgagcgcctgtagtcccagctactcaggaggctgaggcaggagaatcgcttgaacctgggatgtggaggttgcagtgagccaagatcacaccactgcactccagcctggggacagagggagacttggtctcaaaaaaaaaaaaaaaaaaaagaaaaaaaaagaaaaatccctaactaggtaagaaagtaaggacttggtaagagagcagttgtgtttcttttttgtcttccacagaatacagtgagggagctttgtgtcccctcttcagacaatgctgccgagccagcgtgctgaacctgccctggctggggatggtgccgtgggagggtgcgcttcagcttggagtacactcatgagagttagtctgcagggagtgggccggcctgtttattaccattgttgttgagctcccagcactcgggtgggtcagaatgcagggagtggaccagccccatttgttatagttgtcaggctcaggagtgagcaagacagagttctttccctatggaacttatattcaggtgaggagacttgatagtaaacaaatataatggcatatatcatatagtaatgcaaataaaaatggagtggcatgaggagcaggctagagagtgttgggcggagctgctcttttgggtatttgagtggatacctgaaggaagcgaaggacagcctgtgctgagatctttgagcagagcatcacaggccaagggtggcaggggaagggtctgaggcagctatgggcaaaggagtattgtaggagtgactaaaggccagtgtcgctggagaggataagaagggaatgttaggagtcggggccagaggaacagctggtgctgggaatcatcatagtgtagaaggtatttgtagccatggtaggggactgcattgctgagggagtgatatagggctgaggatgaagctgtggggccagcattttcagtgcagatgaagatgatgagggagcacagaacagccaggtgaggtcggaggaaagccgggaagatgcagtgtcctccagggctaaatggaaacagtgtttccacatgcagctggggactgtcctgtgctactgagctgggcaggtaagcctacaggcgggcgggtgagagggcccagctgtgtgagtggggcttgggggagccacttggtctcttcaccatcattagtggctcataaatgaagctcacagtagccagcatgacttttattttttattttatttatttttttgagacggagtctcactctgttgcccaggctggagtgcagtggtgcgatctcggctcactgcaacctccacctcctgggttgaagtgattctgctgcctcagcctcctgagtagttaggactataggcatgtgtcaccatgcccagcaaatttttttgtatttttagtagagacagggtttcagcatgttggccaggctggtctcgaactcctgacctcctggcctcccaaagcgctgggattacaggcatgagtcaccacacctggccaccaacgtgacttttaagacactctcagtcttagaatcctgattgggaggtggcgtcagaatctcagatggtaacactgatgtttgtgtgtggctcacagattgaaggtaattctaggaggagttccaaaaatgttctgaacaatgacagtattttgaggatgaagacataacacctcatcacacacacagctgagtgccttgaaggggagagcaaactttgggtttctgtgagttctggtactctggtgaaagggtagtgccctggagacctcctgggctgtttccatttcagatgttggtcatagggcaggactctgtggaagggataggcagttttcacagcaagggaggaacagctgccagcccacactctcttctgccatattgaattattgagggagagaccagttttcttctggatggtttttttttgtttagcagattcttgatgaatatttgattttggtggagagaagttttcttctgtggaggacttttcagtttattattacttgttctcttcattctccttagttccacacaatggcagctacctattcttttttttttttttttttttttgagaagtttggctggaattctttttgtaatctctaaattgttttttaagaattagctagataatttttctccagggaagggattcttttgttttacataagcatatcttaatagatatgattttaacaatcaaattatgttctaattgtaacttaacggatcttatggtcagtacttttgtcgatttgccttgaaattgatctgtttttatcaaaggccctttttatagtttaaatgttctccaagaacaggctgaaagcacacctgccctcccatttcccatgcttgtgtgtcaaggattgttgtcaatttccacaggcatgttgcctttttgtgttagtttcactgtttgtcagcccttttagataagacagggcaaggcattgaaccctccagaactcgttcccctcattgcagatggcagcagtaagaccactgcacttgggtgagggtcactcataaaaagggcagaagtaaacatcacctatgaaagtattgttcttatatgatagcactaaatgtactcaaattgctactttaatacaaaggttcctatggcaatattaaatgtgaatctgatctgttttaatgtttaaagctcaataactctccttggttagagaatcagataattagttttggttggtgatatggtttggccctgtgtcccccccccctccccatatctcatcttgtagctcccataattcccatgtgttgtgggagggaaccggtgggagattattgaatcatggggatgaatctttcctgtgctgttctcatgatagtgaataagtctcacgaggtctgacggttttaaaaatgggagtttccctgcacaagatctctctttgcctgctgccattcatgtaagatgtgacttgctcctccttacctcctgccatgattgtgaggccttcccacccatgtggaactgtaagtctattaaacctctttttcttcccagtcttggatatgtctttatcagcagcgtgaaaatggactaatacagtaaattggtaccaggagtgggttgtgcggaaaagatacccaaaaatgtggaagtgactttggaactgggttacaggcagatgttggaacagtttggagggctcagaagaagagaggaaaatgagggaaagtgtggaacttcctagagacttggtgaatggctttgaccaaaatgctgataatgatatggacaataaagtccaggctgaggtggtctcagacagagatgaagaacttgttgggaactggagcaaaggtgactcttgtcatgttatgttttagtaaagagactggtggcattttgcccctgccttagaggtctgtggaactttgaacttgagagagatgatttagggtaactggtggaagaaatttctaagcagcaaagaattcaagagataacctgggtgctgttaaaggcattcagttttgtttttttttttttttgtcagtaaatactttattcatttctctgttgattttttttcctcattacaaaacagcactgtatacagctgtgcattttctggttacatggaagtggaattatttggtaaatgtgcatattcaacatgaataaaaatgaacaatttgctttccagggtagtattttaaatttatactcccatattccaccagcagtgcttgagagttattgtttatcagcatttcctaatgtgaaatcggagtttttctaaatgagatttttggctatttggagattttcccactttccttggaatggtctattcagattctctacagtttttattttatgagatttgatttgtaaatattctttatatatttgagttttaactttttgtcagtatgtgacaaatatattctgtcaccttgtgggtttgtttttaactgttcgtgatatctttggatgtgcaaaattttaataatgttggatttatattttttatagtttttgaatgctgccttttcataaaggagttatctgacttccactttccccaggagctgcaggcatcaatttggcaagtttacttagcgctggtgtacttggtgacggccttggtgccctcggacacggcgtgcttggccaactccccgggcagcagcaggcgcacggccgtctggatctccctggaggtgatggtcgagcgcttgttgtaatgcggcaggcgggaagcctcacctgcgatgcgttcgaagatgtcgttgacgaaggagttcatgattcccatggccttagaggagatgccggtgtcggggtggacctgcttcagcaccttgtacacgtatacggagtagctctccttgcggctgcgcttgcgcttcctgccgtccttcttctgcgccttagtcacggctttcttcgagcccttcttgggcgcgggagcggacttcgctggctccggcatgttgaaggcgaactacgagcctgagacgagcagcagatcgtgaaaacgggaagtaatgcaaggcattcagttttataagggaagtggtttggaaaatttgcagcctgacaatgcgattgaaaagaaaatcctgttttctgaggagaaattcagactggctaaagaaatttgcataagtaacaaggagctgaatgttaagccctaagacagtggagaaaatgtctccagccatgtcacagacttttgtggcagcccatcccatcataggcctagaggcctaggaggaaaaagtggtttcatgggccaggcccagggtccctgtgctttgtgcagcctagggacttggtgccctgtgtccctgtcactccaaccatggctgaaaggggccaacatagtgctcaggtcctgcttcagaaggtgcaagcctcaagccttgggagcttccatgtggtattgagcctgtcagtgcacagaagtcaaaaattgggttttgggaacctctgccaagagtttagaggatgtatggaaatgcctggttgtctaggcagaagtttactgcagggatggggctctcatggagaacctctgctagggcagtgcagaaaggaaatgtggggttggagcccccacacagagtccctactggggcaccacctaggggagctgtgagaagagggccaccgtcctccagaccccagaatggtagatccgctgacagcttgcaccgtgcacctggaaaagccgaagaccctcaatgccagcccatgaaagcagccaggagaggggctataccttgcaaagccacaggggtggagctacccaaggccatgggagcccacctcttacatcagcgtgacctggatgtgagacatggaatcaaaggagattgttttggaactttaagatttgactgccctgctggattttggactcgcatggggcctgtagcccctctgttttggccaatttctcccattcagaatggctatatttacccaattcctgtatccccattgtatctaggaagtaactaccttacttttgattttataggctcataggcagaagggacttgccttgtctcagatgagagtttggattgtgacttttgagttaatgctgaatgagttaagactttaggggactgttgggaaggtattattggttttgaaatgtgaagacatgagatttgggaggggccaggggctgaatgatatggtttggctctgtgtccccactcaaatctcatcttgtagttcccacagttcccatgtgttctgggagggacctggtgggagataattgaatcatgggggtgaatctttcctgtgctgttctcgtgatagtgaataagtcttatgagatctgatggttttaaaaatggaaacttccatgcacaagctctctctttgcctgccgccatccatgtaagatgtgacttgttcctccttaccttccaccatgattgtgaggcctccctagccatgtgaaactgtaagtccattaaacctctttttcttcccagtcttagatatgtctttatcagcaacgtgaaaatggactaatacagttggtttataaaactagttttaaaaaattcaatgggatgtttttcttggcccatttaattttttcttctttactgcagagaagtaattgtagagatgtccttcatgttgtttccagagtaacacacattgacatttatatgtaagagctggtgggtactgtaatcatctgagagaaatgatcagatgtcggtgtagggcaagggcagctgccgtcagaagaaacaacaccatgaaaggccaaaaagatttatgaagaacttgacagaaataagagatttttaaaaatgctcgctggtcacttggaacaaatagcagtgtacaaggcatgatttgaatgactacttagattgtagttgagaacatctgtggctttcaggatattttaaaattacagtttgatgctcaaggcacctatttctttagcttaaaggaaaaggatctgcaaagagcagaggaaaaccaagtagattttattgcttggctgagtgtgctgcggcagatgacatgtagcttatttcgaagatatgtttggcattatttatttttagaatttacctgatatcagatcttagtctactagacagtgtgggagcacgcattgacagacagcctgggctggcacaccccatgaacatagtccctgatgcagggtatggacagcaactcctacttgactgggaaactccaggcatttcacgtgcattaggcctcactgtgatgcaggcacatctcaatgggtccagccaaccctgctcaccacagtggtatgtgttcaggtgcaatgtcagctgggagtgtacacagcactggtttggatctgtgagggttaccaccttgcatactgtgtgacagaacttgaaatttgccgagaaggcaagacttaaatgaactagattcagacagtacaaagtacttgatgaggtgatggtggtgatcgtgagcagttctcagtgcttcctctgtgttgagccctattgtgagcactttccatgcattaacttgccagccctgccaggtcagtgctgattcacccagggagcaagtggcagagcaggatgtgagcccaggccatgaggatcctggtagagccaggaatcggagtggatgtgtcagtaagggttagggtgggtaggcagaagttgctgaaccctattgccgagttcatgggtctgggagaacacgagttcagttgaccaggagatatgggaaggactttggcaaatgtttctttttctttctcttttcttctctctgtcctccccttccatcatccttctcttcctttattcttcccttcattctgttctcaggcttttttatatataatattttatatatttatggggtgatatgtgatattttattgcacacatagaatatatactgatcaggctgatcaagtcagggtatttggagtatccatcaccttgagtattatttatatgtattgagaacatttcacatacttctagctactttgaaatacagtatacattgttgttaactatcatcaccctactctactctcaaacattagtacttacaccttctatctgactgtgtttgtattgaccaacctctctcatccccacttcaacccacagacccttcccagcctctgctatcagtcactctactctcaaccttcatgagatccactttttagtttccacatatgagtgagaacatgcaaaatttgtctttctgtgtctggcttatttcgcttaatgacctgcagttctatccatgttgctgcaaatgacataatttcattcttttctaagcctgaacagtattccactgtgtatatataccacattttctttatccattcacctgttgacagacatttgtaggttgattttgtctcttgtctattaggaacagtgctgcaataaacatgggggtatccctttgatatattgattacttttcctttggataaatatccagaagtggaattgctagatcacgtggtagttctatttctagtttcttgagaaatctccatactgttttctgtagtggctattctaatttacatgcctatcaacaatgtgtaaaagttcccttttctccacatcctcgccagcatctgttttttgtctttttagtgatagccattctaactgggtaagatgatatctcattgtgatttcagtttgcatttccctgatgattagtggtttttttttgtatacttattgaccatttgtatggcttattttgaggaatatctgttcaaatcttttgctcactttttaatgggattatttgttcttttatttgagttgtttgagttccttttagatagatccccttgtcagaggaatagtttgcaaatagtttctcccattcagcacattgtctcttcattctgttgtttcttttgctgtgcagaaggtttttagttcaatatagtctcatttgtctatttttgtttgttgtctgtgctttcaaggtcttagctataaaatatttgcctgtaccaaatgtcctgaagtgtattccctatattttcttctagtagtttttagttttgggtctaacatttaagcttcaatccatcttgagttgctttttaaatatttggtgagagatagggatcgaatttcattcttctgcatatggatatccaattttcccagcaccatttatcaaagagactgtccttcccccaaggtatattcttgcacctctgttgtaaatacgtggatttatttctagattctggattctgttccattggtgtgtgtgtctgtttttataccagtaccatgctgtttcggttactaaagctttgtaatctgttttgaagtcaggtaatatgatgcctcttgcttttttctttttcttttcttttttctttttttttgctcacaattgcattggctatttggattcttttggttccatgcaaattttaagattttttttcaatttctgtgaaaaatgacattggtattttgatagagattgcgttgaatctgtagatggctttgggcagtatgattattttgaggctattaattcttccagtctttgaacatgggatgtctttttgtttatgtcctgtttaatttctttcttctgtgttttgtcattttccttgtagagatctttcgcctcctaggataaatttattcctaggtattttaattttttggtagctgttgtaaatgcgacttcattctttatttctttctcagcttgttcattgttggtgtatagaaacactgttgatttttgtatattgattttgtatcctgcagcttcactggatttatcagttctaacagttttttggtggactctagatttttctaggtagaagatcatatctttagcaaagaaggacagtttgacttcttcttttccaattttgctgccttttatttatttatcttgtctgattgctctggctaggtcttccagtactatgttggataggagtggtgaaagtgggcatcttgtcttgttgcagttcttggctgaaaggatttcagcatttctcatttagtatgatgttagctgtggatttgtcacacgtggcctttattttgttgaggtatattccttctatccttagtttttttaaggtttttatcataaaaggatgttgaattttaccaaatgcttttttagcatctgttgaatgatcatatggttttgtcgtttgttctgttgatgtaatgtatcatgtttattgatttgcatatgttgaaccatccttgaatccctgggataagttaagttccatttgataatgatgtgttatttttctgatgtgccgttggatttagtttgctagtattttgctgagaatttctaagtctatattcattaggaatgttagcctataattgtcttttcttttctttttttttttgtgttgttgttgtttgagatggagtcttgctctgtcacccaggctggagtgtagtggcgtgatctcggctcactgcaacctctgcctcccaggttcaagcaattcttctgcctcagccttccaagtagctgggattacagatgcatgccaccatgcctggctaatttttgtatttttagtagagacggggtttcaccatgttggccaggctggtcttgaattcctgacctcatgatccacccacctcggcctcccaaagtgttgggattacaggtgtgagccactgcacctggcctagcatatacttttctttttttgttgcatccgtgtctggttttactatcaggataatgctgacttcatagagtgatttagggagaatccctttctcttcaattttttggaatagttttaggagaattggtgttaattctttgaaagtttggtagaagtttggtagtgaagccatccagtcttggacttcactgggagactttttattactgattcaatttcatttcttgttattgctctgttcaggtattctatttcttcctgattcaatctagtagattgtatgtgtgtaggaatttatccatttcctctaggttttctaggtagttagtgtatagttgttcataatagtctctggtgatcttttgtatttccatggtatcagttgtaatgtctcctttttaatttctgattttgtttgtgtcttctcttggttagtctaggaagtgctttatcaattttatcttgtcaaaaaaacaactttttatttcgttgatcctttgtggttttttttttctctgatctttattacttgtttctttctactaattttgggtttggttggtttttgtttttccagtacctcgaggtgcactgctagattatttatttgaaatcattctactttttctgatgtaggcatttgttactataaacttccatcttagcattgcttttgctgtatcccatttggttttggtatgtttttcagttttcatttgttttcaagactttttaaaaatttcctccttaatttctttcttggctcagtggtcagtcaggagcatattgtttaattttcatgcattcgtagtttccaaagttcctcttgttattgattttgagttacattccactgtggcctgaaaagatacttgaatgattttgatttttaaaaatttgttgttgcttgttttgtgtcctaacatgtggtctatcttggagaatgttctgtgtgctaatgagaagaatgtgtgttctgtaactgttgtatgaaatagttctgtaacgtctgctaggcttatttggtctaatgtgcagtttcaatccaatatttctttgttaattttttgtctgagtgatccaatgccgagagtggggtgttgaagtcttcaactattattgtattgcattctgtctctccctttagatctaatagtacttgctttatctagtgctctggtgttgggtgctctggcgttgggtgcatatatgtttggaattgttatatccttttgctgaattgatacttttatcattatataatgaccttcttttgtctctttttacagtttttgacttaaaatctgttttatctgacataaataaagctacccctgcttgctttttgtttccatttgcatgggatatcttttcttgtccctttattttagtctatatgtgtctttacaggtgagatgaattttgtgtaggcagcatgtagttgggtcatgttttttttttttttttttttaattcattgagccagtctgtatcttttgagtggaaaatttaatccatttacattcaaggctattattgatatgtgaggtttacctctgtcattttattacttgatttctgattgttttgtatatcctttgtttcattctttctctcttgttgtttattattgtggtttggtggtgatctgtagtggtaacatttaagttttttctttttttctgtgtttgctctaccagtggtttttatattttcatatgttttcatgattatagttactgttctttcacttctgggtgtaggacttccttaagcattttttacaggactggtctagtggtgatgaattccctcagcttttgcttgtccaagaaatacttcatctgtcctttatttataaaggatacttttgctgcaaatagtatccttgaatggcagttttttttctctttcagcactttgaatgtatcatcacattctctcctggcttgtaaggtttctgctgagaaatccgttagtctgatgagggttcctttgtgggtgactagatgcttttcttttgctgtttctaaatttttctctttgtatttgacttttgacagtttgactgtaatgtactgtggagaggatctttttgaattttatctatttggggatcattgagactcttgtatctagatgtctaaatctctttctagacttgggaagttttcatctattgttaaataagtttctgtttgctttttctttaccttctgggacaccaaaaatttgaatatttgatttatgatgtcctatatgttacaaagcctttgctgattctttttaattctttttttttttttttttaatctttgtctctctgggttatttcaaatggtctgccttcaagttttgagatttttttcctttggcttctctagttattattgaagcttttgaatttgttttgtatttcattcaatgaatttttcagttacagaatttctgtttggctcttctttatgatacctggtaaggttcggctatgtctgcacccaaatctcatcttcaattgtagttcccataatccttacatgtcttgggcgggacctggtgggaggtaattgaatcgtgggggcagtgacccccatgctgttctcgtgatagtgagtgagtcctcacaagatctgatgtttttatgaggggcttttccccctttgctgagcacttcttcctgcctctgtgtgaagaagaatgtgtttgcttcaccttctgccatgattgtaagtttcttgaggcctcctcagccatgctgaactatgagtcaattaaacctctttcagttaaacctctttcctttataaatcacccagtcttgggtatgtctttattagcagcgtgagaaaggaccaatacaatatccatctcttggatcaaatttctcattcttatcctgaattgctttttaaattcctttgtatttttcagcattctcctgtatgctattgaacttccttactatcaatattttgaattattttcctggtattccataaatttctttttgattggaatctgttgctggagaattgttttctttaggagatgtcatattttcttgctttttcatgtttcctgtacccttgcattagtatctctgtggtataatggtcatttcttctaagttttttgaatttactttcgtaggagaggacattttcccgaagatgtatctgtggtattggtaggtagggcactttggttttgaatctgggtgtgtgcagtagtgtagtctctgtatgatttctttggctgtaaacagcattaatgatatctatgattttcttaatggcttagggtatggttgttagtggaggctgtggtgaaattttgctgttgacctgggtgccaggtaggccagtcttttggccccagtggtggcagtggtggactgagcatgcctgtcctcaggccccagggtggtgtacactggcaccagtgttagtaggtccaggcaggccagttcttgggcctccaggtggcttctttgggtactaggaatggcagtggtgggttgggtgggtgggtgggttcctgagcccctgagcagcaggtgtggtgtggttgatggcaacagcagttgtggtgtgggtgatggcaacagcagtggtgggacagccctttggggtcttcatctctggtagcttatgctgggctgttttccaaagtgctgatgtttgtgacggctgtgacaggttgggtgggctggtccttggacctgcaggtggcacatatgggtgggtcgcagcggtggtggtagcagcaagctgagtgggcctgacccactctgggagactctgctgagatgctactggtgatccccaggcccctggacagtgtgatctggttctagggagggatggtggaggcaggctggctggacctgccctcaggtcccttggtggggagtgtagttattggctgtggtaagtagcatcgaggtgattcctaggcctcccgtggaatgctcaggtaggggtggccagagtttcattgtgtccctgctactggggagggcagggtttctttccctgggagcagctgtagtcaggcacctagggggcatgggctttgattgcacctcacctcaggcctgcagcagctcatagtggtagcagttgcaggtagtcgactttgaccttggagctcatgaaaatacatggctacccatctgcagggatggtgtgggggatcactccctgtggctcccacctccaccctggtggcggggcaggctgcagttcattgggggttgtactctccaagtggtgccatgccacagcagcttaggatttggggggttgtggcacccagcgtgggctctctgtggagcagtgcctttgtacagtcttcaggcagctctccgcagtagtcttggggtcctctagaattgaaggactctcccagggctgtggattgtagaagtccacagcagcaatgtgaactgctgggaagggtctttcacttaccctttcccccaattagggagccactgctgactcccagttgatcccagcctagcaagctgccttggttttctttccttccttgcttttggtgtttctgaatgtttctttgttgaattccaaagttctctcttaggttatctatttgaagtgtgattacttgctattttggttcttctctgtggaagaggtgagcaccagatctgtctagtcagccatcttgaagcctcaaaacccttttttttttttttttggacacagagtatcactctgttgctcaggctagagtgcagtggtgcaatctcagctcactgcaaccccctcctctcaggttcaagcgattcttctgcctcagcctccccagtagctgggattacaggcgtgtgccaccacgcccaactaatttttgtgtttttactagagacaaggttttgccatggtggccaggctggtctcgaactcctgacttcaagtgaaacacctgcctcggcctcccaaagtcctgggattacagacataagccaccatgcctggtctcaaaacatttttaatgagaagcacagcatacctagagaaaagtacagaaacataaaagtgaagctcagagaataattacaaaggaacatttgttcaccaccacccagggtgagaaatggcatgttgcctgcacccaggaaatgcgtgtgcttcttcctcatcactacccactcccattttcccatttttgaacattatataaatgaaaccatactttgatgttggctttttcattgagcactttgctagtgaggtccatcgtgctgttgcatgtagctgtggttcattttcactgccacctcgtagggtttctcagcactgctgacgtttcaggcttaatgatgctctgctgtggggctgccctgttcactgtagggattttagcagtcttcctggtctttacccaccagataccaatagtgtctcccacttgtgacaatcaaaaatgtttccagatgttcagattgccctctgggatggcaaaatgcccctcgccctggttgagaaccactgctctatagtacaggttgaatatcccttatttgaaatgcttgggacaggaagtgtttcagatttcagattgttttggattttggaatatttgcatatccataatgagataccttggggataggacccaagtctaaacatgttcatatgtatttcatatacctgtgatagacatagcccgaaggtaattttatatagtacttttagtaattttgtacatgaaacaaaatttgtgtatgttgaaccatcagaaagtaaaggtgtcactctctgagccgcccatgtagacattctgtggttgtttgcatcaccatcattcctgactctgaatttataagtggctgacaagcagtcattttctctcacttatgcacacctaagtatttaacagtatttactggccctccatggggcaatgtggggaacctgcccttggtgcactggcctgcacacacaccattttattacctttgtgggtgtgcttgcattggggaatccgggcctgcatggaaaagacatcgcagccaaagggacctgaacggtctcttttcccttggtgactctgaataaactgtgtgttgtgtgcctgccttttgattgtaacctgtcgtgtgaagtcaggtgtggaatttttcacttgtgtcatcatgttggcactcaaaaagtttccaactttggagcactttgggttttggattttcagattgatgatgctcaacctgtattctattgtatgaatttaccagtttagttatccattttactattgatgcacatttggattatttctagttattggcctttacaaatagtacttctctaacattcttgtacttgtcgtttggtaaaggacatgtgcatgttttcctgttgcgtttatctttaggaatggaagtttgggatctatagaagtgcatgtcttcacctctagtagtttatgctgggctgttttgcaaagtggttatatcaggtgtgaacatttaccaacagcaaaggagcgttctggttgcttttctttcttggaaacacctggtattgtcagagatcttcattgtagccattctgtggggatggagggctggctcattgtggttttaatttgcattgtttttatgagttctgaagtggagcaccttttcctgtgtttactggccatttggatatccatttttgtcacaacctattcagagctcttgcctttttttcttttaggttgtctgaatttgtatattctggatacagaatcttttttgattttattaaagttgcgcatttattttaccactccatgtcttgctttatttctcttaatggtatgttttgatgaacagaagttcctgatttgaatgtactctgagtgcttaatgtatcctgttaagaaaatgtctgcttacctcaaggtcatgaatatatctgcctatattttctcctcggtttctctttttgccttttgcatttatctttgggcatgctctgtgataggggtcaagttaagcgttccccagggttctcacagacccagcactgactgcggagggcactgtgctttccccactctcctcggtgcccacacgtgtgtggggtctgtgtctgtgctctccattgcactcggccagtctcccatcctgcagtgctacattgcctcttgtcaagatggataagtttttgatacctagaacgaacattgtttttcttcaaaaaatgccttcactattattgtctcctttccatataaattttagaatctgcctgtcaaattccacaaaggacaccgtgttgattttgatggaaatttcatggaatctgtagatcagtttggaagaattgacgtttttagagtgttgagacctccagtacatgacatgatacatttcttcactgcttagggccgtctttctctcaacagggtattgtagttttctgaatggaggtcttcaatatctttaatcagatttacacttagtagtagtcctccttctttctaattacataattagaaacagtgtctatcactaaacatcactaattcactcaccactacgtgccaggtcctgttctaggcactgaggccacagcagcaagccagacagccccaagtccttgccttcatggagctagccagtgaggagagacagcagcgccagtaaagcagcgcagggcactgtggactctgtgatatttaatgccatggagggtaaagggcgggagacctgagaggggtagcttttgtgttttaattttagagtggtcatggaagaccactgagcggttgacatccacacgaagatctgaaagaagagggaagtgagctcttttttttaaggcaattttataactttatttgatgtatttgatgatcagctgttagttctcatccacattgactgtctatagatttttgaaagcagtaacgggtacataagtaatcaaagtatagagtttatttggtgaatcttcattctctttacattttctggacaaccgcacacggatgcggtatgggatattccttattcctttggtccagacagctttgttgagcctggtatcaatgcacatatctggagttcccatctccttcatggcaaatttccaaatctctttgagtgcctgaggggcacgcttcttgaaggccactctgtggatgtgctgtgaatgttgatggcgtatctcaggtcaccaccttgttgatggtagaacggccctttttcttctcgccaccctttgtaggagccattctgccaggcccaagttggaaaggaagcgaagcaagctcttagggtgtctgggaaggcacgttccagccagagggatcaacatgtacaagcgcccgaggtggggtgtgttagcagagccagaggcccatgtggcaggcatggggtgttggaggagagcatgggggtggggtgaggctttagtttgtgtaatttggaaattactgtttatggaatgcctactatctaccaagtgtgatagacagttttgctggtatctcctcctttatttagtctttataatagtggtgtagagaatttaaaaccagtttatagatgagaaaacaaaggcctagcaaggtgacatggctttgccgaggggctgctggtgagtgactccagagtctgtgtttgcgcctccacatggtgctgcacactcagtgtgcctcatgtgttattatagtttatgcatttaatgtgtgagttttagaaaaacagacaattagcagataagtaaagatagatttgtttattgtcatttgaaggtgtggttgacaatagggccctgtgagcatgtgcctgaggagcccaccagcaagtaccaaggagccagcatagctgtcagggtgtcctccaggccgagtttggtgagttttctttgtgttagcatgagtgcccatgtctgagaaatgtggcactgggaaatcaatgcctgcgacaagagctatcacaagggcatgtggagctagggtgtctcagtgccatctccttgttctcagttagctgtgacttaactctgagtgccattttgtttttccctcccttccccttcccactgggtgtgagcgtgggacatatgaaaaccctcttaccattgtggggaactagtgtcctgagggacccagtttgggaaacattgagctaccttgatgttgacagtgagtgtgacatggagaataggaaggggcggtgaagagaagtatgggcaaggagggagtttgtagaccttgcttcctatcagacagatgcccgtgcctggtggagccttctttctaaggaacctaagtcagcgtgcaccagctttaggataagatgtttcagtttggctgtgtgtataaagaaatgggattttaaagttcctcatcattttattgaagcatggttacatctttacctctcattctgagttttctccccaaatccctgcagagagtagggaagaatgttgcctgccagtaatgataaccagtcattgcccagcagtacatcctctgtccagtggctgggcctgcagtggatgcctgtgaattgaactggcacagctggtagactcagttgcttctcagctgttcagcgtggattggtgcagttatttaagcctagccacaggcacagttcctgccagatgctgctgctgctgatagatgtgactgagtggccgtatgcttaccagaagcatttgtccatggcagagacctgtgacttgagaccttccagctggaggccatcagccaggggagctttccgagtgcctggttgagattgtttcagtgttcagagttgttggtggccctcttgttacgctggctgctccaggtcaccagcgtagattctctgccccatactccttcccactcacaaatggtttaatgagcgagcacattaacaaaaaaaatctgtctactgttgggaggaaacgtggtgagatacaggcagggttttcatgtccatccaagctcttgatagaactttgtgaggagaaaatagccccagaatgtcaagaggggactaaactgagaaactgtagaagaaaccaagcagaatgtaattttatttattttcatttgccagagctttaatagtgaaatagtgctttattggggtttgttttctgtgtggctccattcctgtgattttcaagaataagcagaactaatctagggtggtagaaaccagagcatcagtcacttatgggttgggctgcctagaagggacaggagggcatgagggagcttcatggcagggggagagacacactgtatcttgacagagcgatgttttttgtggtgcatgcatttctgttagaccttaattttactcataagatttatgcagtttaccctatgtaaattttaaccttattttgacatccagattttttttttttgagacagccttgctctgtcacccaggctggagtgcagtggcatgatctcagctcactgcaacctccacctcccaggttccagcaattctcccacctcagcctccagagtagctgggactacaggtgcccagctaatttttgtatttttggtagagatgggtttcaccatgttggccaggctggtctcaaactcctgacctcaggtgatctgcccacctcagcctcccaaagtgctgtgattacaggagtgagctaccatgcctggccccactttatagaaaagttggaaaaatagtagcaagtaactctcacccagcttcccctaatgttagcatcttacataaccatagaacagttaccaaaaccacaaaattaacattggtatgatatttttagataatctttagctcttgttagaatttttctatttttctcacatcatttttctaaaaatggctttattgagatataatttgcatgctgtaaagttcattcataatacacaattcagtggtttttagtatgttcacagagttgtgcaagcattaccattgtctaattttagaatattttcattgccaccaatagaaacccccatacctattagcagtgactccatccctggcaatgactaatctgctttctgtcactatggatttgcctattatgaacattttataaaattagtgttgtacagtatgtggctttttgtgtctggcttagtgtgttttcagaattcatctatgttgtatcatgtgtcagtacaccattcatttttatgacctaatatcccattatgtgtatatacgacattttgttcgcccattcatcatttgatggacgttgggttatttccactttttggatgttatgaatcatgctgctagattaacattcctatacaagattttgtgtggtctagccattcttgtagagtagtgtgatagtctgtttttttttttgttgttgtttttttttgctcaggattgcttcagctatttggagtcttttgtacttccattatgaatttcaggattgttttttctgttttttttttttttttgtgaagaatgtcattggtattttggcaaggattgcattgattctgtagattgcttttggtagtatggtcatttttacaatatttattgttctagtttatgaacatgggatgtctttccatttgtttgtgtcttcagtttctttcatcggtgttttatagtttttctttttgagatcttttacttcatgtttaaatttggttaaatttattcctaaatattttttgtagctattgtaaatgggattgcctcactgatttatttttgagattgtgttattggtgtatagaaatgctgctgaattttgcatgttgatttttgtgttcagcaactttctttattgaattcatttattttaacaatttttggtggaccttttagagttttctgtgtatacaataatgttgtctgtaaacagggacaatttgacttcctcttttccaatttggatgccctttatttatttttttcttgcctaattgctctagctgggacttacagtactatcttgaataggagtggtgatggtgggaatctttgtcttattccagatcttagaagaaaagctttcagcttttccctgttcattatgatgttggctatgggtttgtcatatatggcctctattgtgttgcttctgtacctaagttattaagagtttttgtcataaagcgatgccagatggtattaaatgctttttctttatctgttgagatgaccatatggtttttgcacttaattctattaatatgttgtataatatctgttgatttgcatgtggtgaaccatgcttgcatctctggcataaatcttttttgatcatggtgaatgatctgtgtaatatgctgctgtatttggtttgctagtgttttgttgagaatttttgcatccgtgtttatcatggatgttggcctgttgtttttgttgttgtgtccttatctggttttggtatcaaggtaatgttggccttatagcataagtttggaagaagtccttcctcctcaattttctggaagagtttgagaagaattggtatcagttctttaaatgcatggtagaattctacagtgaagccatcccattctgggcttttctttaacagattgaatcttgttacttgtaactggtctcttcaggtttctgtgtcttctttgttcttcttggtcggttgtatgtgtctgggaagttatccatttcccctaggttttctaatttgttggaatagagttctttttaatagcctctcatgatcctttctatttatgtaatatcagttgttatgtctcctttttcatttctgattttattgatttgggtcttttctctttttcttggttcctctagctaatggtttttgatttttgtttaacttttcaaaaaaccaactttttgttttgttgatattttgtattgctttttactcttaattttgttttgtttttgagacatggtcttgttgtcactcaggctggagtgcagcggtacaatcactgcttacagcagccttgacctgctggggccaagcaatcctcccaccttagcctcctgagtagcttgcattataggcacacgctgccacacctgacaagtgggtgtttttgtttgtttggtagagacggggtctcgctttgttacccgggctcgtcttgaatacctgggctcaggtgagtctcccatcaccgctttccagagtgctgtgattacaggcatgagccatcacatctggccttaattttatttatttcttctctgatctttattatttctttccctgtactagtttggggtttggtttgttcttgcttttgtatttccttgaaatacattattagcttatttatttaaaatctttccacttttctgatgtagacatttattgctctaaatttccctcttagcactgcttttgctatatcctattggttttgatatattgtgttttgattttcatttgtttcaattaattttaaaattttcctcttgattttgttgttgactcattgattgttcaggagcaggttgtttaattcacacatacttgcccaattttgaaagttccttattgttgatttctagttttattccactgtggtcaaaaaagatacttgctataattttaattattttagatttgttgagacttgttttgtgtcctaacatggtccaccctggaaaaggttttgtgtgctgataagaagaaagtgtattctgtagctgttggatgaaatgttctgtaaacatctgttaggtccatttggtctaatgtgtggttaaagccaaagtttccttgttaattttatgtctaggtgatctgttccatgttgagagtggggtgtttaaatttttaactattatcatattggagtctatctctccctttagatctaataacatttgctttatatatctgggtgctgtagtgttgggtgcatatatgttcagaattgttatatcctcttgctgaattgatctttttaacattatataatgaccttctttatagtttttgacataaaatctattttaactgatataaataaagctacccctgcttgcttttggtgttcatttgtgtggaatatcttttctttatccctttgctttcagtctatatgtgtctttacaaatgacatgagttacatgtaggcaatatgtagtttgcttttcactggggtctgttactagagagttaatattttttcaaattaattcagctagtctatgtcttttaagtgggggaatctaatctgtttacatttaattttattagtgataggtaaggacttactcctgtcattttgttgttttgcagttgttttgtatagtctttgtttccttcttcctatcttgttttttatcattgaggtttagtgaggttttttaatgataaggcttgattcttttctctttctcccttgtgtatctgctgtaccagtatgttttatacttttgtgggtttttaagagagtgtttatcatcttttcacttccagatgtaggatttccttgagcatttcttgtaaggccagtctagtagtgacgaattcctttaagtttttgcttgtctgggaaagacgttatgtctccctcatttctgaaggataactttgctgggtataataatcttggctgccaattttattctgccatcattttgaatattacatcacattttcttctgggctgtaaggtttttgtggagaattttatgctagtctaatgaagattcctttgtatgtgacttgatgcttttatcttgctgcttttataattttatctttgtgtttgatttttgacaatttggctacagtgtgcctggggaataattttttttggttgaatctatttaaggacctttaaacttcctggacctggatgtccatatgtcttcccagacttttgaagtttttggctattatttaagtaggatttctatacctcttcccttatctctcttctccttctataattctcattatatgaaattcatttgcttaatagtgtcccataagtcttgcagactttcttcactctttttcattcttatttctttctttctcccctctgagtgggcagtttcaaatgacctgtcttcatattcagagattctttcttctgcttgatcaagtctgctgttgaagctctctattgtattttaaatgtaattcattgaattcttcagcttcaggatttgtttagttctttcttatgatttctgactttttgttgaatttcttgtttggatcatgaattccagattttgttgaattgtctatatgtattttcttgtgtctcattgagtttccttaagatcatttggaatttttctttttggcagttcactgattttctctttgatggggtcttctattcctagaaagttattatgttcctttggtggtgtcctatttccttgctttttgatgtttcttgtgtccctgcattgatgtctgtacatatggtggaataattgccttttccagattttctagcatggcttttgtagagagagacttttacctgaaattgggttttagtgtgccatttaggaaaggtgtagtgactgttgctggttaggtgcagtggtatagtctccatgaacctttttcagctgtgttcagtgttagcctcagtggcccaggctatagaagtttgttacagtggtggtgacagtgtaagttgttaatgtccttggtatcaagggcttttggggtcctcctggtctcattttccttgcaatggggagacttagctgaggggaattcctttgatgtctgctctgacatggcctacaagcagctgccatggtgctgggttccaggtgtaggtgcttgtaatggttgcagggctgggttgcgacccctattgtggcatgtgggtcttggggtacaggtttgctctcttatggcagggttggatttaggtggccctcagagccaggatctgtgactctgaggcaccctctagcagctcgggcccagggggccaggttgtaactgtgattctaccccagggggtggggcagggtacagcactggcggaactctgaggaagaaggggtgctctgggggcttgggcctggggagccagggtatggctgcagttccggaaccggagccaacagggctcagtggcagctccggtcccaggggatgtgacactgtgtaataatgactcaagaccctgggatggtggggcttgtaagtatcccagactctgtgaggccatgtgtggcaggagaacgtaccccagaatgacagagcacacctgtcactggggccctgaggagggtgggaagcagcgtatccatgactccactctgcagggagagaggtgtctcagcagctcagactggggtggggggctagttcagctctagggaagcaggcagttgagttgtttggcctgtaaggtgggatgtctgggctcagctactgctctgtttctctgggatgtagggcactgcatcagctcagccctgggatgtgcagctgctcagctcagccagggcactgattccccttgcggtggtgtgtcgcttccactcaggcctgagggacgggactgtcctgggtggcccaggcatttccctggatgcagagtgcttcttcaacttgggttccaggaggcatgactgctctgagcagccaaggtattgttttccctggaggccgtttatggctttagctccagcctgagggggcaagagcgggtagtggagtggccccacctttgcttggccccacagaggaggtgtaacagctgcctgcagcttggctgggggatgtggggccactgggctggggtggttgggcagcggcttagcttcaggggtgaaggggagctggggctgctaccccaggaacaagatacactccagcagtagttccagttccaagagggcaccgtgagggccacgggggcaggcacagtgtcgattccttctccggcgggagcacagtggtgtggcctccaggcagctcactccaccctgggcttcgtgcctgtgaggactgcaagggaccccaagggtgagggcggtgggtgtccacggtgttggtgggggctgctggggtcctcttgattacctcctcactgaagggaggtgttttcctgggttctagctgaccctggttaggggatggggtgccaggggcccggcatttccttctgttctttttgtgactatcatgaatttctgggctcgccagggtttctgttactcctctaatgcactttagcactctccctcagttgtttttgttaacatgtagttgtgtattcattgttctggctgtctctgtgagggggttgaatgctaggcacttctagctggctatcttgataatgttacccagaatgggtagtttctgtcgtcctatcttccaatttactgattttttttttttttttttgcctctgtcccctccattctgtcttcaccaagattttaatttcagttattttattttttctgttttaatttttccattttggttttctttatatgttgtttttttctcattggtttctagcacagttgctcactaaagaaattttttgatggccgatttaaaaccaccataaatcatatcagataatttgaacatctgtgtcatctttctgctgatgtcaggcaattttctttttcatttaagttgcctcatgtgtctttaaacccaaagttcagccatgactatcgtaaatgttctcagtctcaagtaatgaggcttttcatgattagacctgagctctgtgttattcttctacctatgttgtgagcagagttttggtgcgttatcagccattcacattcttttcgtctgtgttcccctcaaaggctgtcaccctgctgtagtgttttccttatgatgacgtcctcatgaagttgttccatgttttccttaggatgatgtcctcatgaggttgttccatttgggttgtgcccttgacagcatttgtctcatggataaagtggcctgttttattttaccctttcagggggctcacatagctatctcttcagcttgactagtgatgcaatttgtccagaaatttccttatcatttgtgtcccttgtatcccatcagccttagccacataaaataaatcctttccattcatttagcaaatatttactgagcccttactgtaaggtggtgaacaacacagccaatgttctgctttcatgaagctttcagactaaggaagaacacttattcctatttcatagaataactattattgagagaactaaaataggttaatgggcttgacaatgagtgggcgataagggatggcctctgtgaggagagaatatgtaagctgaaatgtgattcttttctggaatttccatttctgtttatattatacatctgttctttcatatttctactttgccattagaatttgttatatattgaattgtgttctccccctccccaccccccatttatatgttgaggttctaaccctcagtctctcagaatgttaatgtatttagagatagggacttttcattagagtaaaattgggccattagggtggaccctagtccagtgagactggtgtctttataagaagagaagatgaagatacatggagaaaccccaggggcctgtgtgcacagagggatgaccacatgaagaggcagcaagagggtggcgtctgcaagccaaggagggaggtctcagaggaaagcaggcctgctgagaacttgatctcagacttccagcctctagagactgtgagaaaataaattcatgttgttaagccacccagtttgtggtattttgttatggcaggctgggcaaactaatacaaagccattagcatattaatcatagatattctgaattccctatctgatacttctaaaatctgtcatctgtgcagctggttctgatgcttggtttgtctcgtcagactgtgatttttctttccttttagaatgccttgcaatttttggttgaaagctggacatgatttattgtgtaatggggactgaggaaaataggcctttagcgtgaggtgttttggtaatctggctaggagttgggctgtgtttactgtaggggacagaggctttatactcttctagcatccttgtttattctcccctcttccctttgggtttccctaagaattcctccttagatggaattgatgtctttcagctctctcagctataataccgttttaaaaatccctgttgcgtgttatgctctctcatctctgttggtatgatttaaggtgtgtgtggagaggagaagtatttatcatctcaatcttttagtgggcctgtgtctctgggctttggtcttcaaaagtgtttcttaaccccctcccctgcttaggtaagtcagggatggcagagaggcctggagtgggagaaaagcccttccctttaggtgagataaggctctggtgaggtctttccctggaaacagggtgtattcataatggctactcttcctgtccccctgccagagccacgagggagctttcttcgcactttgagaacctcatggggttcctagagacaaaatccacaaaaatatggggcccccctaagactgcgacccccaggagttcctgattctcatggttgtccaccctcagcttccaacaatttgtcatttaaatgttcccaccggtatggctacagcagcttttcctccagggaagcagatcttgttgtgactctccagatttcatggtggccttaattctttgatgggtccaagaaaagtcattgatttgtttgttctgcttttcttagtgaaggatggaagtgctgatttctaagctctttgcattgttgacaaaaagtgtcaaactctgtaaaatatttgaagggatttattctgagctaattatgagtgaccataatgagggcctgtgacacggccctcaggaagtcctgagaacattcagctcaaggtggttgaggtacagcttggtttaatgtattttaggaaggcatgagacatcaatcaaatatgtttaagaattacgttggtttagtttagaaaggtggacaacccaaagcaggggctttcaagtgataggtaaatttaaacattttctgggtgacaactggttgaggttgtctgaagacctaggatcaatggaaaggaatgttcaggttaaagataaaggattgcggagaccaagttttattgtgcagaggaagcccgtagatagcagacttcagagagagcaggttgtaaattgttttttatcagacctaaaagggtgcctggctcttaattgattatctcctggatctgcaaagaaaggaaggaaaataaaagaggaaggggattctctgtagaatgtggatttttcccacaaaagactttgcagggcaatttcagggcatggcaaggaaatatattttggagttaaatattttgtccttgtctcataatgttatgccagagtcagattgaaaagtaagtcacaatatatagggtcaaatacaactcatctgatgagaatccatggtttgtagggcatgactccccagaccccttaggtaggaatttgggcaagatttaaaaaatcggagcttagttctcagcatgttggagctggaattgctctactgagtgagatttgaaaggagcaagacatgtgaagattggggcaggaacattctggttaagaaaatgcagagcaggctggcgctcctggggcatggtgcagatggatgagtgatacgaggggaacgccgggaagcaggagggcttgatctggcggggcttcatcagccagaacgaggacttgggtctccatcatgagtgcagtgaggatctgtgggagagcagggaaggtgtgtattctgatttctgtttaaaaagtttaaaatacaaaaattagctgggcatggtggcatgtgcctgtagtctcagctactcgggaggctgaggcaggagaatcacttgaacctgggaggcggaggttgcggtgagctgagatcatgccactgcactccagcgtgggcaagagaaccagactctgtctcagacaaagaaagaaacaaacaaacaaacagtttaattctagctgcagcatggcagatggataggggtaggaagaggcaagaatgcaaaattaaataagcaagccaccaagaaggctattacagtagtctgggggaagcaggatagcttagactagggtggtggttatgggcttagggcgtgttgggaggtagagttgataagatgtgatgtgagagaagagacgaatcaataacaatacctgccatctttgggtgggtaaatggtaatgctgtttactgagaatacctgcatctttgggtgggtaaatggtaacgttgtttactgagatggggaagatgaggcaggagcacagagaatcaggagttgggtgttggccttgtgaaacctgagttggcagtaaattcccaaggggagttgtccaggcaagtttttgtggctatgaagtctggaattccagggaaaggctggggttggagaaatggatttagagtcactggtagatacatgggatttgaagtcatggagtagacgaagtcacctaaggagagtagaaagagaaggaagcctaggacagagccctgggctagcatctaaaggagaagtataaggagggactggtgaaggagtgctatggaagccaagaaaagccagaggagtcaagtgagacgaaagctgagcagtgacaacatggaggacattggtgaccttgagagaagctgtctcagcagtgagcagatggtagcgtgactgaagggtgaaggtgaggtggggcggtagcaacaacagaccactcttgtaatattcctgggaagggagtcaagaactgggcagaactggaggccagtttggggtcaaggaagattttttttttttttttgccttcttgttctttgaagcttgtaagaatgggcttatgttgctgctcgatgactccatgttcctaggtgctcaaggagcctggggcattgcctaagatgtggctgacatggtccagaatccatatgtgctttggaggtggccaggaagcccataggaggagggaatgctcagtgtgtgccctgagagctttgccactgtcagaaagcacctgacaggaacaagtttgattgtatttgacacatgccggcactaccacagaaagttttagcaacagataagaggggacatctgtactctcaacttcttttttcatacttcctattgaagttttcatctctactctcaggcatttaatttctaagactgctgtttatttttaattgtcttaaaaaatagcatcccattcttgtttaacagatgatatagcttcttttacctccttgaggaagatattaataatagttttttaaaacttttcttctcactgcacaatctcttttctttgtcctccttttgttcctgtttaaaatgatagccatttatctttttctcaggtgtctggtgatgtgtggttgtctggtcatgtttaacagtgggatttataatgccgattggaagctgtgagcatatgggtggagcttctgaacttttctgcagtgtgagctggtgcatcaattaattgggaacccataggtcagtatcttcgactgtgttgtcttgggttgttcagattgtctggagaagactcacccacccttatttctggagggatgaaggcctataaactccggaaacaaagtagagatagagggaatgtcttagagcttgtaggtatgtgtttatctaatccacatgttttccagacagaacctccatcctcaattgtgcctgatgtttcacctccagagattctttagaaaataaatgtccaggccaggtggggtggttcacacctctaatcccagcactttgggaggctgaggtgggcggatcacctgaggtcaggagttcgaaaccagactggccaacatgatgaaaccccgtctctactaaaaatataaaaattagctgggtgtggtggcaggtgcctgtgatcccagctactcaggatgctgaggcaggacaatcacttgaactgggaggcggaggttgcggtgagctgagattacgtcactacactccagcctgggtgacagagtgagactctgtctcacaaaaaaaaagaaaagaaaagaaatgtccagtctctactagggaagggcatttttccagaggcagggaataggggagagggtccagggatctaatttcttattattatttttatttttttttagttttgagatgcagtcttaactctgtcgcccaggttggagtgcaatggcgtgatttcagctcactgcaacctctgcctctggggttcaagtgattctcctgcctcagcctcccaggtagctgggattacaggtgcctgccatgacacctggctaatttttgtatttttagtagagacagggtttcaccatgtttttcaggctggtctcgaactcctgaccttaggtgatccacctaccttggcctcacaaagtgctgggattacaggcgtgagccaccaagcctggccttcttcttatttttaatataaagccagatttgttgagttataatttacatagaacaaaattcacttgttagtagacaattgtatgagttgtgacataaaactatctcagcatataactcatatgctgagttatgtggtaagtatgtgtttaaatgtataggaaattgccaaattgttgtctcaggtggttgtaccattttatttattttattttattttattttattttattttattattttattttattttattttattttattttattttattttattttattattttattttattttattttattttatttattttatttatttttgagacagagtctcgctctattgcccaggctggagtgcagtggcacgatctcggctcactgcaacctccacctcgtgggttcaagtgattctcctgcctcagcctcccaagtagctaggattacaggcgtgcaccaccacacccagctaatttttgtatttttagtagagatggggtttcaccatggaggccaggctggtctcaagttcctgacctcaggtgatctgcctgcctcagcctcccaaagtgttgggattacaggcgtaagccactgcgcctggcctggcagtaccattttaaattttcaccactaatctatgaacattccagttgttcctcattcttgtcaacacttggtattttcagatttttattttttaattttagccattctaataggtatggatttaatttccatttttctaatagccatgatgctgagcatctttttgtgtgcttgccatttgtgtatctcctttggtgaagtgtcttttcaaacactttccctatttttattgggctgttgtgttactgagttttcagagatgtatgtgtattctggatttaggtcctttatcagatacgtgttttgcaaatgttttgtcctcatctagtggcttgtcttttcattgtgactgtcttttgaagagcagatttttaaaattttggtgtggctaataaattatttagttgtatggattatgcttttggttttgtgtctaggaaattgttacctaattcaaggtcacaaagatttttctcctgttttcttccagaagttttaaaatttggggttttacatttaggtatgttattaatttttgtataatttttgtatgttaggcaaggtatagattgaagttctttgtttttgcatatggatgttcaatttttccagcaccatttgttgtaaaggttattctttcttgattgaattgaatgtatacctttgttgagagttcacaaagctgtggtctgtttttggatcctctaattttatttcacttatctctttgtctgtcgctctgtcacttgaccagtaccacactctttatggccataaatgttgaaatctagtactgcaattccccaacatttctctttctctaaattgttttgtctggtctagttcctttgtttttccaaataaatttgagaattacttgttgatttctgctaaaatttcaacttggattttggttggcattgcattgattatatagatgaatttgaggagatttgacattttaacaatattgagtcttctagtccataaatatggcatattctctccatctatatgtctgtggatccttatatctgtgttttgttgttttcagcatagaaatcttgcacatagtttcatgagatttatacttaagtgtttcatgttttggtgctattatataatatatggtaatttttaaaaaacattagatttttaattttttgttataagtatgtggatacaattgacctttgtatgttgaatttgtattctgtgactttgctaaactcaattagttctaataactttttttctagtttctttgggattttctgtatagacaatcatatcatctgcaaatagagacagtttcatttctgcctttctaatcaataaaccttttatttctttttcttgccttactgcacaggctaggatctctagtatgattttgaataggggtgataggatattcttgccttgtacgtcatcttaggaaagaagcattcagtcttctatcattaagtatgatgttagctgtgtgttttttgtagatgcccctaatctggttcaggatgttcctttttattcctgttttgttgagggtttattattattattactgttatgaacagatgttgaattttgtcaaaaggcttttctgcatttattgaagagataattttttttttcttctttagtctgttgttacggtaggtgatgttgactgatttgcaaataatgagccagccttccattcctagaataagtgtctattggctgtgaagtattatcctttttatatattgctgaatgcaatttgctatttttttgtttaggattttcgtgtctttgtttatgagggatattggtctgttcttttattttaacatctttatctagttttggtgtcagtgtaattctggcctcataaaaaaaagttgacttatttcctccttttctgttttctggaagacttgtttaaaatttctattatttctgttctaattttttgatagaatttgacaatgaagctctctgaaatgttatacattgcatgactgtttacctttaaataataatccgctgcttcaggtatagtgtaagtaccttaaaacagtgttttcccatctattgatcatatttatttcagattctttttctgaaattcctgtattattattccaggttatctgtgtgtctgcttctgttgattgtcacttgacaatgagccttttgtttcctttgccttcttttgtttgtttgtttgtttgtttgtttgtttgtttttgagacagagtctcactttgttgcccaggctggagtgcagtggcgcaatctcagctcactgcaacctctgcttcctgggttcaagggattctcctgcctcagcctcctgagtacctgggattacaggcgtgcgccaccacacccagctaattgttatatttttagtagagatggggtttcactatgttggccaggctgttctcaaactcctgacctcgtgatccgcccgccttggcctcccaaagtgctgggattacaggtgtgagccactgcgcctggcctccattgcctcttcattgtaatttttgatttcagtgttggacattgtgtggagggcagtaggcaaggtcaaaaaactttttctgtaatgggccaaataaatattttgagttttgagagccacgtgtagtccctgttgcatgttattcttctggtttttacttttaaaaaattacccttaaaaaatgtaaaacctggcaggctgcaatggttcatgcctctaattctggccctttgggagactgaggtggaaggattgcttgagcccaggggtttgataccagcctgggcagtgtggtgagacaccgtctctacaaaaaaatgtgaaaaattaactgggcgtggccacatgttctgtggtccctctttcttgggaggccgaggtgggaggatggcttgagcccaggagattgagactgcagtgagccatgattgtaccagagtactccagcctgggagacagagcaagaccctgtctccaaaaggaggaggaggaggggggggggaggaggaggtggtggaggaggagaggagggggggggaggaggaggaggaggaggaggaaagaagaagaagaagaagaaaaaaaaagtaaaaccattcttagcttgcaggctgtacagaaacgggtcatgggctacctttggcctctgggccatgcgtaccctctctgtagaggggaatgaggtgggtagatagtgttatattcaggaatggccactcctctttttccgctgggttttcattgttggggagttaaggtgggtctgggttttgttgttgtgtatgtaccttccatcccactggcttcaaattcctctaacctttccttgagcttaggatgagggctgagttgccaaagcgtcttcacccatggcttttggccttgcctctgtgtctgccttagctgccccttatctttggcaggtctctactagagaaagttcccctcccttcccccaaagtaggaggactctaacaggctggcttaagatggctcctggaccctccctgagggctagagcagattgccttttatcttccctggccacagcagtcttctgattctgtaggtgagaagcttcttgttagggcttagtgctgtggcagctcccactgagagactgttcagtctgctctttcagtctacatcttaaaaggtttttttttaatttttttatttgttaagtaaatgtgctaagaaagaggtgctgattttgagcctggttccagttgcagtacccagtcaaggagtgaatttacggcatcgtaaaggctgccagtagagaggaatggtaaggaaagttggctccactctggtgatggattgaagcttccagtgggtttgtctagctattttttagtggttgctacaatgtatgcaaggctaccagattctataagtcctggggccattcccatggaaaataaacaacgtgaattttatatacccagtgacattgtgtaaactcagtggccctgataagtgctgtatctgtatgtggtccctgagggatttgctgcaattggagtgaaaaagaagtaatactttttaaaacaatcttataagtggacagaatgctactgtcgacaaagagtcaaactctgcaaaatatttgaagagatttgttctgagccaaatatgagtgaggtcctgagaacatgtgcccaaggtagttgggtgcggcttggctttatacattttagagaggtgtgagacatcaatcaaaaacatttaagaaatacattggtttggtccagaaaagtgggacaaagctggggggcgtggggcttccaggctataggtgaatttaaacattttctgattgataaagacctgggattgatagaaagggaatgttcaggttaaggtaaagattgtggacatccaagttcttttgaagtcttatggtggctgccttagagacaatagatgacagatgtttcctattcagatcttagttaatctctttaggattaggagggtctcgaagaaaaagatctagctatgttagtagagattctttacaaatgcagattttcccccacaaagaacagctttgcagggccatttcaaaatatggcaaagaaacatattttggggtaaagtatttttattttctttcttgtctcataatgttatgccagagtcaggttggaaagtcatgatatatagggttaaataaaacccatctgatgagaatttgtgatttgtaggacatgactccccagaccccttagataggaatttgggcaagataaaaaaaatcagagtttagtcctcactagcaaacagagaaagccctcatctttctagtttaacactttaaaattgtatgactgtaatatttgaagatgatggttattagactattgagttttttgatgctgcttttatgagctaagcttttatatcaagcagtgactgtgtttctgggttatcctgtagttttctaaactgtcaaacgtgttattcagaaaggccaggaaccccttgaggggtagattgcagtagaacattttattctaggccaggcgcggtggctcacgcctgtaatcccagcactttgggaggccaaggtgggtggatcacttgaggttaggagttcgagaccaacctgaccaatatgatgaaactccatctctactaaaaatacaaaaaattagcgaggcatggtggcacacacctgttatctcagttacttgggaaactcctgcctcagttacagaggaaagctgaggcaggagagtctcttgagcctgggaggcggaggttgcagtgagcagagatcatgccaccgcactccagcctgggtgacagagcgagactctgtctcaaaaaaataaaacaaaaagaaaaaagaaaattttattctaaccagaagcattacctcttttccctagatccagatgcagaggtgtgccttcatgtactgaggcttgtccagtctgtggttctggaacctgaagtcttctccaagtcggcctctgagttccggagctccctgcccctgcaacgcatcctggcaatgtccaagagccgcaacccccgcctgcaaaccgcagcccaggagctcctggaagatctccgcactctggagcataatgtgtaggtgtgctcggccaccagggttttggtgaaaatgccggtgtcccttctccccagatccctcatttgatactccaaaaccatcaccatgtaccatgtgttagagttggcaaaatgtgattgactagagatggacatgaattgatatgtatcccacataactttgtcttggaagtgagagtgcttgtaggtggttggttaagcttgccaaaggagaggccatgaaagaacctgtccttctggaaaagtggtccatgtctgtgctggctggaagagggcttgcttagggcagcttcttgctgctcagcagaccatgacctgtaggttcacctataaaacagggaaattgaataaccatctaccccattagtcagcattttcttgagatacatttctttgaaaagcaattcattctctctctagtaattgtaattaatccccccaaaatgcaagtttacttttataaccttttggtgaacctgctatttcggatgacattgggcattttagttctatattttttgtgcctcttttatttttgaataaagaaaatcagaagagttgtattacgacccttgctgtctaaaatctaaacttgatattaggaagttagatttctgcatattaccatgctactcttggttggtggaaaaaaaactcttccttaaactgttctgggccctttggctataaacttagaagtcctatttttcttataacaaatgctgtaaaaacaacttgtataatagattagaacacatgcagttagttgagattccataaatgaaatgatagttccagctccctttttgtgcatgggtgtgcctgtatgccagggccctgccatgtctgtgttatctacctactggttgccatccagcttgttttctaggccactggcagagagcaagggagaatacacttcatttctcatggacaccatgattggtgagagttgccttttgtattagtctgctttcacactgctgtaaagaaatgcctgggacttggtaatttatagaggaaagaggtttaattgactcacagttcactgtggctggggaggtctcaggaaacttacaatcatggttgaaggggaagcaaggcaccttcttctcaaggtggcaggaaggagaatgaatgcaggagaacctaccaaatatttataaaaccatcagctctcttgagaactcactatcacgagaacagcatgggggaaaccgcccccataatccagtcacctccacctggtctctcccttgacacatgggaattatggggattataattcaggatgcgatatgggtggggacgcaaagcgtaaccatgtcaccatttaaatcaatccttaaagtcacgtcacgtgaacacattcccttcttttcctgggctgcttccttcggtgtgatgctggagggctgctgggctctgggcatgctgtaagagcaaaacaaatgcaggtgcaccccaccagtggcagccccatctacaagaataagctgttttgttgcatatggcattttagagtaacttcatttttcttttaagtacatttttataggcagtgtgcaatttaaggctgaggctgagtgaagaagtgtagaggaaggcacagttgcttggatttcacgagccagcatattgtggaacactagctcatctgagccagaggaatgttgcaaaaggcaatttaaaattcatggaggcagaaatcgatccatctgtgctgtgtggttctgtaggtcctgattattggtgaataaaattaagaatgttgtgtttctatacttaatagcatggtgctatcttctttttgattgctatttatttaataaggtaatggggaatgctgcctctagaactacaggacctctttctgccagagatggggtcaacagtgtatagagaggagtgagcgttggccagactcttggatgttgtgtagtttagctaattagtggatggatgtgtttaagaaggatcatttcttttctcctgattttgaggtgctaagaatagcaagagttcttacgaaaactcttttaggaagaaacatgtgacaactccatattttgaatgtatatcctaggaaaagtacataaggccagttttaaggagtgatctgcctcctgctcttcatatgaaggtcaacaggaaaacacaggttctttaatttttctacaactagttatctaaagaaaacctactcagttttttaaaaggtattcataaaaagcatgtactttgcagatctcgtgaattttaaaatcagacaaagtaaaatagtgcatatattttgaaatgtttgtttgtttgtttgtttaaatggagtttcgcttttgttgcccaggctggaagcgcagtggtgcgatcttggctcactgcaacctccgcctcctgggttcaagcaattctcctgccttagcctcctgagtcactggaattacaggcacccgccaccaggcctagttaatttttgttacttttagtagagatggggtttggccatgttggccaagccggtgttgaactcctgatctcaggtgttccacccgcctcggcc

SEQ ID NO: 16965 - DNA, 40586 bp, Human
cagagagagagattcatcaggcgctcctaagagccaagggcgagagactcacagagtaggatgagcaaagggtagtaagggcagttgttggtgctgcctttgtaggttcctggggctctcacccagcactgcttgtcaccaactctgtaacctctgacttctccttagtttgttaacttcacaatctataagtttgggaaaggacaggagaatttatttcttacaaagggttacagcctttaaggtgatgagacgggagagttccctggagccttttgctggacttgtgataggggtgtggcttgcttacctggcaccacgctctaactccttgtgggaggggaagcacgcaggcgagtgggtgcgagggccaggacaagcgcttttggactccagcctcgtggtaccatctaggggtgtgttacaattaattctctttattttattttattatttttttgagacggagtctctcactgtcacccgggctggagggcaatggcgcgatcttggctcactgcaacctccgcctcctgggttcatgcaattctcctgcctcagcctcccaagtagctgggattacaggtgcacaccaccacacccagctaaatttttgtatttttagtagagatggggtttcactatgttggccagactggtcttgaactcctgacctcttgatccgctcaactcagcctcccaaagtgctgggattataggcgtgagccaccgcgcccggccaatgttagctattattaatggacaattatgactaattatgaagtactttcttttaaaagcctagatctctaagtaatgtcttcctccctcagtcctcagcacccgcctggtcgggcattgggtctcaccaagctacagagccctaggtgcgctgtgttaggtcaccaagactttagtctggtgatactgaccccagggccccaaatcaccatggctgcaagtctggaacccaaaggcctccgttccccggggtggtgcagggaagccgcagggagtgcgtcagctgtggagagcgcaggggtgggaagtgaaggctgtggggtcccccagggggtcaggttcgtcctcgaaggcaggccctccacaggaagacctggttggggtgggatcggacacgcggcccagacccaggcacctgtggatggacggccgggcatgtggccatcggctgggggcctctgcaggccgcgccaccagagtgggcactcagggtccgcaagggtctggggcgccccgagagaagcccgccgccccaggccggtgcggagttgactgggtccccccggccccgtgtctgtcagctcccgcgcggcccctgggaagggacgcggatcggatgcgggctccgggccctgcaggcagttgagagcgcggttcccttgggtatccggggtccggggtcactttcgcgcctccgcactattcccacgcccgcgcgcactctcgtggccatccgcgttgcgagagtgtcgcgcccggaggtcaggggcgtggagcccgggcccccgagtctcccctgcgtgcgcgcggggcgcggggcgcggggcgcagggctgaggcggagcacaatggttgaatgaatgaatgaacgaacgaatgaacggcgctgcagagccctctccaggcggaatgaaagtgcaaacccagcgtttcgggcggcagagtggcgggggccacctggcgcggccgcgcggccagggtccggtttcgcttcctcccagcccgggggcggggcctgcgtggctgtccccgccccggtccgcccccggccagcccccggcgccgcgcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggtacgcatccgcccgcagcccgggcttacgtaacccgagcccgtgaccttggcggggctgcccgagacgagcctcagttccccgagggaggctcgggagctgcgggcagagcctggcgcgggcgccctggaggcaggcgcgggatgagcctcccgctctgcttggcttgcgggggcggaagcggagggctgagcgctctgcgggcccctgcgggtgggacgggtccggcgtcggggtacgcgggtaggagggagccctgtgcaccagctatggcgcagccgctcgtcctcgccccttcccgccgaccgggccaactgccgcgggggcgggcgggcggtgcggctcccggaggcgaggaaatgtcgcagagccccgaggagtcccggagcagtcacgcgagccgggaccttgccccgctggaacgcagaagcggccgtggagctcgagacgctcgcgcgctcacctcctgggcccctgtgcgtggggaagtcaggaagaagacgccgagtgaggtcacggtgcccacgagggtggattcccctcggcctgaccacgccaggaggtggccgaagggaagagggtggggcaggggctgctctgcaccctctagcagagcggcatccctgcaggtgtttgctctgacgaggagaagccccagagagcagttcgggactgtgcggattggctttagggagccagcttttaaaacgcgttggcccacggcctcctggttgcagctaagtggcccgtggaggggtaggagaggcctgggtgcagtggcgtgggtgtcacgcagggccgaggcagaaccaggacgacgggcacttcctggccttgtcgagtcagcaggagggctgggggtgccctgccgggtcgtgctctcctgtgctgcccacctgcggcctggtcactggggacgggagcaggtatgcctggtccctgtgctgggccccacgggatgtaaagaagggccacctgggcacggcggggcctgcggtgcgggctggcctgggaggaggacaggaagaggggagcagagcttcagtggaatttgagggctgacctaggcgtgcccccaggaggaccaagctgagcagagttgagcgtggaaaggcagggggttcgagtccgaagtaagtggaggtcctgttgggaaggatgcggtgcttcacaggtggtcttacttgagaccctgttccatccagctgcaggcagaccctgcctgggacagtcagggtgcaccggttctgtggctccggctcttaagcactgctctggaccactcctagcttgagggggttgggggaggtcaccacaggctggcggattgcttgggcagagtcagaggtaggattgggcttgggaagaaaggtgcagggtgcctgaagcaggggcagccaggcagtgtggaaccagggggctctgaggacagcgtccactctcttggcagaagtgtgcaggtcctgctgtgtctgtcccgtccctcctcccatccacctcctacttcattgggcaaactgtttccttctttggctcactcgggatcccccagcaatgtcctttgttctcgaactcccagtgactcgaggggtgtcctctgattgctcacctcaggtggagcctcgaaaggatggcgctgctgttcctacctcgggtctccccagtgcacggcatccttacctgtgggctccacagggttccatgcaggcattttgctcccataccccgatgtccaagcccggctggacaaggagaagcaatgtgatgaccgaggggctgagatggctggagacccagcgagcctggaccagccttagtgggcacaggagggaatgggggacagagcctggaagtggccttggggccagtgtttgccgcttctagctgcagttccaaggggacgtgtccccaaagtctagagctgctcttgcaagagtttgttcttgattttgatcatcacatgtggcttaggactccaaagccttgttcacatagctgaatgtgaggaaagaaaacttagaaactggcagaacatagcctctggctgggccccagagatttgcctcaaggctacttggaatgagactggagaatgcctcaggggtgtggcatgtagcagggcggctggagaggcgccttatggggactgacccaggtgtctgggggtcccacctcaaagcaggtgtctccacatcttggaattccagctgagggacctggccctggtttctgagccttccggagtctcacctgcaaactaggcacaatacctgtttgcaagatagcaccagggctccttgtgcccttcatgccaggctcagggtacacctattgccagggagctcccactgattccttgtgagtgtagcacagatttgttgcgactggaccatctgcacgtctgggcttcagagctgttctccccagctgttttctgccaggtcctgtcagaggcagccaccctccctgggcagagcaaaaccttgagcctgtgtttggattttgtttctgggcctaagcctaaggtacatattagtggtggggaactaaaggagggaacatgttggcatgaccagtactggcaggaggtgcagtgtgtcaggcagcatgattggggtttgcagatagaacgcagagggcaagggcaggcttgaggtttgggggtgcatggaggagaggagctggggggctgcccaagtcaagcacagacctgcccaagacaggccatgggatgcaccctggggtggggcacttccccgctgctctggcttggattctagacaggaaggagtggagggaactagtggctgcggccatctgcccttccacattgctaggactgtttcctcttgggtgtaggaaacctcaggttcttccagggctgggaggtttggctctttggagccccaggtgtgtatgtgtggaaagccttcctggctatcagttcagcagctcacatgtttctgtaggcctcactgcatgggggagatcctggggccctcagggcagcctcccaaccccttttgctctattgcttccgtaaccctaaggtacacagctgtagggttatgtatgagtttgctggattgaaaataccatatgcagccttagggtcatgtaggagtttgcccggactgccaaaacaaagtaccacaaaccaggtggctcattgtagcagaaattcacctctcatagtctgggggccagaagtctgagaccagggtgtgggcagggccatgctccctccatacaagggtccttcccggcctcttccagctctcggtggccccaggcttctggggctcacggccgaatcactccagtctctgtctctgtcctcacgtggcctccgcccagtgtgctctcttaaaagtccacttaacatgggattcaggcccacctggataatctggcatgatctcatcttggaatcttacatctgcaaagatactttttctttctttcttttttttgagacggagtcttgctgtgttgcccaggcagaagtgcagtggcacgatctcggctcactgcaagctctgcctcccgggttcatgccattctcctgccttagcctcctgagtagctgggaccacaggcgcccgccaccacgcctggctaatttttttgtatttttagtagagacggggtttcaccatgttagccaggatggtctcaatctcctgacctcgtgatccgcccacctcggcctcccaaagtactgggattacaggcatggggccaccacgcctggccttctttttctttttctttcttttttttttttttgagacgagggtctcactctgtcgctcaggctgaagtacaatggagcgatctaggctcactgcaacctcccccttccaggtacaagcaattctcctgcctcagcctcctgagtagctgggattacaagtatgcaccaccacacctgactaatttttctgtatttctgtttagtagagatggggtttcactatgttggccaggctggtcttgagctcctgacctcaggtgatctgcctgcctcggcctcccaaagtgctgggattacaggcgtgagccaccgtgcccggcccaaagatcctttttccaaatagagtccccttcacaggtttcagttaaacatatccttcgagggtccagcattcaatctggaaggagccttcagagaaatttgaaagtggcataaaccaaggggtgaattaaaggcccagaagttgatgacgtcaagacgtcctttttggaagtgaggggagcagcacagctgtgagtctccaaactgggctgtgcagagattgtcccaagcacgtctgaggccagtagctgccctgtggggagaggcaagcctgtcctgtcactgtgcatcccgtccagatggacaggtagtagattcccgctggctgggtgacatccgtgtccttcatctgtcagcctctggagccgccgaggctgggtgccaggcactgccgcctgggacacatgtgacctccgtgctgcaggaccacagtgcaggtgcgctttcacagggccgctcctagggaggaggttgtggacatcagacattccatgattggattccatggctttgagaatctcacttggggccttagctcgagacccatttaaataccacatcgcagagaccagaaggcaagaccatgggactccctgcagcccccaccagaagaccctgtgaggtggctggctccatctggggcctgcaggcagccgcattctttcattctcctggtccgtcggtgcggagcagacctgagacagctgagggggcttggcggaggttgtatttctctgtctaggggcctcaatgccatgcccgttaggcaggtggactgtggctcaagcgccccacaggaagaggcagggggctccctgccctggaaccctggatgtcagcacctgactcctacctgctgtgacattggcaaaagtagctgtggcagaggccgagggtcccacctgcttactgggccccgcttctccggacaggagcagaagctgcagagctttgggacctcagcacttgagcagcatgtggacgcgagcagcgagtaaccccgggctcccagagacgcgtgacggggtccccagggggttgcttgagggccctcaagtcaggagctgatttctatcctcaaatatttaagcatccccaagcccaggtgcggtggctcacacctataatcccagtactttaggaggccgaggtggggggatcacttgagcctgggagtttgagaccaccgtgggcaacatagcaagactccagctctacaagaaaaaaaaaaaaaagctggctatgtgactcacatctgtagtcccacctacttgggaaggtgaagtgggaggatcacctgatcccaggaggtggaggatgcagtgacctgtgatggtgccactgcactccagcctgggtgacagagtgagaccctgtctcaaaaaaaaaaaaaagtaaaaaataaacatgtatggaagtacaatgtatttttaaccagaaagttgacagagaataccgatgcactaggtagaccctgttttaaaaaaaaaaaaatcccctgctctgcaaagtggcctcttcttcagagatgtggcatcactggagggttctcttggggaaatggttaaaacacctggtgttggctgggtgcagtggctcacgcctgtaatcccagcactttgggaggctgaggcaggcggatcacaagatcaggagatcgagaccagtctggctaacacggtaaaaccccgtctctactaaaattacaaaaaattagccaggcgtggtggtgggcgactgtagtctcagctgcttgggaggctgaggcaggagaatggtgtgaacccaggaggcggagcttgcagtgagccgagatcgcgccactgcactccagcacgggcgacagagcgagactctcgtctcaaaacaaaacaaaacacctggtgttttgaaaaatctttacattttttcttagaattcctaggatagaaagagtcttctttgccttcagaactgcactataagatcctggaagaataccaccctgccttttaaaagacatcatttttgccttaacatttttcaaggtgacatgcatttgcaaacagtacaaaaaagccagcgctgggccaggcacggtggctcacgcctataatcccagcactttgggaggctgaggtgggtggatcacctgaggtcaggagttcgagaccagcctggccaacatggtgaagctccatctctactaaaaatacaaaaaattagccgggcgtggtggcacactactgtaatcccagctactcaggagggtgaggaaggagattgcttaaacccaggaagtggaggttgcagtgagccaagattgcaccactgcactccagcccctgcaacagagcaagactcaggctcaaaacaaaaaaaaaagaaaaggaaaggaaaaagagccagtggtgaaaagtgtgcctccttccttcctccggtggcccgcactaacttccttagaggtgatgctgatgctgtatgttggagacgcttctgagtgtcctcggaacgttcccacgtgctctccaggccatgctgggcagctggctttcctcccgtctagctgggattctctctctctctctctctctctctctggcctctgccagtccctgggtctgagccagaatgtgtcccaatccaggaaacaggtgttgtttctggtatttcttctttttctttcatctttctccaagaaggaagaaaattggctagttttttgcttttctgactcccttagtttgggactgaggtttctgttattcttgtttggctgtcatggagaaaaacaagaacttatcggtcccgttttccattttttctttttcttttttttttttttttttttgagacggagtctcactctgtcacccaggctggagtgcagtggcgtgatcttggctcactgcagcctcctcctcctcccaggttcacgccattctcctgcctcagcctcccaggtagctgggactacaggcgcccgccaccacaccaggcaaatttttctgtatttttagtagagacagggtttcaccatgttagccaggatggtctcgatatcctgacctcgggatctgcccgcctcggccttccaaagtgctgggattacggctgagccaccgcgcccggccaatttttgtattttggtagagacggggtttcaccatgttggccaggctggtcttgaactcctgacctcaggcaatccacccacctcagcctcccaaagtgttgggattacaggcatgagccactgcacccagcctattggtcccattttctgatctatttttccctcttgcctctggctctagcccacatcggtgcatgtgtgtgtgtgtatgtgggtgtgcatgtgtgtacgtggtgtgtttgtgtacactgtgtgtgtatgtgggtgtgcatgtgtgtacatggtgtgtgtgtatgtgggtgtgcttgtgtgtacatggcatgcatgtgtgcatgtgggatgcatgtgtatggggcatgtgtgcatggcgtgtgtgcacatgtctgggcatgcatgcgtgtgtcatgggcatgcatgtgtgtgtatgcggtgtgttgctctgcaggccccagtgttggccggcccccccgtctttcctgtaagtgacttccttcctaggaggcttggtgtgactggcattccctggaaagggaggggcggatccgcagaacgggcagcttcggggacacaggggctgctgattggcattgtggcttgttggccttggtgtctgcgggtgcacacccacacagagcttttgaaatggaatcctgcgtgcccagttcacagagtgagtgacgctgaggaataagaacagagggaacttctcaaggagaaaggaagaaaggagttgtcaaagatgggctgagcaaaaaaccgtgcaatcagccgaggaggggccggcagcgcctcccttcctgcccacagagcagccgccttgtgcccatctattccccggctctgcatggggcctctgttttaaagggttctgtggccaagacaagcctgccagcccctgtccctgtccttggccactcctccggcagctttccccattcctgaagcaggtggctagcctgcttagcctcttgtcccatctccttacctgtgacagtcaccaagcctctgggaatgtggtcaccctaggacagctaaacgaggaagctgtgcagtgcacacaggtttggctgaccccaagggccagttgctgtgcatgggagcgagttctaaggggtgggagggagccagcactaggtggagctctgccagccggggcacagggaggaacagcatccaggaggagggtgcagcgggtgtgaggccctgtggagcagactctggagctagaataaggtggcatttttgctgcacgctgtgggggtggacggggcccgaggtcacaccagggagcccatattgggtcaggaatgctgctttggcaatccctggactcagcccccagctgtctggccatctgggcacttctgagccagccatgacctctgccttcccttagcactttgcagtgagcccagcacctggcagcccctgcccagctggtgcacggtccctctgcggcactgtgagcctggaagtagggagctgggtgtccatgtgctctgagcagggctgggggcccaggcgatggaccctggagctgtgaaggctgaggcaggggtgggtcagggatgaggggagactgctctggggggctcggggccatttccaccagaagttccccctgggagtttgtaggacaaaggacatggttgatgtggatcatagggctgaccagtggcaggcggtgggagggacgcggggtgcttgtgccccaggttgatcagggtgaagcagtcacatgatctctcctgtcctctttcctcattctggtttcctaaagtggtcagaggtctctgcaaaataagctaaagggagggttctgctgggtgggtggcttcggcttctgtgcagcgctcaccctgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccccggctccgctgggtgcttggcgcttgtttacggagttacaccttgcggtagaggctgagcaggagcttgtccttcagacttcccagcggagacagccaggctgtcctgtggcagcagtgggtttgtcagaggccgggggctttggccagggccggcagagagccccagtcctgaagaaccctcgttcttcgcgtgctgtcgcgggggctccgtaggcacggttgcagcagggtcttggaggccgaaagaaggacggtctgagctgagagaggggagttggccaggcacaggggtttcagagctttacaggattcagaaggtgcccggggttctgcagcccagtgaggagttcacagagtggtgggcgacccagcagccaggggcatcagccgtgggagtgggacgctccgggagtctgagctgcatcctgtgggcgcagcagacgctcaagggctgggtttagaggggtacgtctggaggtgcgggtggggaatgcacatgaggggagctaggagcagaacagtagcacgggccgagcacgatggctcacgccttgttattgcaccactttgggaggctgaggtgggaggatcgcttgagccccggagttcaagaccagcctgggcaatataggcaatatttctccacaaaaaataaaacataaaaaattaaccaggcatggtgacacatgcctgtagtcccagctactcaggaggctaaggcaggagaatcaattgagcccaggagggagaggttgcagcgagctgagattgtgccgctggactccagcctgggcaacagcatgagatcctgtctcaaaaaaagaaaaccaaaacaaaacaaaaaaaacaaaaaacaaaaaatggtagcacggcggcctaataagaccatcccgagaagggggatgaggtgatagtccacaggcctcagtggaccgtcacagcaggtatggacatcagagagtcttgctcatatctgattgattgattgattgattgattgatttggtttgatttgaatttttttgaggcagagtctctctctgtcacccaggctagttgcagtcttggctcactgcaacctccgcctcccaggttcaagtgattctcctgccttagcctcctgagtagctgggactacaggcacgagccactacacccggccaatttttgtatttttagtagagacggggttttgccatgttgtccaggctggtctcgaactcctgacctcaggtgatcctcccacctcggcctcccaaagtgctgggattacaggcgtgagccactgtgcccagccctcatatctgatttagagtatgtactgccaagctccgtggtgtgaatacttccactatagctgaacgtaaactaccaacctgagcaggaaagagctgtgcagcagcctctgtcatgtagcgttcttccctccagacacaatagacacaaatagctgagtagacaacagatagtgtaaaatgctagtaaactaggaagtggtgaggctacaatatatattatgtttacttttaatatagtttatgtagtctgggtgcagtggctcatacctgtagtcccagcactttgggaggctaagggaggagaattgattgagcttaggagttcaggactagcctggacaacatagtgagactctgtctcaacaaaaaaatataaaaattagccaggtgtggcagcacgcacctgtagtcctagctactcaggaggctgaagagggtggatcccttgatcccaggagttcaaggctgtagtgagctatgattgtgccactgcactccagcctgggtgatagagtgagaccctgtctcaaaaaataataatataatttacataattgtaagttttatgactcaattttttttttaaatagagatggaatcttgctatgttgctcagtctggtcttgaactcctgggcttaagtgatcaatcctccagcctcagcctcccaaagtgctgcgatcacaggtgtgagccactgtgcctggccatatgactcagtttttaataatgactctatgtaaaactgacctgcactattgcatctggcaatcgcgtggcccaatccatcttcaaagccagcaacagtcgttgagtccttcttttaacttccaatctctgatttttccttctgcccttcagcctgagaaaactctgcttttgaagggctcatgtcattcaattaaactctcctggataagaagatcctcatgggagagagatctcatcacactgacaggtttcacccacactcagggggttgcccgagggtgagcggggtccctgaaggtcattcttagaattctgccacggaagagccccataggccattatagggacagggtttactgtaaaacaaggtgattcacatacacagaccagtaatgctgttcctaaaggggcccaagctgatcccatcagtcagcagggctgctcacagggcacctggcctgtctttgttgaaggcgattcctgtgaaggcagtggaggagctccgggtgggaggtgagtgttgtggagagcccagcagcccgctgggctgaaccttggaccaagaaccagtctgtccttggctcccttgtgggtggggaaagatgaggtgtatcaggcagggtccagtccagaaacagaaaccagagcaacaatcgtagaggccgttgttcagccaggtattgagaaaatagagaaggcaaaaagggaacactggtgtcgtggaggagacccctgccagcattggctccacacagctgaccctgggataagagaattgttggactctttagaacctggagctgggaaggcaggtgtctgccagctggcgggtgctgggagtctgtgggggcatgcgatgaggaattctgctggtggagggaaagccacaaagtggattccgctgctgctatgggaagggacggtcactaccgctgcccctgtggggagaagagccccgggggaagaagagcactgctgacagaagcccattctcttcgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggtgtgtgaaacggagatgccagcccaggggctcagcttgctcgtgctctcatttaaaagcagaaaatagcgacttcattctcggatacgtttgccagccccaaaggattaattatctacacacccagaagcagtggagcagaatattttggcaggattttcaggatttgtgtcatcgttgcttaatatctgtttcttcacagtcggttagaattttaaaggatttgaaatactgcaagctatctgtgtatagaggctgtggattcgggctggtacatttgcaaagtgcccattttattttttatttttatttttatgttttttgagacatattctcactccgtcacccaggctagagtgcagtggtgccatcagggctcactgcagcctccacctcctgggctcagtgatcctcccacctcagcctcccgagtagctgggactacagacatgtgccaccacgcccggctaatttctgtattttttgtagagacagggtttttgccatgttgcccaggctggtcttgaactcctggcctcaaactgtactcctacctcggcctcctaaagtgctgggattacaggcatgagccactgcacctggccgcaaaaaaagttaaagtgctaactttaactttttagattagtaagactgctaacgtgtttcattagttcagtgataataccggcttcaaagaaaagccttggcaaatacaaatcgtaagcagatagctcaactcatcatcacaaagcaaagcccacccagtgaagaaacaaatgtgggaagccccggaagcccctccccatccccacccccccccccgccccccccgccctggaaacagccgctgtcctggtgttgacagcagaggtggcactgcctggctttgaacttgaaggtgggactcaggggtggttggctgttcagatgcagcagggagagagggtttggggcattgctggtgcacgggagagggtggggatggccccccaaactagcggaggccgggcttggccctgggagatacaggaaggaggcccccactccgtggattccgtccttcctctccatctgtctggaaccctcaccctctccctccctctctgtcctcacacacccactccctgactctcactcaggcttttgaggcatgtgtgctgcccgcggagcccttggcctgacttcttccaaggggtggggtagacgcccacattttcacagcagagacagcctcccagcctctgttcagtgtgtggacagatgggtattgccttcgttttattgtttgttagtcttattgagtgctttcgctgggtgcgatttctggaatgatgcgtgaagtgcttccccatggaggtcctgtgggctgggcgatgccctcccgggctggttgctccccagagagggaagcccagctccagacacacaaggccctgcctgtgcacatgtcatgtgtgactcggggagagcctcctgctctgatgcgtcagccctccagcctgcagctgggggccccgtgccagccgggactcatttactcccctcttctgagtcagcacctgctggggttcgtgggaccccagacctggctctcttacgcctacctgttccttctctgtcttgcaggttttgggatttgagattgacgcggtgaactctgtccagttttcaaaccacacaggtaaggcgttggctccagcagctggcatagagcagactgtgggtgtgagggacggggcggagtgtgggtgtgagggacggggcggagtgtgggtgtgagggacggggctttcgtgtggacggggacctggagtcctgggcgtcgctcgggcagagcctgcacagcatatcagggtgtaggcctgggtggcctcgcctctgagaggggttgtgttgactcagcttggctgctttgaggctgtgtgacccagtgcaggtggcagaacctctcggtgcttcagtttccttctctgtaagacaggagggcaatcctaacacctgccgtgaggttgccagagttgattacgtcacttgcataaaatgcttggaccaatgcctggctcagagcgcagccgtgtgactcctgctgtccacctgcctcctggagctgaggagggtcccccatggggtggtcgtgctgggggatgtgtaggtggttctgggttttctctgttaacagcagtgctgcagggccccgtgtgtgcctctgtctccctgccctgggactctgaggactttgctggctcaggggactgagggtggccggcctcagaagcccctcacaggccatgctttccatgcccccagccccatggcctgggggtggaggtgcgtggagtcccccctcctctctgtggtttctatactgcttcgtcggcaggagaacaaagctgttctgttctttgaaaccccacctcgcttcccctgaaatttctctgaacccaggcggaaccttgggagcacagaacgtcccagaaacagcctggcagagcatcagtgcgatatgttggagcagggaggaggggcctggcccctactcttgggagtgggaaggaatgctgtggtttcttttgaggtgggcatgacacgtgctaagtgagaggaaagagttgcttggccggtgcagacggacaggctccagctcttggcggtgcagatggacaagctccagctctcgctgaaaccctttcctgcctttgcttgcggggcacactgggtgctgtgagatttggagacgtccccgaagactcaggccctccaggagcctccctgaacccacatgtccttcctggctgctctcgccatcctcctttaggatttatttttcagtgagtgagctggccggcttggacactaaagcagggtgttgagtgtgtttctggggactgtgttgggctccgtcagtgctggttcaacatccacaccgacccggctgcccttgcatggattccaggttgcgggagggccccgggctttggcaatgccttccaggcttggtggaagcttctcagtgggtggtgggctggctgacccgagggcccagagatagaaaaggggtctctggtctgccctcaggggactgggatgaggacaggaccccaggcgcttgggagcctccacagttgcagagccaggcagacagcctgggggtgtcccttcccatggggtccagcctgtggttcctgggagcccccactccagcctcctccagatgccatggggggcctgctggtttaggaccccttagccagctcagtctatggctgtgggctggctcccagccccctgtacccacactctcggggtcagctgtctgtgcggcctgatcaggaggcccccgggtagcttccctaaggctgtctctgtggctcaggggcaactccctagggcagtgagggcaggtgtcactctcccctgcaccggggcccttctgcctgctccccttccctcgcccctgccacactgtgctgctggggagtgaggctggtgcatcgtgtacctgccctgggtgccacgggagctggtggtcaagacgggggactcggcctcctccgtgcagcccctcagcccctctgggctcccgtgccacccactgtgagtgcggtgcccacgatgacactgtctgttctgcagaccttgacagagctggaggcgctttttgttttttgagtttttttgttgttgtttttcctttttgttccccctaccctctgtctaagggctagaggtgcttatttttcaccaaactcacctccaggaagcattttactggtcctgattatgcacaaagaaagatgtctgcatgcacgacgggcctcccgcattgtaggggctgttctgctccgggcacccttgttccagggctgcgctccccgggctgtctcaggggccacgttgtcatgttcctcctgctgcgtggcccatcgtgcgtgcccaggaccagctcacgccctgtgtgaccggccacgtgagcccagccacaagcagccgtgcggacactcgggccgtttccactttttggctgttggggtcatgctgccatgaacgtttgtctcagttctccagtgagcacctaggagttgaaggtggggttgcacaggctgcgcctgatttggcagggagctgggatgatgctgccagggagctcattcgcgactctgcccagggttttccttttcctttttctgtttttttttttttttttttgtgagacaaggtctccctctgtcattcaggctggagtgcagtcctgcggtcatgactcactgcagccttgacttcctgagctcaagagatcctcccacctcaccctcttaagtggctgggtctacaggtgtgcaccaccacaccgagctaattttgctatttttcatagagacggagtctcactatgttgcccaaggtggtcttgaactccttgggctcaagcgatcctgccccctcagcctcccaaagtgctgggattacaggtgtgagactccacgcccagtcttttcttttttcttttttagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagcgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgggctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaacatctgcttctcagatctaagtgactgtactcaataaatagcgtggagaccagagctcagtgccttttgcagcctccattttgccactggccccctggctcctacctttatgaactcttttctttttctttttttttttttttggagacggagtctcactctgttgcccaggctggagtgcagtggcgcgatctccactcactgcaagctccaccccctgggttcatgccattctcctgccttagcctcccaagtagctgggactacaggcacccgcaaccacgcccggctaatttttttgtatttttagtagggacggggtttcacagtgttcaccaggttggtctcgatctcctgacctcacacaccacgcccagctaatttttgtattttttagtagagatgaggttttgccacgttggccaggctggtctcgaactcccgacctcaggtgatctgcctgcctgagcctcccaaactgctgggattacaggcgtgagccaccgcacccggccccacctttatgaactcttaacctgtctcttctcattcctttgtcactaccggacgttggatacaccatgggtggtgttgaggctggtccccaacactaataaagacatacctgagactgggtcatttgtaaaggaaaaaggtttaatggactcacagttcagcagagctggggaggcctcaggaaacttacagttatggcagaaggggaaacaaacacctccttcacattggcggcaggaaggagaagtgcagactgaggggcccagggttttaaaagccccttgaaaccatcagcttttgtgagaactcagtcactatcatgagaacaagatgggggaaccacccccatgattgaatgacctcctgccaggtccctcccacaacatgtagggattatgggaactgcaattcaagatgagatttgggtggggacacagccaggccatgtcacctccccaggaaaggagcacatgtgcagcagtggtgagtcccaccctgcctggaaagatatcaaaatccgagggcagaaaggaccaggagggaccattgctcacctccctcctcctaccccttaccccaaaccccgccccagcctggcagaagcctcctcaggacacaccctccaccggaggggcaggctgctgtgtgaggcactgacctcgcccgcagtggataccacctgcccctcctgaccccagtgactgttaacccagagtccatcaggggcttggtctctggcagacccacccctcagtgcgtacactctggtgtcccgggcagagtacagggcaggcgcccccaggtgcaccccccagatgccgcactgtgcctggagcgtggctcctgatggcagtctcaggacctttgcgccacacgtcctcccgtgcgacggctgctggggaaagccaaaggcgtcccttccagcgggagccagcgactggtacgcaggagggccctcaggggcaggagccatggagccctcctctggtgtgggaattcaggggatcttagccacagggcatggcgcgtgggcgcagagccggccgtgacccacaagtgcgtgatacttgtactttgctattctaggaacccatacatcagttttccttatttgctgaaaaaggcatgcattagaggggtgattcatgtgggaggaggccgggagcccctcgatgtgaggcgtttctcatgggcgaatgtggggtatccatggtggacccccaccctgtgtggatggctgccccctgagcagtgctttgagctggagctgtggtcaggttccgcagtgcaggaagggctcccaggaggctggtggtcccgcctgcaggaagccgacgcgtctgtcctcacacattgatatgcctgtctgcctgggacggacacttcaccctggctacccatcgggccaagggcaggttgtatacacctgggctgaggcctctttctcattcacatctatctcttgctcaggagttgatctaagacaggctctaattgcaccttaataagcttgttggggaggagttgggggtggggacataacaagccctacctgccagggtatccgggtgacagtggccggtggccgagcaccccggcctgaatagctggggactaatgcaggagacgctgggaaacaagagactgtgacgttgtgcggagggagtagccaggggccttccggacagcaatgggggagcaacgcagccgtgagctggtgtgtctctccccacgctcctcctgtacctgggacgcagctcccgcaggaactggcagtgggagtgtgggggccacggaggtcgtagtaaccatccctgacagtgcaggggcggggggctcgcgggggggctcgcggggggctcgcgggggggctcgcgggggggctcgcggggggctcgcggggggctcgcgggggggctcgcggggggctcgcggggggctcgcgggggggctcgcgggggggctcgcgggggggctcgcggggggctcgcgggggggctcgcggggggctcgcgggggggctcgcgggggggctcgcggggggctggcggggggctggcggggggctcgcgggggggctcgcgggggggctcgcgggggggctcgcggggggctcgcgggggggctcgcggggggctcgcggggggctcgaggcgtcccatgtgggcagccgttgggacctgccaagcactgcgcctagtgatctccttcgggtttgagccagtccatggggaggagccgtccaccaggcagcctcagggagagtgggcgggtgtcaagggaagcccacggccccagctggcccccttgtgtctgagcccccatggcttcctctgcctctaggctatgcccactggaagggccaagtgctgaattcagatgagctccaggagttgtacgaaggcctgaggctgaacaacatgaataaatatgactacgtgctcacaggtaggtgccggagcaagctgccgcaggggactacgcaccccactccagccagggtgggctcagggaggtccagagcacccccgccctgggcctgtctcgggtccctgccccttcaaggagggccttggcgtgcccaagccaccatcacacccccggtagcctggggggtcctggccacactatgcctgccgggacaatgactgcccaggctgtgccaagtcacccccactcctgtgaccacactggggttccagtgcccaggggagggtgcaggcagggtgttgggaacgctgaccggggcaggacaggtgggtgggacactcaattaggtgacgggctgctacctggtacactgccatcctttgtcaactttctggttaaaaaaaaattgtatttgtatacatgtttattattattattatttttgagacagggtctcactctgtggcccaggctgtagtgcaatggcacaatcatagctcactgcagcctcaacctcccaggctcaggtgatcctcctgcctcaacatcccaagtagctgggagtaaaggcgtgcaccaccatgcccagctaactttttgtgggtgtgtgtggagacagggttttgccatgttgcccaggctggtcttgaactcctaggctcaagccagccacccaccctagcctcccaaagtgctgggattacaggcgtgagccactgcagccagcctggtttctacacttttaaatggttaggggaaacacttagcctcccaaagtgttagaattacaggcgtgagccactgcgcccagcctctctacatgtctaaaggtcacatataaggccaggcacaggggctcgaacctgtaatcccagcactttgggaagactaggagggaggctcgcttgagaccaggagttcaaaaccagcctgagcggcatagtgagaccttgtctctacaaaaaaatttttaaaaattaattagctgggcacagtcccagctactcgggaagctcaggtgggaggatggcttgagcctgggagttcaaggctgcagtgagctatggttgaaccactgcactctggactaggggacagaatgagaccctgtctcaaaataaataagattaaagtgtcatatgcttattactgaaagtagaaatataaataaaggaaagatcactccttcacctctcgcccgtgggttcattcctgtgaagcacagcgtttctgttgagaaatgctgccgggtctgccctccgtgtctttcaactgtgaggacacctcgtttgcacccacctccctccccccagctcctgagcactgtggggacacctcacctgcacccacctccctccccccgctctgagcactatggggacacctcgcctgcacccacctacctccctccagctcctgagcactatggggacacctcgcctgcatccacctccctccccccgcccccagcactgtggggacacctcgcctgcacccacctccctccccccagcccccgagcactgtggggacacctcacttgcacccacctccctccccccagcccctgagcactgtggggacacctcgcctgcacccacctccctcccccctgcccctgagcactgtggggacacctcgcctgcacccacctccctccccagccacccctctgcagggtctgctggtgcttctctttctttgtgccacagttgatcgtggtgagtctcctgttttctgagggtgacctggattctccccctaaaggttatacgagggacaagtcgttcctggccatggtggtggacattgtgcaggagctgaagcagcagaaccccaggctggtgtacggtaggcaggggcccaccctcgggtctggctgtgtggccccacacgggtggggctggcctgggagcccgggaagggacgtcttagcctccttcctcctctgcacgcctccgtgccccgcctctccgggccagtgaattgtgtctgctgggcctctgaagatgttggcctgctgaagtccgctgggctagaagcgtttgcaggtgaccctggtgtcttgtgtggctggtgtgagacaggaaggggtgtcagtgtgctcgtatagtggggctgctgtgtgaatgcctggggcccaggcagcactgttgtgtgactacactcaccctaaaggcggaaggggcaaggggccacacccaggcagggccaggctagggagtgggggagggcagggtcatacccaggcagggccaggctagggagtggggggagggagggtcacacccaggctgggcccgctagggagtggccaagtctttggggcatctgccttgatcggtctttcgttagaggccaggcagtgctggatccatcttgacgcctggcagaaggggcagcgtcaccaaaccttgcagacaggctctctctggggcacaggtctcccgggtggcaggaggacaggcctggcctagcacatggtttgccacgctgtgtactgttgcccaaaaggagagtgcttgtcggtacagacgtgtgaggcccggattgtgtgtgctcgaggccaggaagaggaagggagctgctgcacctgcttgggtgacaaacagtgatgaatagcacctcacagcaattaggatgactgtcatcaaagacacagaaaatagcaagtgtgagcgaggatgcagaaaccctcatgcacagctgctgggagtatgaaagggtgcaaccactgtggaaaacacgttggtagttccccaacaagtggaacaccatcaccatgtgacccagcaattccgccctgcgcatgtatccgaaatagctgaacacagactcaagcggatgtgcgtattcccacgtctatagcagcgttgttcccagtgaccaaatgtggaaacaggctgtgtctgttgatgggtgatagacaaacaaagtgtccgtacatacaatggagtattactcagtctggaaaaggaaggaaattctgacacactctgcaatgtggatggcgcttgaggacatgatgcttagtgaaagtagccagacaccaaaaagggagactgttacacgatcccgctatctgaaatagctaggaaaggccagttcatcgaggtagaaagcagacgaaggctcgtcgcggctgggaaaggccagttcatcgcggtagaaagcagacggaggctcggtgtggtggctcacgcctggaatcccagcactttggatggctgaggtgggcggatcacctgaagtcaggtgttcgagatcagcctggccaacatggtgaaaccccatctctaataaaaatacaaaaattagccaggcctggtggcgcacacctctaatctcagctactttggaggctgaggcaggagaatcacttgaacccgggaggcggaggttgcagtgagccaagattgcgccactgcactccagcttgggtgacagggcgagactccatctcaaaaaaaaaaaaaaaaagaaagcagactagacgttaccagggcctaaggcagggggagtggggcgtgagtgtatagtgaggacagagtttcagtttgggaagatgagaagttttggaggtggatggtggtcgtggttatacacggtgagaatgtcctgaatgctcctgaattgtacgcttaaacatgcttacactggcaaagattatggtatatattttttactatattaaaaagttaaaaaagggaagatacctacttcaacttggcagcttaaaaaacaagaaaaaagaaaaaagccaaatgtggttgctcacacctgtgatctgagcactttgggaggccaaggtgagaggatcgcttaagcctaggagttcaaaaccagcctcggcaacatggtgagaacccatctgtacaaatcatttaaaagctagctgggtgtgctgctgcatgcctgtggtctcagccacttgggagggtgaggcaggaggatcgcccgagcctggaagatcgaggttgcagtgaaccatgattgcaccactgcactccagcctggacaacagagcaagaccctgtcttaaaaaaagaagaaagaaatgtggagggtttcttactcgtcagctgtagcctttgctgataagatgcccttgtgtctctgcagtgtgtgatccagtcttgggtgacaagtgggacggcgaaggctcgatggtgagtagtttcacgtgtgtgatttaaaagtgtggtgagtggagctattcctgtccagccagaagacaggcccacatctctaagtgtctaactcggtgggactcctctgtccaggggtaaaaagacaaaccttgttaggaaggagaaagggaaccgacatattttctgtaaagtgcctgacggtagataaatatcgacacctttgccggccgcacagccttgccacagctgttctcattagagcacagaagcagccacagataagaggtgtacaaacatgatgacttcttttcttttctttcttttcttattgagacagagtctcactcagtcacccaggctggagtgcagtgtcatgatctcagcttactgcaacctctgcctcctgggctcaggcaattcttaatgcctcagtctcccaagtagctggaattacaggtgcacaacaccactcccagctaatttgtatatttttactagatacgatttcactgtgtcgtccaggctggtctcgaactcctagcctcaagtgatccacctgccttggcctcccaaagtgctaggattacaggcatgagccaccacgcccagccatggatgactattttctaataaaatttcatttgtggacactgaaatttgaattttctataattttcatgtgtcacaaagtgtcattctttttttggcttttttcccctaaccatttaaaaatgtagaaaccagactgggtgcagtggctcacgcctgtaatcccagcactttcgggggccagagcgggtggctggcttgagcccaggagttcaagaccagcctgggcaacatggcaaaaccccgccatctctaatcaaaatacaagacaatgagctgggtgtggtggcacctacctatagtcccaactacttgggaggctgaggtgggaggatcacttgagcccaggaggtggaggctgcagtgagctgagatcgcaccgctacactcactccacagagcaagaccccatctcaaaaaacaaaagaaaaatctagaaaccacttaacccatgagctgtgtagtaacagcagcagctgcagcccacagacctggacgtcggatcaagtggatggagaacaaatccactgtgaccagtccagaagcctagaatttagaggcggaaggaacccaaaggtgatcctgcctgtgggtttttaactcagccattcagcgcccaggcgatttcagtatctgccttctttgtcgttgtgtctagggtgtctgtttgcttgctgtatattcactgagcacagcgggcttctccactggcacagggcacgcctgggcctgtgccctccctgccccgctgggtcagtggttgaagtcaggatatctgtcactgggcatctaactgggtggggcgggctggtgtgctcagcgtctgtctgtccactttctcccatgcttgttctctggaaggttccctgtcctgcgcccagcctgcaggaccccagcttgcagctccctgccttcccttcatggtgctccctggtgtgggctctgctgaccctcggcagacacttgcgtttggatcacgaagagttggggccactgtccagttcagtgcggctacgggatctggcccctcgattttgatcacatttgttttcctgaacaagagtggcctaaacacgagctcctgtctcagatgagcggtcaccccgtatctcccctttccgtgaggttaaaggggtgtgttggccctccctacccaaaatggggctctaaagagctttccttcgatttcctggtccagggatcggggacatccacgtgccacccacccatccttagtgcctcctaagccatgtctggagcagcggccggcgtgtgaccactttgtgtgctctgagcaccaggtgcagacatgcctcctgtggggcctctgatctccaagggaggtttccgggagcaaagtgaagtgaagggattggaaactcaggccactcagccagcaggggctgctgaaatgttccatgaagcccacagaattcttccagagcttcgcactgcctccggcttaaatttgatcgctaaagaaaaccatgtgttgcctggcacagtggctcacgcctgtaattccagcactttgggaggctgaggcgggtggaccacctgaggtcaggagttcgagaccagcctggccaacatggcgaaaccccgtctctactaaaaaaaattagccgggcgtgggggcaggcgcctgtaatcctagctgctcgggaggctggggcaggagaatcgcttgaacccaggaggtggaggtcgcagtgagccaagaccacgccattgcactccaacctgggcaacaggagcgaaactgtctcaaaaaacaaaacaaaacaaaaaagtgttgaattgtttgtcaggcaacttagacaaaaactagatgaagggtgcattgactcagccaggaagagctggcgggttgggctcccagtcgcagatggacatggccagcacccccaagccctcaccagatgaccagggctgctccatccacctgtggggtttccctttcctcgtctccctcctccctccctccctctctccttcacctccttctcctcccagacactctgtggggacccactgtgcgccctgagtcctccctcggcccctcggagcacttagggttccccactctagtgtgcctcggccacacgctgtccccgtggtgggaacaacttatcgctacagtcggggggcctggcccctgagcctggacttcagggggcttttgggggagcactccgtggtgggcttccctccgcgccccctggcgtgcttccctcacggtgactcagcctctcctcctgtctcctttgttggccagtacgtcccggaggacctccttcccgtctacaaagaaaaagtggtgccgcttgcagacattatcacgcccaaccagtttgaggccgagtaagtcattttattttattttactttatttatttatttttcaagatgggtctcgctcttgtcacccaggctggagtgcagtggcacgatcacagctcactgcaacctctgtctccggggttcaagcaattctcctgcctcagcctcccgagtagctgggatgacaggcgtgagccaccacgcccggctaatttttgtatttttagtagtgacggggtttcaccatgttggccaggctggtcttgaactcctgacctcaggtgatccacccatctcagtcttccaaagtgctgggattacaggcatgagtcatcgtgcccagcagagtaagttattttaaatggcaaatgctaccagtctttccccagggagagctgcagagaacatgccagaagggtctccactctgccttcgggctgcctgtttagcttacgaagtggttctcaggaaggtcctgccatggggcgagtgccccttgatactggagcaggatgtggtgggggcgcctgggttggagaagcccctgcccacctgggtcccaggctcacgtcttctctttggtggtggcagccatgggtgatggggatggttttgctgcccctgtgccttcctgagcggcagggcccctgggagaggaagaggaggggcgacctggggagctgtgggcttgtcggggccaccacagcagagggagggtgggggcagcacaggcggccaggtcacctgccgccctgtgaggggaagaggagtgtgttgggcttggctgtctgacaccgagtttgaaaaggtctttctttgggtgcatggctccccccagctgaagaatcacacaccaggggaagccaccagcgccccagtgccatgaagagtggagctgcccgcggagggggctggtgcctgtcacagcttagctctacctggccctgagccaggtctcgagcccccccattcacgcaggggtgggggcgcctggactcttggaggcctgggatccctgacctgggcctgtccaaacttgggggtggcatctcactcgaggcccctgagccatgggtggcccatgcgtgcattaatcgctagcggctctttgactttgtatggatgtcagtcacccatgctgagaccctgcgctgtggcatgggccttaagtgggggccgtggctgctgtccatcaccacggttacgtataaacagcagccatgattgggccttacgtgactcctgtaatgtgagggtcccctttagaaccaaaccccacatgttgcaggggccccggcccagggtggccagtggacgaagagttagctgcctgtggggatgggggtttccagagccgctgcggtttggggaatgtcaacacacaacccggagaggagaggctcacctgtccccacccgcctgtccccgcctgtcttccaggttactgagtggccggaagatccacagccaggaggaagccttgcgggtaaggaggccctctggggcctgtgcggggcacatgtgccgctcacggtggggacgggagacaggctgcctgagtggcaccactgtgtcatttctccccagcagtgactgaacagtctgtaccagtcggggcctccagagatcagcaggatatatgtgtgtgtgtacatgtgtggacatgtttgtgcatgtgtgtgtgtgtgtgtgcatgtgtgcgtgtgtgcgcgcgtattgtgtgtgggtgtgtgtgtgtggatgtgtgcgtgtgtgtgcgcacccatgtgtgcatgtgtgcacgtgtgtgtgtgcacatgtgcatgtgcgtctgtgtgcatgtgtgtccatgggcgtgtgggcatgggtgtgcacgcatgtgtgtgcgtgtgtgtgcacgtgtttgcacatgtgtgtgcatatgtgtgtgtgtgtgtgtgcacatgtgtgtgaagagctattgtaaggcggtggcttgagctgtgtgggggctcctgggcatgtttgggatttgcagggccagctgttgggaagggcaggctggaggctggacacaggagcagatgcagcagcccaaggtgcagtttcttcaaagtcctttttctccgggacttggagaccgtgcgtgtcttgctagcattgaaccttggttgagtcatcttagtctgttggggctgctgtgacaaaatgcctgagactggatgatttataaaaaacagaacttttggccggatgcagtggctcacgcctgtaatcccagcactttgggagactgaggtggtcagatcacttgaggtcaggagttcgagaccagcctggccaacatggtaaaaccccatctctactaaaaatacaaaaattagctgggcatggtggtgcacgcctataatcccggctagttgggaggctgaggcaggagaatcgcttgaagccaggaggcggaggttgcagtgagctgagattgcaccactgcactccagcctgggcaacagagtgagcgagactccatctcaaaaaacaaaacaaaacaaaacaaaacagaactttgttccccacagttctggaggctgggaagtccaaggtcaaggcactggcaggctcagggtctggcgggggctactttgctacccggactgcaccttgttgctgcatcctcatgtgtggatggcagggggctcgaggggcccatgctgctccctccagccctcatcaggcacagagaaaggggagccctcatgacttaatcatgccccagaggaccccttctgaatattgccacatgggtgccatgtttcaacatgcattttagagcagacactgtcagactgcagcaggagtccatgtgctttgggctgcgttcccaagcagcctggcgctgccctgaattttgtcttcacaacccaggagcctggtcctgagaatgggccactgcagcagccactcctcccactcggaggcctttcgctgacctggtattgggtcctgggactgcagagtcagctgaccctggagcagggtccagattctgctatggacacgtgctgggtggcgatgcagcacatgtgtgtgtgtgtgtgtgtgtgtgtgcgcgcgcgtgctgcccgatctgaggcaaccgtgcggtggagacagtttctacgagagttacagaaaagccaacgtacagaggggccagctcctcctcgctgcaggacaggcacccatctgtccaccccccaagggggaggccctcgccagtcacctgtggggagccacacggtttgggctgacagtttgtggggggatggtggctgaccaggtggctgtcttccctccgggagtgccgccattgggaacgggctctgggggagtggggtgtgaccggccgtggctgatgctccccgtgccactgccaggtgatggatcggggagtggggtgtgaccagccgtggctgacatgtgaccggccgtggctgacgctccctgtgccactgctaggtgatggacatgctgcactctatgggccccgacaccgtggtcatcaccagctccgacctgccctccccgcagggcagcaactacctgattgtgctggggagtcagaggaggagtaagtgcccccatcgtgcaccgtggccgcctctgctcttcccagaggaaggtgttctttggggctgcaagaatgttttgggttcaatagcatgaaatttaagccttatccagcaccgggatgacacccccattttacagactctcagggatcaggtgggattcccaagacctcacaggtcacgatgaatggcctggctggaactggcttccacggacccagcatcataggcctccctcagagccaggcggggtccctgagttcactgggaggacgcgtccacccggctgtgctgattgtttacacagacaccacctggttgattttctctgaacagtgtgaaaatgacgcagaaggctggggccatgcactaagctagtggccgcgggttcatacccatgggcccaaaagaacagctgtgacctccttgccgctctatgtttggacatgggagccttgcaggcacacacataggcacaaatgcacatacacttgggcacaaatgcacatacgggcacacacgtggacatgggcacacataggcatacatgcacacatacacacgggcacacacaggcatacatgcacacggacacatgcatacacacggacacacatgcatacacgtgggcacacgcacacacatgcacacacactcggatgcgtccaggtacatcctagttcttcacgccgtcgttactctcgggagtttcacagcgacccccgaggcggcctgaccgtgtggccctctgagggtgcagtctttccctttcccttgctgcggtgatggggaccccatgcatgccctgagcccccacgtcctgagcaaggccaccttgtgctctgcccctgtgaccctccctgccgccgtgcccaggaggatcagggatgggaggctggccctggcagaggagcggcagatctcagtgaccttgcccatcttctccccctagggaatcccgctggctccgtggtgatggaacgcatccggatggacattcgcaaagtggacgccgtctttgtgggcactggggacctgtttgctgccatgctcctggcgtggacacacaagcaccccaataacctcaaggtcagccacacgcaccgctcccctcctcgcccactcccacggcacctcatggggagcaggatatgagagtcctggtggggggtccctgctgagctgacagggcatggccctgagtgctggccccagttgtgggggagggcagtggccaggccatgacaggagttgcgcctgtcactctcacatcgcctcccatctccccttatttgggacctagggatgatcagagtctgtgagggcttgggtgacagatgtttcagaacagacccatgggggtcccaccaggattcagatgccacccgcttggcgttggcgcagggctgtgggatgcatggagctgttgtgtccttggtgacttgggggctgctgcagaggagtggcaccctgcagcatttcccacagtgtgaccacggcagtgacctgagggacggaaaggccggagccgcccttcggggacagtaggtgggaggctgaggacaggggtccaggcaggtgtggagagccgtctttctgggcgttttgtctggatgtctgcctgcttttcaagtttgtagagatcgggtggctttgcttagacagtggggggagtgggactgttgggcaactgacatggcaggttgggatgtggggtctcgtgagcctttctcgtgtgtcccatgggtaagcacacagctcagcggggacagaggagttttgttgcaactgtggcgctcagatccgtgacctcctgtgctgcatgcagcagagttgcttgtggcctcggcaggtggttttgtcagctgagtccgaggacgcctggagtgtgtcttcttacaacaccgtccagagccgtgctgtgctctgaggtggtccccagcccctgggctcagcccccaaaactcccctgggtacttcccactgcgtccgcagtgggttcaggtgggagggaggggcctgccatccctttggaatgtggggcagggcaggggtgccatgggagtgacaggaggaagacaggacacctctgtcactattgggtgcgctggggaaggaagagttcagaggtcaggacctgcaggtggctctccctgtgctgtctttgccgggccgcttaaggggccacgtgtcccccggggtacacctcctccccaacaagtcagtttcagctgagtgtcctggtgtgtaaaatggaagaggtggactgaggccctttgcctcccatgggactagcccctctgcacaccctgagctggaatgcacagccccctcattccatcccttctggcccctcaagggcaattaaacagggccattaagtaagcctgccgtgtttaattggtggtgcagggcagtggaaaagtgccagctggcaccccgaggaggcctcactgccaggccgcccaaggtcacattctgggtttggccagcccagggttgtggagtcggggagcgagttccccgtgcttccccagcacctttgactctgaggcatcactgagtgatgattggctgactctgaggcatcactgagtgatgattggctgactctgaggcatcactgagtgatgattggctgactctgaggcatcactgagtgatgattggctgactctgaggcatcactgagtgatgattggctgggctttcggcaggagcacttccccttgtagactcgttataaggagttaattctgggaactcctaccaagctcctgctgcctgccaagttctatgcaggtcacgaggctgtcccttctgtgagccatctcttgtccagagcaggtagctgggaccgggcatctgctcagccctccgggctctccgtggtgggcagtccgcagcctgtcctccagggttcagcacgtgcattggcggagccggctccccggtggctcggagagcaggacggcccttgtgttccctggaaatcccctcctggcagcagtgggcacgtcgggtgttgtgagtgggccaggggcacagcaagtctgtcctccctgcaggtggcctgtgagaagaccgtgtctaccttgcaccacgttctgcagaggaccatccagtgtgcaaaaggtacggcggccgggctgcatgggctgcgtgggctcctggctcccgaagtgggtgggagagaagagctggcacgtgctggttttgaaggtgtgatcggtgtctcctgctgacctcacctctgggagtgggggcaacagcgggagcccctctgagatgggaactcagtgctctctgcctgccccgcagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagc

SEQ ID NO: 16966 - DNA, 6417 bp, Human
gggtcaactctgccttcactcattcaacaatgatggggggctctgccccgctccccccaggcttcaaccacacctgactgcccacccctttgggcccttccctgaagtgacagaccaggctgtgccctggcaggtaagagaaaggaccccacaacccattcatgggccgctccagctggggccttgcatgcaggagcggaccagtccccctgagggacagcccttgggtgggggctctgggtcattttgaggagtcaatcacaccaacaggtgcctagcacaggccccacccccaccccaaataaggcaagcgacccttcccttccgcaggtggtccagtctaacagaaaccctaaaccaaagggactgtgtggtggctcaagcctgtcatcccagcactttgggggatggatcgattttagcctaggagttcaagaccagcctgggcaatatagtgagactccatctctacaaaaacactttttaaaaaaattaggggtgcagtggtttatgccaataatcccagcactttgggaggccgaggtggacagatcgctcagaagttccagaccagcctgggtaacatggtgaaactctctgtctctatatatgtgtgtggtagggtgggcctgtggtcccagctactatagcagctgaggtgggaagatcgcttgagcccaggaggtccaggctgcaatgagttgtgatcaggccactgcaccccagcctggccaacagagcaagactctgtcaaaaaaaaaaaaaagaaagaaagaaaagaggtcaggtacggtggctcacgcctgtaattccagcactttgggagcccgaggcaggtggatcacgaggtcaggagttcgagaccagcctggccaatatggtgaaaccccgtctctactaaaaacacaaaaattagctgcgcatgaaggcgcgcgcctgtagtcccagctactcgggaggccgaggcaggagaatggtgtgaaccccggaggcggagcttgcagtgagccgagattgcgccactgcactccagcctaggcgacagatccagactccgtctcaaaaaaaaaaaaaaaaaggccgggcgcagtggctcacacctgtaatcccagcactttgggaggccaaggcgggtggatcacaaggtcaggagatcgagaccatcctggctaacacagtgaaaccccgtctctactaaaaatacaaaaattagccaggtgtggtggcgggcgcctgtagtcccagctactcgggaggctgaggcaggagaatggcgtgaacccgggaggcggagcctgcagtaagccgagatcgcgccactgcactccagcctgggagacagagcgagactccgtctcaaaaaaaaaaaaaaaaaaaaaaaagaaaagaaaaggaaagaaagaaaagaaatcctaaaacgcaaattccaccagagaaccctgccttcttctcatccctctgatctaccccctgcccccacccagcctggagcgcgtgggcgccgtctccccctccctgggcccctctgtccacccccttcagccttcagtgttctcggtcacaagcggtgatgtccactgcagcccgcacacctgctcccgcggggccgggacccctgacccctgacccctgcagcgctgcgccccgccctccctcgtgcgcggcccggaccccgccaccctgcaggattgcgcctactccgactgccccttccctatcgtcccaccctgcgcgcccaacccaccggcgacacccggccgcgcccccgccccggtccgtgtgactcggcgcccggaaagacgataccagccccgggaggggggcgctccctcccgacaccagcgctgggcgcggagacccagcctgcggcgagtggtggccaggttccccgccccgcgccccgccccgcgccccgccccgcgcgtcccttcttgcggggccaccgcgaccccgcaggggactccgaagccaaagtgcctcctccccgccccttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgggtgggccgcggggacggggccggcccggagtcctgccttagcctcagggcgcggccgcggctcctggagcgaaagaagccgctttggccccgctgcgcacccctgggctggcccgggctgtggccgtgagaggcctccctccgctcgggcgctgcgcgcgagtgagcagcggggggccgcgcctggggcgccgctggggagacattgggctccgctgaatacagcaagggcgagtgggaattgatagcccggagcagggtgcggtccctgcatggacagtctctgagaggaaaccccagggatgaggcgcttctggtttcaggcaggcagggtgatcgggcgtcgccggcgatggcgcaggtgagcagccggctccgatctccacggtgatccgatagcaagcgggtgggaagggtctggctaaactgacttagccaggcttcttgctaaaagtggattttacaaggaagtgcgcaggtggcctaggcgcttcaggagcccgactacagtttggccaagcaagaatctttgtcaatatcctcatctagttcgggaaaaaaatcatgagagagagtgcaagaggtccccagtgataaggcacatgggttaaaaacttaagtgtatctgcataaaaggtccacaggtttctttacatgcttccgattctagcactgtttcaaactgtaagtctaaataaaaagttaaaacacagaaaaacaagataaaaaccgggctgggttgcagatggcaaccttccctgtgtctcggtttcctcgtctgtaaaatggacgtcctgttgctctgcgcctgccagaagattctggaggggctgaaatgagcaggtcatctgtgcaagaagccccctccggtggagcacaggccaggcccgcctcgctgtcatggttggtgaccgacgggatgccccaagcaagaacaggtccaggcgatgctgaggcctgtgttttttttttttgtttttgagactcagtctcactcttgcccagggtggagtgcagtggcacaatctcggcccactgcaacctccgcttcccaggttcaagggattctcctgccttagcctcccgagtagctgggattgcaggtgctcgccaccacgcccagctaatttttgtatttttagtagaaacggggttttgccatttggctaggctggtctcaaactcctgacctcaagtgatccgcccacctcagcctcccaaagttctgggattacatccttgagccaccgtacccagctggaactgtttttttctactttattattaggctgacagtttaaatgtcccttcagttgtaagagacaattgtgtgaagagccagtgtcagaatcgtgtgtgtgctcacatgcgtgcaagttactctagcaggagggaatccaagaagccactgagacatcctcattctgtcccttctgtctaggtgaggtcccagcttgaagagaaagaaaacaagaagttccctgtgtttaaggccgtgtcattcaagagccaggtggtcgcggggacaaactacttcatcaaggtagagtgtgggcctcaggagggcctgccccgaacgggtgctggtaggaaaccgcctgtgcaggcccgggctgtgtggtcttaggtgctggggcgccctgtggctgccccctgagataagcatcctactgtgtgtgtccatcggcctttcaggaggactagggcttctggggagctaagaaccccaaggaaacaagtgtgggatgtgaggcatcccctgcacatgcaggagaagacaagattgtcttcagctggctgctaatgacctggaggggcgcagcaaggtgacttgggatcagaggcttcgctcactccgctctcttcccaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttacagattgcctcctttgttttagacttttttcttcgtctgaaccaccccgggcaggtccttcccctcgggggcatggagggcggagagactgcctggctcacacagcaagcaggtggtggacccaggattcacacctgcccactccggcccgcgttcctaaccaccactctttacatgttggtgctttgactcttaggtcctggccccaagcttcagtttctcccataaaataaaagagtgtgagtaaatccaattccagagcataactggctccagatctcagatacattcacgcactttatgctctggtacggagaggcagccacacagtgtcgtgcacgtgcagaatagcctgcagcctcactgagtgccctgtggtgcgggaggcttcccatggagccacgtgggcttctaaagggaggtatcttaggagagcgtggctgtttttaaaaacaccttctagttttcaacagggattacttcccattcatggaattggtccggtgccttcccaactgtgattctatgttaaataggacagaagagggagcatcatacatgataagagctaagactgggggtgaaagtctctgtgcaccggggtcatgatgtgaacgtgttcctgagggtgtcctgagctgcgctttgcctccgaggcgtccggcagcgtatgccagaactgcagctgcagggttcaggctgtccagatcgtgggggatctgtgaagactaaggagggatctaccagtgagtccacagagctttgaaagtgatgttaggaaattctgaatcaggccgggcgcggtggctcacacctagaatcccaacactttgggaggccaaggtgggtggatcactctgaggtcaggagttctaggccagcctgacccacatggtgaaaccctgtctctactaataataaaaaaattagctgggcgttgtggcaggcgcctgtaatcccagctacttgggaggctgagacgggaggatcacttggactcgggaggtggtgggtgcagtgagccgagatcgtacctctgcactccagcctgggtgggtgacagagtgagatcctatctcaaaaaaaaaccaaaaagaaaactgaatcatggactgtgtgtattctacactcttaacatgaactctgagactaagcttttataacatgcaaaacagaatcaagcagttttgcattgaaaggaaaacccgttgtatttcccacttgagaatttccagcggaaggcaggtgggggaggggctgtttaggggaccacgcagcgggagagccatccccaacaggaagggagcggttgtctgcaggagcagtgaccaggaactcctatggggcacctgggttgggggaagctggatttagggttagaagcttgtgtgtaaacaggaaatatcagtgtaaaacagaaaataaaatatgtaattaatgctgtggtctggtttaaatacaagttgacaaagggatcaaaattacaggctcacgcctgtaatcccaacactttgggaggctgaggtgggtggatcacttgaggtcaggagttccgggaccagcctgaccaacatggtgaaaccccatccctactgaaaaaaataaaataaaatacaaaaaactagccaggcaggtgcctgtaatcccagctactcaggaggctgaggcaagagaatagcttgaacccaggaggcagaggaggttgcagtgagccgagattgcaccactacactccagcctgggcaacagagtaagactccgtttctctctctctctctatatatatatataatttatatgaagttgtcaatttcatccacacgctgtctgcttccttaggagcatcaacagcagcagcttggaaatctgatgaatttcactacccgctgacaaaagtcccttgttaccgaaccccccgctggtttaaccgaaccccccgctggtttaaccctgccctctgagagtgcattaggagctctgatatggtgtggctgtgtctcc

SEQ ID NO: 16967 - DNA, 31300 bp, Human
ttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcacatggtaattatatttttaattttttgaagaactgccatcctgttttccacagcagctacaccatttcacatccccaccaacactgcatgagggttccagcctccccatatccttgaaacaattactattttctgcatttttctttcttttcttttcttctttttttgagacggagtttcgctcttgctgcccaggctgcagtgcaatggcgcagtctccactcactgcaacctctgcctcctggcttcaagtgattctcctgcctcagcctcctgcatagctgggattacaggcgcacaccaccatgcccggctaatttttgtatttttagtagagacggggtttcaccatgttggctgggctggtctcgaactcctgacctcagacctcaggtgatccaccccccccccccccccaccccacgggcctcccaaagttctgggattatgggcgtgagccactgcgcccagcctgtgtttttcttttatagtagccatcctaatgggtatgaggtggtacctcattgtggctaaaccatgtacgtttaagaatttacacacacacacacacacacacacacacacacgtgatgaagctgtaagaaaagggagagaataatgacccaaaatgtcagcacaaggatgcctcaggggtagacacaggtgtcttcttagcgccttttagcccacgcatatgtgcttgcgcagtctctcggtgtgttttctaacatttcacaattaaataaggagtagttgatattcacagccaccatttccaccgtatatgtagagaaaaatgctcaaatcctagcgatcagcccgctgagctttcacaaaccgaacacaccgtgcggtcacgaggcggctctcccgaacaccggctctgcacccccagggcccggggaaccaagacttccccaagggcccagcaaaagtgagggaggaggggaggaaaggagggagagggagggaggagtgctggctgctttccgccagcgcctcgtttgggtttcgctctgctgaggcctgaaggcgccctgagggcccctggggggcagggaggggcggtggctgcggccgacagcaaggaacctccggagaagcgaagccgggccagacgtgccaccggggcctcggcgctggcgaaggggcgcgtgcggccgcactggggccagccccgccctggtccccggccacatcctcgagaccaccggggtggaggggggggtctcactgctcagggcccgcgtgacattgcacaggtttagaaacgcacagcgggaaggtggccccggcgggccgagggcgcaggatccctgctccgtccagggtccgtcctgcgaggaggcgccgggggcgggcccggggcggggcgggcggaaggcgcgcgcggggcggggcggggacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtgggcgggggtcccggccgcgtcgcggcgcagggggtggagggcgcctccgccctggcctctccggagcgcccgccgagccccgggacccgggtctcgggccggcccggcctcccgccccggcctcccgccccggcctcctgccccgggtctgtcccccgctcttccccggcgcggtctccggcctacgtgcggccggccacgttctcggcctccgcctgggtcttggcgccgcccgcgccctgccccgggggtgtgtccgactctgggccgcggggcaggacctcccgaggagtccccgaggccacgcgagcggagggcgccggtcccgccacccccagagcctggcccttcctggttctgaagcgacccggggacccggtgcctcccgagggccggcgccaggctgcgggcttccgggacctcctcccggctgggcgggggcggactcactcccggaccgcgcctcctcctcggggccctcgcggccgccttccttgtgggtctagctggggaagagggcggtggggagatgggctgcccggggcattgagcaaagcccagttgtcacccttttcgcaggggtactggggaggcctcaggtggtggggactgggacttggcagagctgggtgggggtccggcctgagggcgtggtgtcctcgcacgctccctcccggaggcctggtcctgcccactgccggcctccagtgtctctggcctgacatgtccagtgtggcacctgtggcacaggacgccacctaccctacccctcaggaggagagaggagaggatttaggagaccagaagtgaggtgctgggttgggaaggggcccagccagcaccccaaggctgtgcagcggggtctggtctgtcttttagagttcagaaaatggttgagaaaatgcggacacacacccccacccagcttcaggcacctgaccctccttttccctatctggaagccaggaagaggcgagaaggaagccggccttgagtgggaccaagccagggaggcaggagtggctcgtgggtgtcactgtctgaaccccggcctgcagagggggctccttcagacctggctgagccaggcctgtggtggctgcccacccgcccttttcacagctgtggcaagagcgggagctgctgcttgttgccggctactggcagtgtcctggagccagtgtggctccacaagtcctgtcctgtgtggctctgggtcacgcctttcctgtgggccaggggtccgtgttgtcgagaggggagggcgttgttcaaggatgtctttttgcacaataacctgtgcaaaggtagctagaagacttgaagcaggccgggtgcggtggctcacacctgtaattccagcactttgggtggcctggtgggttgtgggcccaggtgggagaggaggcccgtggccttggagggtgaactcgggaagctccatcccatgagattagacaagaaaggccccgagtctggagggcagacaggttgctgtggggccagcccgcctgcccaccagggaggcgctttcttggtgaggctggtgaagccccaaagcccacctgtggttccctgaaacacagagggtccccaaccagcttccttgtttgcaaagtgggagcatcagcagtggagggttgggaaagttgagagcctggggtggcacgtgccccccccaccccctgccaccccatgcacagactaaacagagaaggggggctcgctggaggttgctgaagggccagcctggcaggtggttcttgggccagcggggaggggcacccagggtgacaggcggttctggatgctggtggaggatctggagatgggatgcccctcctggccctgtggacaggccggctgggtgggcctcccatctctgtctgagctgggggttccaactgctcagcctggccccagtgcctgatatggagtgggcagcgcttcctggctgcagctgggagggtgcccacagtgcacctgctggccgatcatggcatcccagttgggcctgtgccttcctctgcaaatgtcctcccttcccaagccccgtgcagctgcagcgtctctgtatgtgagctcccatgcgtggacagggaacaggtggttttctgcaagggaggaggactccacacacttccccagttcagggctggggctgattcatggaggatgatctggggcgagtaggatgggaggaactgacattctgggcagaaccagagtcctgtttcatgagttcggaaaagcagtctgcagggctctcccaggccaccactgctgctgccgtgtggctccccatggtgggtgctctgttttccttctcggggccccactgccttcctagaaaggctgaccctggccgaggggaagcctgtggcatagtgtgcccttctctttgccctctatgtcagccgggcagcaggagagtggggactgggaggcactttctgccccaatgctgaagtctgcgtttgttggatgtatggaacagccagcctcaccatcctgccagtgttgcccagtcctgggacttctcgggccttgatttccccttctgtgaaagggggttggggacaagacaggccaccttgcaagttccttccagccagcccacaagtcctgtcctgtgtggctctgggtcacgcctttcctgttggccaggggttggtgctgttgagcaggggagggcgttgttcaaggatatctatttgcacaataacctgtgcaaaggtagctagaagacttgaaacaggccgggcgcggtggctcacgcctgtaattccagcactttgggaggctgaggctggtggatcacctgaggttaggagttcaagaccatcctggctaacatggtgaaacctcgtctctactaaaaatacaaaaaattagctgggcatggtggtgcgcatctgtaatcccagctactcaggaggctgaggcaggagaatcgcttgaaccaggaggtgcaggttgcagtgagccgagatcgagccacggcactctagcctgggcgacagagcgagactctgttgcaaaaaacaaacaagaaaaaaccccaaaaatcagccaggcgtggtggtacatgcctgtagtcccagctactcgggaggcagaggcaggagaatcgcttgaaccggggaggcagaggttgcagtgagccaagatcccgccactgcactccagcctgggtgacagaacgagactctgtctcaaaaaaaaaaaacagacttgaccaaaaaaaaaaaaaaaaaaaaaatggcccggcctgcctatgcctaccttcatctcgccctggcctgggcacttttaattctctgggccctttgtctagtgccccctccctgcccctgcaggacaccgtgccctgcctttccctggctggtgtgtttggacgttggtttcctgttatcgcaggtgaggacttagcttcctggcccgccacgcctccctgacatggcctcctgtttggagccttcaggctcatgcttacatccttagctgatcattaaactttgtgaccatttcatgctcactgctttcttgcctgggagctaatggtgaggaaaggtcactgggaaccagcgcaccaacctcagacattgattttgttccagccttttttcctgggcaggggtggctatcacctgctggtaggcagcggcaggcccactgtcctgcctgccctctgactgcggtgtcggcgactgctgcccgaggtttattttgagaaagaaaagccgattaaagggccattaaaaaggtcttttgaagattacagcttccaatgaggttaacagagaaaatttcctccttcaggccgcagccagtcccgttctaaaatccagtcccaacaacaaagtggccatgtgacatggccactttgttctcctcccaagggctcagcacaaagctgggttttggcagcttcattgtctccgggcgtcaaagcaggttttattttgcagagcaccctgaagacatttggaagtgaggggtacccttgctgacccctgatcctggggcccctttgccgttcccaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggtgggcttggacctgtggtgggaccaggtctgcagggagggcgagggagagacggaggcttagcttcggccagctgtggctgagtggatctccctcactgcccccaactccagtgagggtgggggacagggcgctgcactcacagcaccaccttggacgcccagcctcaggcagcaggacttggctctgctgactgtttttggttgtcgggtgcttggggtggctcagctgtctggggggggctcggctgtctgtctcggggggcttggctgtctgcggggggctcggctgtctggggggctcggctgtctttctgggggagcttgtctgtctgtctggggggcttggctttctgggtgtgtgtgggatgcttgctgggttcccgccccagtttcagctgtagcagccgtgctcccatctatgtggggatgtgagggaggcactgttcctttagagacggcgttgcttgctcaagtggagaagctgccagtgtgggcagctccagctccctgcacgctctgtgctctgcccattctaacgtctgtgccccttcttctggatggctgccgggcttggctctggcccccctgttggatcccctggctgctgggtggggagagggccacctactgaacctgagggtgggtctgggtgagtcctggctctgctgccacctgctgggctctggaaggtccctcaccctccctctgggatctcattggattcctgtagtgtggggatggtggcagatactctggctgctacgtgagaacagtgtgccgatccctggggtttctcaaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggtcagcacctccagcctctgcaagtacaggggggtgggagggcaggggcttttgaggggcacgaggcttggggacagaggacccgcatggcttagggatggatggcatggtatgggtgctgggagggaggcaggaagagcagggctggtcccaggggcaagcacaaactcaggcctgttacacggccccagacctcactcagaaggggaccctggccgctggcgtgggtttcctcctctctgaagattaggtggtcttggctgccccttttgtatgaagtcatggatatcttttgagatgggggctctcgggaagaaggtgtggggtacattagcaccagcgtttcctgagtgccgcctcccccgttaatgtccctctccaggaaactggctttgccaaggcccccgctgggacagactgtttctttcactgcagtcctgggagccgagggcaaggggacaggaaagaggaagtgacctcagagcctggtggcaccagcatcatgtccaggctggggggtgagggtccctgaggccctggggcagggcagtgctgttccctgggtggctgaggccggaggggctctgttctcagtcccccatctcattgcggaggaaggagcccaagccccttccagcaggtgctttcctcagtgcccagaggtgctccccggcttctccatccccacgccgcagcctgaatgtctggggtggggccggtgtgggaggtgccggcctcttttccacctgccccactttttatcctgctctgtggtcaaggcctggccccgtggcctgtgagtgtgggggctccgtggcagaggttggggcggcggggtgtggagttcgggacacccacacatgcctgattgccatgctctgcatgggatgttcccagtttatctctgggcaccatactccaggtgctcggaagctgaagcctagagcctgctgggttcacccgagcctccacccgggggcccagggctggtcctcaagtttcctggcctggtgcctcctgagatggggagggtgaccaggccttccctaccccctgccctctgagatggggagggcgtccgggccttccctgacccttgccctcttgagatgaggagggtgaccagggccttcccccaccacccgccctctgagatggacagggtgtccaggcctcccctaccccctgtcctctgagatggggagggtgtccagggccttgcttctcagcgtgggactgacaggtttgccctgacctccacaggcatgaacgctgctgtccgggctgtgacgcgcatgggcatttatgtgggtgccaaagtcttcctcatctacgaggtaaggccaaggtgggctgtgtgtgtgcagggagtggggacctcctgaggcgcatgccgaggtgtgttctgtgtgggtcacactgggagacggggtggtcctggcctggaggagctgatgggtatgtggtcttggggagtgtgagggggagcttggggccaggccaaaggcatctgcagaaagaagacctactgccttgggactcagcccggctggaggctcagaggctgcagagcacgggcctgggggcagggaaggagctgggtggacaaggagtcgaggccctgcctacagtgatcgctgacgggccaggccccacccaccacacccctgcctggtgtcccccagcctggcccttgtcccgccccgaggcctctgtgagtgggggccagggacctcaccgcctctgcccttgtcctccccagcctcctgcctcaccacccagacccggggggcagccgctggcagcagctctgctgtgtctatgttcattgtgtccccgcaggagcagcggatgccctactgcctcagccccagtccccgtgggagatttggggctcgccctccgtcctgggtatttacacacccacacttgcgctcacacatgtgcacacacaggcgcattcacacacttgggccacaccacgcactcacaggctgcattcttgccttgtcaggtggttttccacattccacaagacaaggtcttttgttattttgttgccactttttatgtaatatgtagctgtttatataaaatgtagcaaccccagctctgcagccccaggcactcagccccacccccctcactgctcactgctcgctgctgaccactcaccgccctgggtctcagttcccccatcttggccccagggaacagcagcctgtccagccctccctctgcaggactgtgtgaatgaatgagtgagtgggcagtctgtgctggcccgtcctctccctgtggccaggctggggtggggctggggccctgccagtattggattaggaagcaggtctcagagccctggggagctgggtgtgggggcctctctaggcaggctgggctgtgtccgtacaaacccctcctgccacctgctcgaccttcagtttcttcttctaagtggcaaaggggagaaattagggttttccggaacccccacacatttgtggttgggaaagactcctgtggcaaaagacagaaaacaggttcatcggtgcagggcgtgtcctggaaaaggggagaagaggcactttgccgtgcctagagtcctggcttctgcagagcccagcagagaccagtgcacatggagaagccgaggggtacagggacgcagcgtgaggccctcggaggtgggggaatgcaggagggtgagtttatgggaaaaagaatgaagtgggtgggcgcgggtcctggggctgtctctgggtcctgagggctgtgaggggcatttacatcctgtccaggcggtaacaggaggagccttagtcttgggatgctgtgtgctgctttcctctcaaagggaggcaaggctgagagcttccctgaatctgctgcctagtgggctttagctcagaaacatccacatctaagaggcagattttgagatgagacattctgatatagcggcccagggaagacttcccctccgtcccatgaaggttcttggaagaatccacttgcgaaaagcggattaatagggcagaggtgctggcattcattgtgaataggcatggagaggtagggcgaagatgctgacctgccctcctcccagggaaaggggcatgggcagcctggatgattctaggggggtaggaattttttttttttttttttttgagacagagtctcattctgttgcccaggctggagcgcagtggcacaatcttggctcgctgcaacctctgcctcccaggttcaagcaattttcctgcctcagcctcctgagtagctgggattacaggcacccaccaccacgcccagctgttttttgtatttttagtagagacggggtttcaccatgttggccagcctggtctcgaactcctggcctctggtgatccacccgcctctgcttcccaaagtgctgggattacaggcgcgagccactgtgcacggccatgaatggtttttaggggattcaatgggcttggacagcatctgttagccctggtgaccacctgcccaagtgtgttggcagacacaggtctttcttcctacgatgacctcagtgcatggaaactcagggaggggactggccgtcactgttcctttctccagcagctatgggctttaggcagattcgggggcttcagggagcagctgcatcctgagcttggaggaggcagagggtcgagaggcagaagggggaggtcagggagacctgcggctgcgtcagttcacatcagactgcattttgggtttctgagcccccagcgctggcttccttcagcagggagaccgatcccttctccttggggctattgttagggcagaaagggagggtggccttggaggtgaaaacccttctcagttctgacacaaaggagggctcagaacaggctactcttatccccccaggcagagcccacagcatagcagggagggccctgagcctgggtccaggcctgcaggggtgagaggagggggcggggctagaggggaaggaggggaaggtgagctgggcctaggaggacagagacggaaacagagtgggtagaggggggcaaacagcttctagaagattccaagggtaggaggaggttgtgtctgtgagactgattccagcagaactgagccactggccttgtggggtctctggggactgctgggctggccatacctgcctgcccctccgcccagtggggcaggggcctggctggcgcctgggctctgtattggatcctgagttttgcagacagacctgtgtttggtggcctcctgctcaggtggggctgtgggtttgggatcattttcctgttttccttgttcctagctcagggctggtacaaccagagggggccaggctggcctggcctgagccggaggaagtagctctgtggtccctcagatcagcccctgagatggggcaggggcacctgtcccccagcccagctggtggggaagggaggctgtcaggctagaagcccgccatggccagagtggggatgttcatgcgccccgcagcgcgcactatcccttgaccccctgcctgcttgaggcacttgccctcctggcccccagggccctgacacctggttggggagaaggcggagggaggagcagaagcccacagctgagctggcatccgccctggccgaggaatggctgctccactgcctcacctcacggcctggagaaggctgctgatgccatggagggaccggggctgcacggaggaggccgcccttctcctctccacacccttagtgaaatgcagtcatgagtgtccctcccctcaaacaacaagaaagggctggccgtgcagtaggaaacgggcacgtggcacggaggctgtgcaggtgccatctgggaaatcccaggtagaaccgcatgagaggcagatccacggtactggatggaaggcccagtgtggccggcgtggcgggacgcggagcctggagcccctgcctggggtgttgccggccctacgagcgatggccactcgggtcccctggacccaggagctccctcgggtgggggcccgcctgtagggaggtgtgtgtgttctcagcttcccgctctggcgggcagatggtagcctgggctgttcacacggccgccacacagcaagagcacgcgccgcacaccccgccggccgcatgcctgggaggactccagtggggacagaaggagccacgcacagcagcctctgtggtgtcatttctaggatgttcagaacaggcagacctaggatgcaccctcaggagctggatggcgggctccgctggggccttcgggacgctgaacttgcctgtgtggatctgggtggggtgagggagctcagacaggcccctgcaccaaagcacttgccacaggagtcacgccccgggacacacggactcaccagctgtgcagagggtgtctggagccccctagggggcacccggaccctgttacccaggccctgggatgatggtggggcctcacagtcagcaccctggtcctgctttctgctggtggggtgaaaatcctgctcccagaccacttgctgccggccgccatggggtcccctatctcatgcctgccccactcttgatttcagggctatgagggcctcgtggagggaggtgagaacatcaagcaggccaactggctgagcgtctccaacatcatccagctggtgaggcctgggaacgcggatgcatgttgcacttggactcgcagacagacacacagagacagacctgcacacacagacacacacacagagacagacacgtgcacaaacacacacatgcagacacacagacatgcacacagacgcacacacacacagatgtgcacacacacagatgcgtgcacacacagacccgtgcacggacacacaggcgcgcacagacacagacacgtgcacagacacacacagacatgcacacatacagacacacagacgtgcacacagacacacagacgcgcacacagacacacacagatgcacacagacatggagacagatacacatggatagacacatgcagacacataaatacacagatacacacgtagacacacagatgcgcacacaggtacacagatacagaaacatacagacatatgtactcagagtcacacacacacgtgccccatcgcacagggactcaggttcaggccgaccctgtcatctgctgccatggaattgttgggtcgcagggtcatggggttgccaggggccaggaggacctggagacgtggccgtgctgggtcctgggggagccctggctgaggctggctatgaggggccacgtgagcgcacctggagctgctgaggcttgagccctggaggccctggccggttccctgagttggtacagggcctgtgtgtgcacgtgtgcacgcacatgtgtgtggcaacctatgcgtgtgtgtactgtgctttccagtctccaaagccttccactctattaccttggggcttcccaagcccaggaccggacggacatcatcctcctctttgtctctccaaggagagaggcccagggaggtagggccacctcaggtttccagagaccccggggcttctgcctctcactctgcagggtctgccagccccttgctgcccagtcctggggtccctctggtgatccccaggggctgtctgccgcctgccatctctcctgaagtttctggtctcctctgtgcagggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtgggtctgtgcccggcgcactgtaggccctggggttttgttttgccgctgctgccaggcgtgggaatgggcaggacagagggacgagggatccctgggtgccccgaggcagaggaggggctgtctggccgttggccggggaggagtggtgtctgccagcacgagctcagatgtctcccagagatggaggtcagtgctcaagcctgagggagggcacccaggcagtgcatggggctggtggaggccggtgttgctcaccctacgctgcgtagacaagtcttctctgtgtttgatccgagtgagattctggacatgcatggtcacagtctgcagaaatagagttgaagttggggtgacataagacacagagtcccgagattgctgcttggaaagtggcctctcggagccatgtctgttccatgtccctcatgtgggggaccctgatgtgaggccttggccgctctgcaaggcaccccagaggtcccccgtctgcacttggccccagcggatccagccatgctgccacagggttccaggcaggaggaggctgagcctggaactccggggcccctgccgggctgcacgcctgggatgcgggggaaggggtggcaggagaggggtctctggccctgtggtggggccagtggagcctcagccaggtcctcctgctgctcctggcccaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagaggtgagtgaggctggcgccggcggccagcccagggcccctcctccccgcacggtggtgaggtggtctcagggtgacggccatctgcaagggcagtggactctggtagccccagcatccaggccagccgccctcagcccccagctgggggaacgcacagcgggctccactcccactctgccaggccgcggggggcctttgtgcagccccttctgaggggcagctgcttgccctggggtgtgacgcccccaaaggaagtcctgggctggccaggcctgggcttggcaaatgaccctcagcctgggaggagatcagtcgaaaccagcccaaaggctggaaggatcccaaggtatcttttagctcagagcctgggcatgagaaggggctgtcccctgcctgcctctccatccactgggtcccttgagcaccccgcagggaatcgggctggcagggccgtgtggctggcactgatgcatcctcctgttccatctccacagccaccagaggaccttcgtgctggaagtgatgggccggcactgcgggtgaggaggggcttcctggcccgctgggtggcccgggtgctgctggggaccgcagtgacaggtgtggcatatttattctagggctcagttaatgccatgggtgtgagagagccgggtgggggccgggagagacagagaagctgtggcccagagtcggacctctgggtacagggaagctcccctcaacggctgggtgggggtcctgagcaggcaggcgctcgctcctccaggtacctggcgctggtatctgcactggcctcaggggccgactggctgttcatccccgaggctccacccgaggacggctgggagaacttcatgtgtgagaggctgggtgaggtgggtgccgtccagcctgctgggggccgcaggtgtcctggtgcactgggtagcgcccctggggttttgggaccagccttgaccaactcatctatcactcatgggttcatcagcagctgcaggtgccccttgggggcgggacacgcaaggagtggggggctacggggctgacctcagtgaggcacctgtggtcctgcccccagtgggcaggaggcggagagggtcactcaggctgccgccgccccaggctcagccccgtggtcagtgtggggagcttggtgaggctgcttactggggtgggactgctgagcctggggcggtgggaggtggttggttgtgagggagtggccccagcaaggtccagacggcagggctgtgggggtggcgaggccaggagctgggccagtggggagcagggccttcccctgagggcggtcggggcccgggggtgggttctaggctggaaagatgtgtcggaacgtggctgtagccacagggtggacaggaggtcccggaagcaggagagggtggggaggctgctgggaggccgagaccgcctctgggagggatgggggggtgcctggtggggaggggtgtgtctggagtgggggtgcctggaatgccgccctctggttcccttggggtggagttgggggctctggcctagaacaggctgacactgccctgtggaccctgagacccctcaactgggacaggtcggccccttggtggggtggggctcaatggtggaccagaggcacgggccattcaggctgtccttcgcccacacccgaccatgcagggcaaggccaggggcccccgtggctctagctctgtcctctgtgcgctgaggctgaggcaggaccactggaaccagccctgggggcagagggtgggtttgggactgacacggtatccctgtccccgtgtgaaggtggcagcgtcactcccatctgtgtggacactggttccacctccgcgtggctgtacagtgctgccgagggcagtgggagaggccgtgggtaatgacctggcttctagaaccttccccagtggagcctaggggccgggcggagatggagcccaacaggcgaggctggcccaaggtgcgggtcctatgaggggcttgctctcctagggcagggacttcccgggggttccggctccagtggtgaccttggccttagcttatgtctgtgactcacattgggccctcctggaagtggcctggatgcaaggtcggcccacctggttccttcctgctctgtgtgagcagctcaggccctcactgagagtctgtttccccctgtaacatgcgggttcccgccttgcccaccacccagggtgcactggggcagggagggtggcacagctctcctgctggacctgcagcccatcttccgggtgtctgacctcacctgcactggcgccacctcctccaggtagccctccactcccaccacacccgggccctgtctgagctgctccaaccctgtccctgtaggaggcattgtggcccgtggtgggcaaacatggggcttgtggctcagagcgagtcccacaaatgttggctgggtcattgaagtggacggccgaaaagctctttcagttcccagagagctgggccgcggctggtgtgtggtgctgaggcagcagcctgaggctggcagaggggatggtgtgtcctatgtgcaccagtgtggacccacagtggcttcagggtgcagggtgtccggggagccctggctggtgccagcgatgcggggcccctggttataaggatgagcagatggaagctcacaggggccccaggtacctggcccaggctagcccgggcaggcccctctgccctgtgccccgtggagctgcagccctgtgcgtcttcccgcctggaaggcttcaccagacacaagggcccagccccagctgtgtgtgtgctgggcccagccccgagggcccccttcctcccctgctgcccttcccaggctttcgggcagagccctcttgttcaccgcctccaggagggcggggcgtcctagtgggcccagcctcatctctgccctcgcgctccaggcctgctttcctcctgccgggtggggattgtgccctggcccatgtgggttgggaatggtggccccagggagggctcctggcacccgggggctgtgtccggggcaggtttccctgcctggcagctgagccctgtcgtgtctttgacccagactcggagccgtgggtcccgactgaacatcatcatcatcgctgagggtgccattgaccgcaacgggaagcccatctcgtccagctacgtgaaggacgtgcgtgtgggcctgggggtggccactgggcacctgctcctctaggccgtgtgggctggggctcagggctggtccttcccactgtcctgcagctggtggttcagaggctgggcttcgacacccgtgtaactgtgctgggccacgtgcagcggggagggacgccctctgccttcgaccggatcctggtaagtggccatcaccctgccctgcgtacgtgcgtgggtaagcgtggtgtgtgggtgtgggtgtgggcagtgtgcacgcgagcatggcacgtgcactgtgtccatgtggctgtgggtgagtgtccgtgtctgtgtgtgggggtgtatgtgtgggggacgcgtggtccttgtgggtgtgtctgtgtgtgtctggtccgtgtgggtgtgtgtggcagtgtgtgtgggtgtgtgtcagtgtgggtgtgtgtgggtgttccctcaagctgttgctcctcctgggggagactgaggcctggcttctccgttcccctgcaggtatagggaactcagacctggggaccatgggaggccccccaccagcctgtgcctcctggctgttctgacccccaccctctgccagcccaacgtggcagcagtcagggccaggggcaggccctgggagaggggctgggtgggcagagggtggtgcccatggcgcctgtggcgtcacagtctgggaggctggtgctgggagggagcattcggggtctggcctggcctcgccgtccttggtcctgatcaccgctgggtctcactttgtcctctgcaaaatgggaatgaagttggagccaaatggagtgggtctggggccaggaaggcaccatggtaggcaaaatgcctgtgtatgagggtggtcaccctctcaggcagggccagagactgtcagacaggtgggacttgtgctgagggagaccaggtgactgcgcccagccctgtgactgcacctggccctgtgactcgtgtgctgagccgagcattcccagggaacccacacagctggacgagggccactctatagaggggaggcttcctcagagaggggccccgccgacctagccaggcagctgctgtcccctctgtgaggcctcaggctcactctgaagagcctcttgaggggccggggacatcagggcaagccagccgctgctgagcctggggtgatggaaatgccgctgctgtgaccgggccagccatgcactcccagcctgcaggctgctgggttttccagccagtgtcttggatgcctgatgccgggtgtgaaacaaaggacagttgatcgcccctagccgcggctgtcacccagagcgtcagcattcttgtgctccctgagcccgtattcccactgggtgctgcgaaggggccaggggaccctagcacgtgcagtggtaacctgcacttttccaaggagcctcatcctgcatggggggtgtctccgaggctgctccctaaacagcgtcctggagagactgcccagaataaggtgccgcctgtgcctcacttgcaagatgaaaaaacctgtgtggaacacggagggctgtctgtggccccgggggtccagctgctgggcttctacagggctggccactggtggtcatgggacggccacggcaaccgcaggcctggctttcttgtccactgtggccggttcccggggtggggctggggcctgcctttgcagtgtgtccctggggggcagctcctggatgtgtcctctgcccagccctttggccggtgcggacacacaccagggaagtcacgacatgagggcctccacgggaggatccatcgcagcggatggggccctggggacctggctcccgcccttgccttgcgcgcctagcgatggcagcgagcgacggtgggtgggtcgcattgcatggcaccctgcagccagcagtgcaggctgggccttccagcagggcagcgaggactctgtgaaatggtgtctggtgtgccgtcgtgaatgctggtcagacacgtttccatctctgatgccacctgttctggaagcttccgtcagcgtggggggctctggaagctggggtttgcacatctacagaggatgggcatgtggcttggggtagagggaccaagtgggtgtgccagcctgaacccttccccacagagcagcaagatgggcatggaggcggtgatggcgctgctggaagccacgcctgacacgccggcctgcgtggtcaccctctcggggaaccagtcagtgcggctgcccctcatggagtgcgtgcagatggtaagccctgggccccccccatcagaaccgcctggcccctctccccagtccccactcacaggccccactgctctctgggggccccagcactgtgagcaccggagggcagggcctcgtggctggcccagggcatcccaggtctccagggaggggagggatgtgagcacatccctgggtgggacgtgggacctgggacgttccccaggaggtgtgtcggagctgcagggagcctggtgagcatgggaagtcacaggggtccacggccactgagcttctgtaggcagtggtgggagttggggttacgatgggacggaggaggaggggccagtgatcagagcagagccctgggaggagctcaggcaggtgatggggaacactggggtggctggagcagggaccccaggagaggaggtacggggaaggcagaggcgagggggccgggtgtgggggctggtccagccctggctcggtgggtttggaggcctgcaactggggcagagtgccctgcctggagctggagctgctgagaggtgaggagggcagctgggggcagggtagggcctcctggtctcagccagccccagaagagctggccttggtggtgaccgctgttcctagggagaggctgccaggcctgggccagggtcaggagatgccggccagatctgccctcgtcaggcccaccagacagggcagtagccatgggtgtgcgggccaggctctccatagtctgtgttctgtttctcttccttaagaccaaggaagtgcagaaagccatggatgacaagaggtttgacgaggccacccagctccgtggtgggtaagccccctcagcagacccctgcactcttacatggctgggtcccggtgccaggcagcatgtgctgcagtggcgctatgcacgcctggcctgggtcatccttctaggcaccgcgtctgaagatcgagggaggaaggggcctgcgggtggtacaggaggcgggctgggaggtgtggtaccacaggagaccctgggcggtggcacgggcagggcccagtgcacagggatctgggcatggcgaggggatgagaagctgtggatacaagcccaggacatggggtggccccgcgggggctgggaaggctggcagatgttgggtgtgggtaccacccccctgcaggcgtcctggcggccgggtcaggctggattggacgtctgggttcccatgcgtgcctccacccgctaccaaggtggccaaccctcccttgagctggatgccggccacgtgctttgctgcacgggctggcgtggcctcgtgttgtgttgggggtctcgcaccttctgtggaaggtgccctgcctggcatgcgcggtgtctgctgcctcatggctgagcttccatcgggccgtgtgcctgtgaccagcctcctgggctctgtcacggctgcgctgtggctgtacgccgtggcgctgcagggctgtgcatggtgtgacccgaatcccttccaggagcttcgagaacaactggaacatttacaagctcctcgcccaccagaagccccccaaggagaaggtgaggcagggagcggcgcccacagagggaggaacgggctcagttattctgcagcctcttcacgctggccccgtggctgggcctgcctgcccccaccttccctcctgctggggtccgagctgtgagctgggagggtgggcctgacctctgcctgggctcaggcaccactgtggctggcaggtcccgggtgctgggaccctggctgcagggctggctgttgcttctcagtggtggatggaaatgaagtcaggccacaggcttaactcaggagaggagaagccattgtgtagaaaatgtcccccggggccaggctcacacctgtaatcccagcactttggaaggctgaggtggccagttcacctgaggtcaggagttcgagaccagcctggccaacatggtgaaactccgtctctactaaaaatacaaaaattagctgggcgtggtggtggcacatgcctgtaatcacagctactcaggaggctgaggcaggagaatagcttgaacttgggaggtggagggtgcagtgagccgagatcgtgccattgcactccagcccgggcggcaagagtgaaactctgaaaataaaatgttcccaaacagctgaaaacctcaggaaatgggatctctccaaaataaggatgaaatggcttgtttctaaagtcctgggggacgagggtcctgtagagagagtcacggccagtgaggtcctggctcccaagccccttgagccacagccggagctgcaggccggggcagacagcgtggcccagcctgagtctggtcctcccttccatggacatctttgggtgtccctgctgctccagcctcctgcttatccccagagctagtcagcgggctctaccctccgtggtggggcaacctggtctccacgaacccagaacctggcaggggcgtgactggctttgtgggcagcagggctggctcgtaccaggacccagtggggccatgtggctatggagcccttgggtgtggctgctgccaagtgggatgtgctgcacgtgacaggtgcacgccaggttcagagcctcagcacggtgggtggaggggaggtggtggcggccgtcactggattcacatggatgtggtggggttttgggtccatcaggttaaattaactgtagtcctgatgggactgtctccatgtcttttcccttcccttaacgtggctactagaaaacaggatagccagggccccttccttactcgtggctgtgcaccccccaccctcccgcccgctgccagccccttgtgtgggcactgacctgtgttcccgcccgcaagcctggcttcacaacagtgctcgccccttctgcctcctctgttgcctgcgtgccagggggccaggcttgcaccgtgtctcttttggtcttcaccagaatcttctggaattagaacagataccgtattcccagggcagttgggcggtgtgctgggcagcgtccaggctgctggcagggcctggcccctttttccagaacctgccggcctgctgacctcctgtgcaggttgggggtcccctccccggctgtgcctcacgctcatctccccttctctctgaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgggtccggccggggcaaacaagtgaggacttgggccttctgtgtgcacacttggggcatttcctgtggaaggccggctgctggaggtggaggctgagacctgggtccgcgtgtcggtgcccacccgggcctgggtactcagctctgcctgcagcgtgatgcccaacactggctggcccccgggcacaggcccacccctggggggaattggccagaggctcaggctggcccctgaagctgcatctcctcctggcaggtgcaagaagtaggctggcacgacgtggccggctggttggggcgtggtggctccatgctggggaccaagaggtgagctgcctgctgcgggtacctgggggcaggagggccagggcgcagtatccaggccctgcaggtgggggcggcaaggggaacccagcccggggccctgggctcggcccctcttcctgctggtggtctgcccagagcaggcttcacgcctcctgcctggggcttcctggcctgagctccgctgtgtagggcaggctgctctggcggccccatgcccatggtgggctctccgtggcaaggaagctggcgagcgtctgtccctgcctggccaggccaggcagcctgcactgtcagcactctggctgaggctatgggcctgtctgatggcttttgtcccagggcctgagacccttctgtgggcatggggtgggcacagtccccctgtgtgactacaggggaagttgctgagtcctgagccactgagtggctgcaagggccagaggaagcatccgctcctgccgctgagtgttgggcgagaaagcctcgggcaggaaggggttcccacggggagcccagcggggtggggggttcactcggttgcctggccggtgcctggtgatgctgagtggtgcccaggcggctcacgctgggcctgtgtgtccctctccgtgtggagccacagcgccacatcccgggcattgcagcgactgctgactggctcggggaacggccaaggcaatgcctttctgtgatcagatgcaatctggacacgcgtccccgggtgctgcgtgttcatgcggatgtgtctttgactgcaggaccctgcccaagggccagctggagtccattgtggagaacatccgcatctatggtattcacgccctgctggtggtcggtgggtttgaggtgagagctgcccacggacgaaaaagccccagggcacaggagacccaaggtgtcctcccgccgagggggcccatcctgaaaacccgtgtgctggctgggccgatgcaggggccgagagggtcggggttttaagtgctgtgtgtgggctcgggagggcacccgtgtgccagctgggctgatgcaggggccgagagggttggggttttaagtgctgtgtgtgggctcgggagggttctttactttctccggaaagcttcacaaggttccgattaaccccagtgctggggaggggcaggggaggaaggggactcggaagctggaggacgagaaagaagggaggcggaggaggcagaggtgtaggtgctggacggcatcgctgaacgtggtgtcctggcactgggcaagctgtcactaaataatgaataaatgacagcccttcccccttgccctccatggagtggatctggggtcagagtgggttggaggagactcctgaccctccttagagtccagtttccctggtaggcatcctgagatgacaccaggctgactgcctggcccagccccaggggattgagcaggtgggtcctggcgtccagcacggggcacatgacaggtcagcagggagcagggctgggcggccgccggcagagcctgtccccggcccaccctggcctcggtgctgcccttgacctgccccgtccctactgctgcaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggaggtacggggctcctggacaccggcctgccatgcccaggcccttgtggggtggggctgagcctacggaggctgctggaggggatagtgtgtggtgagcacctgggagggctgccagggttggggtttgtggggcacaggcccgggtgaaggggctcagctccctgccatagccacttccaggtccaggggggccctgcgttgttcctcgctactgtgatgagctcagatggggagactgaggcgggaatgtccctgcgccccagtgctgggtagtctaagagcagcgcctggcctctgtccaagggtgccagggacacccctgcccactcacagccagtgtgtgtgcaggctgctgtccactgtgccctggggggtggggtcgcctggttgagaacccctggtcctgtggggcccaggtgggaggtgggcccaagcctggtgctgctggctgtctgggtgcgtcagccccaggctggctttggagacacagggctccctgcagggtagccatgccgacggcctacagggaagggtgggcacgtggaggacccccgacccccccttgtcccccagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtgagcccagcccagcccctgctgcggcagacctgccggcatgccagcctgggccccagacactcaggccggccagcgcagggcagggcccgggcaggtgggacgcgtagcccagtgctcctgctggccccggatcgccggtcagcctggaattccctccccacagtcctccggctcatccgtgtccgcccctcccgcaggtcaacgtggagcacatgacggagaagatgaagacagacattcagaggggcctggtgctgcggtgaggctgccgtgggtccctggccacagctgcgcgtccaactctcggggctggggtggggctgctgaggagcggctgggcaggagaaggcaggaggggtccttggagagggtgggccagggcggctttcctgggagctgccactccctctcccaggcctggcccagcggggactcaggatcggggggagacctgaactcgttcccgccgactcaggccctgctgcccctctcaggaacgagaagtgccatgactactacaccacggagttcctgtacaacctgtactcatcagagggcaagggcgtcttcgactgcaggaccaatgtcctgggccacctgcagcaggtgtggggcaggggtgaggctctgagaggcctgcccctctttcctgccaccatctgtccccggccccaggggtcccagccctcacgggcacccacgggcactcccggcaggccctcgggcacgtgtgcccttccccagtgaggggaccgaggcctgtatctaggtgaggtctcatttcaagaaggggtggggctggggctggagccggggcccgagccagggcattcacatgctgagccgagctccccacccctgccaggcctcccgcggccacttccgccgaacccctcacctagatccccgcatgctccctgccttatggtggccctgcaggaagcccgcgtcctggggttttctgagccagggaggggagtcagggtggctgggcatggggcccgaggtgatggggcccgaggtggggccgctggctgccgatgcagggcccaggagtcacttgacttggccaggggcagccgactgccggcctcgggaggcagcttctggcctggacttggagctggagagagcaggcagggtcctcgatcgggaacagacgggaacggtgcacgggttggaaggaatgggtgttcacaagctgcctgggaggctccccgtggggatcctgtctgcactggcgttggccttggcccaggcagcccaggggagtccagggaaccgggcctcacctgtttccagggtggcgctccaaccccctttgaccggaactatgggaccaagctgggggtgaaggccatgctgtggttgtcggagaagctgcgcgaggtttaccgcaagggtaggtggtgggtgcgacccgaggcctcactttgccctcccctggctccctggggcagggcctcaccatggagggctgccacgtgcctctgtttgcaggacgggtgttcgccaatgccccagactcggcctgcgtgatcggcctgaagaagaaggcggtggccttcagccccgtcactgagctcaagaaagacactgatttcgagtgagttccaccaaagcctcgtggaggcgggtggggctgaggggtggcccagaccttccctgaggcaggtgtgccaggcccagccccactggcaccctgaccccgcaaggcctcctgggcccccatgcccaggtccccgccaggccgtggagagcagggaccatgcccaagtcttctgagcacaacactgggcaatcctttcgggtgggcatgggggcacagcgggtagccaggagtgggcacgcttgagggcggctgaggctgactctgtgctgtgcctccgagggatggggaccccagacctgtcccagctccacggataccgagatgttcagacagaggggcatgcacaggctgcagggtcggggggggtgggggggctggggacgtggctgaagagctgccctgacccctgactccccatcatcctcccatccccgtcctgcacaggcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagcacagcctgcagaactcctcagagagaggggggagcagcaccgagcggccagcccagtgggcagcagccccaggggtggagggccctctggccagtgcctgggccaggtcaaagggacatgtgccctgagaggccacaggtgctctccaggactccctgggggccaccagggtgacctgagcccctcctggtcctcccctgggggcagaagggtacagcctcactcctctgtctccccaacctcagcctgagtgggggtctccaacctgcaggctggtggctggcttgagccagtatccaggagacattgatggtggacacgcaagaggggaaaagaaggcagcgcagagctgcgcccaccaggggctagggctgagtcctgcaggcggctacggggtggtggacgccctgcttgcaggatgcctgttaacctcagcgtcgaagcctgcgctctgcatcatgaacgtgggaggtgcttgcccaagagggctgcttcctgcccgcagtgccaccctggggatgtggttttgggacacaggaggtgtctcaagggagaccctggcttggaggggcctaagggccactttgagggcccctgggcagtctcctggttgagctcaggccagtggggtggcctagggacctggtgaaggggctggggaccctcttgccctcgggcaccttgatattcccaagagcccctcactgtgttggccctagtgccggaggcctccagattgcttaactcgagctggggtggaggggcccacacctagtggccttctagttcattctgagctgggccatcctggggccaggcccaggagtggacagttgtccaaggacagtgctccggggtctgcagctctgtctcaaaggaagagagaaacaggttcataggcccagggaaccacacaggcatgctctgggggcctccgttgtgtcacaccgtctgggatcaggactcagttctgagtagaccccctcggcctgccctgcctgatgaggtgttagaacctgttcagctgccactcagctgctgcacccaggtggtcgcctgtggctgatgcccgggacagtggctgcctccctcctgggcgacgtggtgtggcgagcgcctgcgtcaggcccacttctggctgcgtggagttggcgtttctggcatttcgggcagagtgacgcgacctcctgggcccttggtcctctcctgtgaactgggtgaatgggacagagtgtgatgccagtgctgctcggcttgagaacccatttttggggtgacttggggaggagtggagtgggactgtggggtgccccgggctggacgtgcttctggctgtcctccatggctgggtgcattgggtgaggaggtgccgggaggggaacaggcaggaggcggcaatggtggggacggggtagggggaaccgtggggctgaaggcaggcagctgcccccacaggtcccacccaaggtgtgcatgatgtggggcaggagggcgctggtgtaagccccgcatgtccacggcagcccatgtcgggggaagtggaagggactcaatttaaaacgacctcaaccattccaacaaagcgctttactgagggcacccactccacagtcccaaggaggcagacacaggcctgaactgtccaccctctatgtcccgagtggtgactccactccccactgctcagagatcacaccccttctggagagcttgcatcccttctggagagcttgcacggatgagtgactgtcttcaccctgggcttccccaagtccggcgacagtggctgccccagtgctgcagctggctctggtgacggtggcacggcatggccccgagcttgggagaacagcggcctgcacacacggtcacgcatcaccgctcggcggaggatgggaatatctcatggagatctggatctcaaccccacatgggacaagggcccagggacctggctttcctacacaccagctggaaggctgactccccatctcacgtg

SEQ ID NO: 16968 - DNA, 11726 bp, Human
gctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccaccgtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgttcctgggctcaggacccaccgctccagcctctgcttctgtggtctcacagctgtctcccacgtgtcctctttataaggacaccagtcattgaacttatggtccagtgtgacctcatcttaactaatcacatctacaaagaccctgatttcaagtaaggtcacactctgaggttctgggtggacgtgaacttcgggggacgctgttgaacaccctggtgtagatccaggacaatccccgggccccagactcgactggggtgggggcgggctggaggaatgcaggctgtgggaactccacctgtctctgctagaccccaccctggggcctacacgactgccaaggcaggtcctgctgggcgggtgagccaggaccagccggcatctcctcccaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccgtaagcacctgaccttccctggggagcctggctcttgatgccccccgccccaggaacagcgttgcctctgggggagtggctctgctgggggctgggggctgctgccgagagacgcctggtgccacagccatgtgcaccctcgctgctgaggctgcccccattgctgacgcccctcttccttgcagggtggaggtgaggctaggctgggccagcagggcagcgttcccgcccctctggccctccccagtgacccccagctccaccaggtaatgccctagaccacaggagaggcccctgtctgcccttgctcccctcgggtgggtcctgctgcctctgcctttacctgggcactcagggatgagcaccggggcctgagcccctacccacagggtacagctctttttctttaatagacagtatttttttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcagtctgtgggaggaagagctctgggtgcagtggggacccacgttcaggcgaggctctgccccagcccctgagtggccgtcatcaggccccctctcagccttgtgcctcatcactagaataaggggcacagtgggggtcattgctcggctcctgaagccgttcctccttgccgtctctttctgcccttgatcacctccccattctgctgggtgccattccccttaacaggtgggtcagtttagggaggcccccggcagggcccagccctgagaggcaggcaaagccaccagggctcgcaggtgttggggattcctggggttcatcagagagcacgccaaggggaccctgatcacgctggccagggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctggggatgggactggtcccgctgtcctgcagcctgcgtggcaccgtgaggctcctcacttgcgcctagacccgccgtccagccctgggtggtcccaggggagagcgcacagggctcgggttcgggttcagctacatttcccccggccccccgcgtcaccccgcgctgttgcctcccacagaacctggctcctggtgcgcgttgcggggtgtgcggagatggtacggacgtgctgcggtgtactcactgcgccgctgccttccactggcgctgccacttcccagccggcacctcccggcccgggtgagtgagcgtggtcggcggggaggcctgaacccacacccacaccctacaccccaccccacactccccacccacatcatacagcccacaaccacaccccacccacaccccacactcccacccacaccttgcaccccaccccacacccatgccctgcacccacaccctacactccacagccacactccaccacacccccacccacaccctactccccacctcataccctgcacctcaccacactccacagccacaccccaccccacaccccacactcccacccacaccctacacccaccccacaccctacacccaacccaaacccacccaaacccaccactcccactctccacccacacccacaccccttcctcacaccccacacccccatcccccactcaccacccacgcccacaccccacaccccataccccggaggtggcactcctgctcccccccagggctggcagcccctcatcctctgctgcaggacgggcctgcgctgcagatcctgctcaggagacgtgaccccagcccctgtggagggggtgctggcccccagccccgcccgcctggcccctgggcctgccaaggtcagtgccgcaggggccctccatgcatgccggtgctgggggtggggaaccccttgggttggtgttgggggagcacatctcagggcagaccctgggtgccagcttcgagggcttgcaccagacgcactgaccatgtgctcattatctgtagaaaatatttcccctttaaaccaattctttttggcaacttaaatatagttaaaaaggaagctccccccgagggttggtggctgacgtcacggttggctgtgtggccgcctcacagcatgagcctgagagtcctgccagggctccctggtggggtgaagggagagcgggagcgcccggcctgcaggagcaaacccccaccctgtctgacccctccaggttgtctcacccccagccctccctggggccaggatccaccccactgtgtggccagagccctctcagagaggcaaagtgaccccgggtccagccagtagctcttcctgtcctcctgctccggggtcagagaggacctgggtggcgcggagacccctgactgctggggcggctgggcttgccctggagctgggtgtgggggaggcccgagtcgctgctgcaggagcctccgggggggtggcctcttgccctgaccgtccccagcagaggcctcctgagcacatcctggccaccgaggagcctttagggatcctggggtgatgacacgtcccacctgctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcgggggtggcatggaccaggcactttcctctctgggcctcagacttcccctctcagagtgggactccttgctggttccctgagctccctcgttttccccaggaggccacacagtgtggaggctgtctgggggccgtgggcagctggccgtgggcaggaccctggggaggcagccccagccccatcatgcccacgcagccctgtgcccccacccccagtggagctgggtgtaagaattcccatctcagtgtgggggaaacacccccgcggcccctaggccctgcggcctctgtacccccaccagggctgtgggagttgggctgacctcttctctttactgggttccaggatgacactgccagtcacgagcccgctctgcacagggatgacctggagtcccttctgagcgaggtaacgcctcccctggcctcctggtgctcctccactccccctcccctgcctcagccggcacccaggctccccactctgggggaggactgccggcccccactgctcttgagccgtggaaactcaggctgtccctgctccacccaccaggagccccagtgctgctgagcacctggcaccccccacaggagcccccctagcccccttgcaggagccccccccggcccctccccctgcgggagcccagtgctgctgagcgcccccagcccctccccaacaagagcccccacacggcccctcccctgagggcctgcaccctggcaggcagaggctcgagcaccaggctcaagatccactttcccagggagggtggggcgtgggagtggggggggggtcccagaccccgtccctctaagatttgcttgcccctcccaactcaggcctctctacgctaagatgggcaggtagaatctgtggggaaaatgtgacttttaagggctctgtctgtttttgccaagaggataagctccttcagcctccacgggttctcctcagtgtctgatgtggcacccgggggtcccagctgaccatggggcaggggttctgccctgtgcagtggccgtgccccacacaccctgaccgtgcaggtgtctgcagagccccagggcctgagagtgggccagggggcccagcgctgggtaatggagctgcccctctggatggggtccccgggtatagctggagaaatgagcgacgggctcacagcctctcccgggtggcggtcttattctgctggcatcgtggggcccgtggccccatcctgtgggagcatcaggctcctgagcagaataagtagctggccccgacccccccaccctgaaggagccacccgaggaggcagaactgccatgaactgccatggggatgtgccctgggcttataggatgtggtgaagtacacaggacagggtcctcggtctggcctgtgccatggggaccttgggcctcagtttccccacctttgatggaatacggtgaagtgcacaggacagggtcctccccagactggcctgtgccatggggcctcgggcctcagtttccccacctttgacttagagggaaggttggatggtgacttcttgtaacgatggccatgattctgtggctgcggcgggggcgcacctggaggttctcaccgtcactctgtcccgcagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcacatggtaattatatttttaattttttgaagaactgccatcctgttttccacagcagctacaccatttcacatccccaccaacactgcatgagggttccagcctccccatatccttgaaacaattactattttctgcatttttctttcttttcttttcttctttttttgagacggagtttcgctcttgctgcccaggctgcagtgcaatggcgcagtctccactcactgcaacctctgcctcctggcttcaagtgattctcctgcctcagcctcctgcatagctgggattacaggcgcacaccaccatgcccggctaatttttgtatttttagtagagacggggtttcaccatgttggctgggctggtctcgaactcctgacctcagacctcaggtgatccaccccccccccccccccaccccacgggcctcccaaagttctgggattatgggcgtgagccactgcgcccagcctgtgtttttcttttatagtagccatcctaatgggtatgaggtggtacctcattgtggctaaaccatgtacgtttaagaatttacacacacacacacacacacacacacacacacgtgatgaagctgtaagaaaagggagagaataatgacccaaaatgtcagcacaaggatgcctcaggggtagacacaggtgtcttcttagcgccttttagcccacgcatatgtgcttgcgcagtctctcggtgtgttttctaacatttcacaattaaataaggagtagttgatattcacagccaccatttccaccgtatatgtagagaaaaatgctcaaatcctagcgatcagcccgctgagctttcacaaaccgaacacaccgtgcggtcacgaggcggctctcccgaacaccggctctgcacccccagggcccggggaaccaagacttccccaagggcccagcaaaagtgagggaggaggggaggaaaggagggagagggagggaggagtgctggctgctttccgccagcgcctcgtttgggtttcgctctgctgaggcctgaaggcgccctgagggcccctggggggcagggaggggcggtggctgcggccgacagcaaggaacctccggagaagcgaagccgggccagacgtgccaccggggcctcggcgctggcgaaggggcgcgtgcggccgcactggggccagccccgccctggtccccggccacatcctcgagaccaccggggtggaggggggggtctcactgctcagggcccgcgtgacattgcacaggtttagaaacgcacagcgggaaggtggccccggcgggccgagggcgcaggatccctgctccgtccagggtccgtcctgcgaggaggcg

SEQ ID NO: 16969 - DNA, 11726 bp, Human; identical to SEQ ID NO: 16968

SEQ ID NO: 16970 - DNA, 16365 bp, Human
gggaccatcgccaggtgtggcgaccctccggaggggctctggccatttgggttctttaccctgtgctcgtggtaggccacggtttttcctgagctctggttcctccgtccattcgatcccctttggctgtgtccttcagaaacctcttggcgttcggtccaccagcggtgtcctttgtgtccccacagctgcgacagagcctttttgcatctttgctgtcacatgaaggattcggggcaggtcacagtgtgggagacagacacagcatgaattgaattcagaccaccattgtcttatagcctggctttttaaaacctaatgtcatctgagcctctttttcccttatccatgactgtagtcacgcatcacttcgtgacacagcaactggcgtaatttcgagcggtaacacatttgggttctgtgtctcatgatttctaagctgcgtgtttctcacttccacaacactgaagcgggctgccgtcatccacagcctgccggagtttagtgtgtctgtgctacctacggtcgtgttgttttatgattaacggtgtcttggagtcgataactctctgaaccctgcctgccctagggcacttccagggccagcaatctgtgggctctgaggcgccacgtcccctcggaaggggctggttgcggagccccctcccaggaccgtctgagctggccacccacctccacatcctctgctgaggccctgggctccaggttccagaaggaagggaccacaccttatgacctgcctgggactggggctgactctcagaccctctccccgaaagacttcagcagccttccccctcctaagtgggggctctagccaagaaagtgaatttttgagtagaagacggtttgtgaagttatggtccatgaagacttgtctccatggctttgcgacgttgctcagttggctgagcctttcccaggcaggacagaaacggctcagacgcttaggttcaaatccaggccctgccatttcccagctgagcctgaagtgcggcctcccccgccttcggccgggctcaccatcagatgagacctccgccacgccccggctggcaccacccgggcactcctgagggacgcaggggtgtccgccctcaggtccgttccatccgaggccctgggatcacagacatggaggccggggcgggccaggcaccccaggaatggcgcccgcaagtccggggaggccgtcctgccggcccagcgcgtttcccgcgtccacgaggtccccgttccgccggcactggcggcgtccagcctgggtttgcccgcgctcgccgacgtggcggcctggccaagctcggcgccgctcaccagcgctgacctgggggtggtttgacctcccagtgcctcagtttcttcacaggtaaaacgggtcttcttgaggacgggtgtggagggcccggggcagccccgtaggagcgttggccaaaggagcccggcctggggctgacaggaaaccgcggcggcagggaggcgggtggcgcccccaatcgtctagggtgctggcccgattcgcgcggcccccgcggacgggaccccgcgggccgccttctccgctctgtccgcggctcctgagagggaacgtcacccccagcgtcctccctcctccgccccaggtccctgcggccatgggcggcggccccggcctcacttcccggcgccccaggaacgcggcccccaggaaaggagtcggggcccgggcgacgcggggaggcgggcaagggtccccagggcccgggctccccgtaaacgctcctggcccgcgccccacagcgccctagggcttccgcgcccgacggggtcgcgcgggacccgccccgtgacgcatctccaaccgcccagagccgcggcccggcctgcgcgcgcccgacgccccggggagcgcgcctcgtgaacgcgcgcagccacgtgacccccgtgccggccaacgggtgcgccgggatttgggggataaagcgcggccccgcgcacagttgcggcgggagagcggcggggccgagagcgtgactcgcccgctccgcgctgcttcccccgcgccgcctccccgcgccgctcgcgcagccatgtccgaggagaagcccaaggtaagcgcggcgaccccgcctgcacgcgcgtctatcgcgggcgtcccgcccccagcccggctccgcccccaccccgactccgccccgcgtcccgcccctgacaggctccgcccctccccgccctctagagccccgcccctaagtgggcccgcccaaggtgcgccccctctgcccccgcgaagcgcgctgtgccgcgagctccgccccctccgggcctggccacgcctccgctccacgcccgtctcctccccagctgggaaggcgcgcgcccagcgcctccttgagcgcccggtgtcgggccccgcgctgctgctcctgcagagcgcggcgccctcggatcccgccccagcagtgtccccgaagcgtctttgcgtgctcctctcctgagtcattgctggttggggtcgccctctcccccggcatcgccctgggtgcgggatcctgtgtcgagtgcacggagtcggctcgggaacaagcgtctggggttacccccaaggggcgcgctctgaggggcctggcccctgtgagcagcactgccgtccttccagggcgcccatcgcgaccccggtattcacccacttctccgcatcgtgtcccggccatcgcgtcccccagtgtgcgcccacccctctccttcgtgtctccccaatcgtgccctcagtgtgcacctactcccacccatcgcgccccgtgtgcacccaccgcctccatcgcgtcccccggtgtgcgcccacccctccccatcgcgccccccggtgtacgcccacgcctccccatcacgccccccatggtgtgtacccactcctccccatcatgccacctggtgtgcgcccacccgtccccatcatcgcgtccctggtgtgcgcccacccctccctattgcgtcgccctctccatcacacccccagtgtgtgctcacccctccccgtcgcgtcccccagtgtgcgcccacccctatccatcgcgtccccctttccatcacacccccagtgtgcgtccacccctccccatcaccccctccacgatgtgcgcccacccctccccatcacgccccctatagtgtgtgcccacccctccctatcacgccccacggtgtgcgcccacttctctgcattgcgcctcccccaccatgcgcgcccacccctccttatccagccttgggtgggctttagtctcccccattgccatgctggggtgtgcctccctccagtctcagtcctggggtatgcaccctgcattcaggtgcactggccattccttctcgggagggtctgtagtcgcattctccagtgttcataaaaagagaacctttccgaagcccttggtgtgcactgtcggcctctatgttacatcccagtggaagatgactagagctgaaggctctgtaaagaggctgtctctgatactggcctggtcctggaggtgaccaccctccctttacagatgagggtggaggctcagtgccagacactggcgggaagtgggatggaaccgtcaggaaccatggtcgcggcctctatggaagtctgcactctgcttgctgtggtcagactccagggaaacctgccctatccagatggcatttggggtgacctttgctttttacattttgactccagtgaagtcaaagttctcccactctggggttgtttgaatatttaaatacttgttaaaactaggtcaaatataaatgtcctttatgtttttgtaggtggcttcctcttaatgaagagtaaatgtaataaaatacatatgatattaattttctcagcagtatttacacttagctctgccatgtggtcaatctcaggctccagttccgttgaaaacacttgtttaattccagaatgactgagtggctgccacctcacaggccccgcttctggtgggtcccctctgagcccatgtgggagcagctctgccctctggggctctgacgaaggggaagaggtggactctggggcccggtggtgctggaaagaagagcttttaggtcaggcaggagaatggttctgacttccctggatagctgaggtggaggattgactgtagcaaactgaggcccatgtttttagggcttcactttttaactcacgagttcacttgcttattaggaattcaccaggggtctgggacagatcgtcattcctggtgtccatctgtttggagcagaggcactgtggccggccctgccctgccccagcctctcccggggctgcagccattccccccggggctgcagccattaccctgtgggggacgtctgggccctgcatctgtgcctttgaacacactcataccttccttccctaaagaagccagtgcatcctcatgcttggggaagtgaagggggctcatgcaggggtccccacttccatcctgcctggagctgtttgcatgctcttccttcctaggccagttgtctctgtgctggaggccacattcgggatggggagatgggggtgtgccagctcaccactcaggctgccgccaagccactggcatcccgggagtgggcaggggtgtctggcccaagactggagtcggggggtgagtgccgccccaggacacgcaccttcaggctcgcagctggagcccctcactgccaaggccccttgcaggccactctagctcccttgacagagcaccatgcctccccagggtctccccagggtgcataccccagggaagcaagcatgggtgcagtccctgggttcaccctcaggcgagccttctacatcccactccctgtatttaggcatcgctgggacagttgtccctctcccagccagggaaggaaaggagaagtggagagaacaggcgtgtgatgtacagtgcttcctgagggcagcagctcagcatggggtgaaagggtaccaggacgccccagacttgactttcagagtgagccggagggccctgcctcattgcttcactcacaaacgactttatcccagcagtgcaggccggcagaggggtgccccacttttcggctcagactgagctgccccgaagttggctcccagtctcttgacatcagctttttgcctcaactcaaaatgcattttcaggcaacaagacaccccgattgtgccattgttgagtagcttcaagtatggcatgaattaaaaaataaaatagtaccacctactgccgctcagataggacagtttgaaaccagaaagtactcggaggtggcttccctcacatttgctgatgtcagggcagcgagaaggagcctggccgcctgctgtggggagtggccgtcctcagttggattcccgaaatcaccacttgaatgtcccatagggttcctctgagtcacaaatgttttcttctgtttttggtttcttttactagtgctgtatagctgcatgacttttggatatgtgtttttactggtttcataagaattttttaaaaaagagatggggtcttgctctgttgcccagactggtctcaaactcctgggcttacgccatcctcccacgtcaactcccaaagtactgggataacaggtgtgagccactgtgcccagcccacaagaataactttaaaataaagatggattttctcttatttttccctagactttgtttttttctttgaattaacaatgtcagaggaccctaggcttgcattgttttacacatggatgcttaacaagtggaagttaaaaataaattctgtgtaaaaataaaaccatcacgagtgactctgaattgctggagaattttaagaattaggttggttttgatgactttaaaaagccaacaattacctaaagacttgcccattcaagtcgcggttattttgagacacagttttgaggccagtctctggtgtcttctgcaggagggtgtgaagacagagaatgaccacatcaacctgaaggtggccgggcaggacggctccgtggtgcagttcaagatcaagaggcacacgccgctgagcaagctgatgaaggcctactgcgagaggcaggtgcggcaccttgctcccccgcagagcctccccgtgtgcgcactggtcctgtgcgttccaggcatccccagagcacgagcgtctcggggctggacccagatgcagctgcccgaggtgccctcttcgtggatgggcaggcgggggcttgtgctgtaaaattagtccaggctgggcttgtcccccatggccttttataaggtggagggacctagaggctcggagaagtgtggtgggtttttcttcctgacagggcggctgcccggggtgctgtgttctccatggggtactaacatctgtgaagtctgtgatgctgaaggctcttgggggccctgctcaggtctggccattctggggctgcaggtggcgtgtgccccacgccgctgtcaccctgtcctcgcgtatgagctggcctgaccctggagagacactgccctcatgtgcggtgtggttttccattttgttaggaaaggcaagaaagcgcgtgattctttccccttcttccccagtttcaggataatgagctgccccactggcagtgcccagctgggtggatgccttctggctgctgtttgtgacgtggtgtgtgtgtgtctgttgttcttggtaacgctgtggcggactcaccctgggccagggggtccctctctaggccacttttatgggctttgcccaccagctgctgcctggtgtgttgggggcccggccctgcagccaggcgcccttccccagggagccctgcttgcctgagtgggacctagaggctgcttttcttcagccgctttgaaaatacagcaactcgttgcccttttattttactcttttgcctgtggattttcagttagatttcctcctctttccctcccactttggataccctgctcataggggcagtcactggcgactgccttgcattctttattggcaagcagcccctgacttcctttctttgtgtttgctgagggcagatcttattttcacctgcgaaaggtgagactgagcttccagacacgcaggtcccggtcttcccagcagagtgagtggcctggcgccgtgtaggccccgtgatccagcctctgcctgatgctgggccctggcccttgctggagtttgtactgcctgggctcgtggccactgtgtgtgtgacttcccgggtgcccatgttctcctctgcgctgcgggatggcaggcgtgtggggccgtgtacatgtggggggggctctgcccttccccctgctctcccggagctcccctcctgccccacctgcactgctgcttgtgaggctggctgctcagccgtggtccagggcctcctgttcaaatccttctagaaacttgggttctctcttgggtgtttcctggattagtcctcctcccttttgtgttttgtggtggagcacatcctccagggtcttgtcagaacgggcacagaagggcagcgtctttgagacactgcatggctgaacgtgacttttgcttttataaaccttcacacttcagtatgtggctgcacgtaatattctcggttgaaacttttttttcttttttatttcagaggtcagccatgagaatagctcccaatgttaaaagtgaaaagttcaccaggcatggtggcttatgcctgtaatcccagcactttgggaggctgatgtgggaggatcacttgaggtcaggaattcaagacttgaggtcaggagttcagtgccaagcctgggcaacacagggagaccctgtctctacgaaacattaaaaaaattagccaggtgtggtggtgcaagcctatagtcccagctactcaggaggctgaggtgggaggattgtttgagcccaggaggtggaggctgcagggagctgaggtcatatcactgctccagcctgggtgacagagcaagaccctgtctcaaaaaaaaaaaaaaaaaaaaaaaaaaggtgagaagttcagtggattctgattctctgtgctttgtttgtaacttggtttttccctggaagtatctgggaccatattctggcattcagtgtttccttatgtgcctcagaggtgggtgattttctcactcatgctgctgggcactttatgggtctggacgtttatttttattcaggaaatatgccttatgttagttctctgataatttgtatccttctccagactctgttccctctttttggagttcctgttcctcctgctgctcattgtcctagatattttaaatttgataatttttctcccattttgctttgggctttattgttgcatttgggcttctttccgggaggtcatttcaactttatctttccacttcctgtggacattctcatctctgtcatgatttttaatttccaaaagttcttttttctttctgttctttgagtgttctttttttctcagtagcaacttattttttttgagacagggtctcactctgtcccccaagctggagcgcagtggtgtgatcatggttcactgcagccttgagccctggggctcaagtgatcctcccacctcagcctcccgagtaggtgggactccaggtacacgccaccacgcctggctcatttttttattttgtggagatggggtctccttatgtggtccaggctggtctggaattcctgggcttaagtgatccttctgcctcggtctcccaaagtgctgggattacaggtgtgagccaccgcacccatcctcagtagcaattgattgttttctgaaggtagtagtattttttacttcccatagaatttgaatcgtgagtgtaggtgtgtgtggtgtgtatgtccgtgtctttgtgcatgtgtgtgtatgtgtgggtgtgtgcctgtgtgtgtatgtgtgggtgtgtgcctgtgtgtatatgtgggtgtgtgcatgtgtgtgtatgtgggtgtgtgcatgtgtgggtgtgtgcatgggtgtgtgcatgggtgtgcatgtgtgggtgtgtgcatgtgtgtgggtgtgggcatgtgtgggtgtgggcatgtgtgtgcctgtgttgggagtgttctcctgcctccttcctgtccgttctcctctgcgctcctcccctcctctctgggctgctgcacagtgagcctttccctgactgctctcacgcaggctgacttctgtgcaagcatggagcaccgagaagctgctgaaaagctgtgtacatggatggctgtgctgccagggctgtgcatccacatggggtgatctgtctggattgcaggttctggaggcgcccagatgctacagtttgagagttgagtcctccaggctccggccagcctcctggaggcgcatctggaggggagaggggacttggcgcacagtgttgagggcacgcgctttcgtgggcctgtttccgccctgcgcctggagctccgcacccaccttctcagaaagcacatctcatgtgtgctgccgtgggaggcacagggttgtgggggtcctgcctgaggggtctgcatgtgaacttccaggcagctgttcagaatcagctgcctgccacagctctgcctcacaggttggggcgtgcccagtccctccgccctaggatcctggtccagtgtccatcagaccaccagtgtccacgcctcagtagcctctggctcagcccagcattgacatatctgcccatccccactcccgttttctttgtccttcctgtttgtgcctttttcatttacttcatttcagtggggtttcaggagggagcagagatgcacgttttaaccccgtctgtcctgtttcagttaaatcaaaactgctcgttgaggaaatgtttctgcccctgaccacatttctccattccctcaggacgcagaaaggctgcgtgctctccttcctgctgccctcctcaaggccaaagtcatggtggtaactgctccccggcctcatgcagccttcttatctgtccctcattggcacacaacctgttccttgctgagaactttgtaaaggggggaagtagtggtgccagcattgtagaagttctactcggcttctggaaagatgggagggatgacccaggacaggtcagggcaccaggacagagaagattcagtgtttgaattgaccattccacacggccactgcactgagaaactttgattgaaaagctagccactggaaggttagtattcacctggcggctcatttcccctcccctggcacatcaccaatgctagtccagcttttctcctgctcctcagagacctcctggctgacagctgtctgagctagcgtcactgtgacgtgttacgcttcctcacctgggtttcgtatgtaaagaaagggtggattttagaggtacatgagtttggatgttagtctaggacgtctcttgtgttctggtgtttgaatgtaagtcggctttccttctgccatggaccacttacctatctgctttgaaactgaactgccactggtttggctttaagaagttcccagtatgcaatggtgtaacaaaacctgggttgaaaatgagccgttttagctcatcagagagaagatggtagaagagtgggttctgaaagcagtggtgtcaggcaccgcgtgaaagagattgtaggcccactggtgagtttttaatactgagctggatcataaatctgcatatcagaatgctgatacttggattaaaatatttggtttttgaattaagccgtatctggaaatgtttaatggccactgcttttcctctccagggcttgtcagtgagactaatggccactgcttttcctttccagggcttgccagtgagactaatggccactgcttttcctttccagggcttgtcaatgaggcagatcagattcaggttcgacgggcagccaatcaatgaaactgacactccagcacaggtacggagctggcttcgcgtggttccagggcgacttccgatttgtgcggggtaactgccatttgggatacgcttatttgagaattgtaggtgggagctcatacagaatgccttaatgatattgattattagattatttatttttcacattttaaatttaaattttcaaatgagaaaactgctttgcagacatcattcttgctgtttggagatggagccaagtgctgggcccgtcctcactgtaagggaagcgggggtgcaaggaccactcagcggccccttcccactcattgtctggacgcttgctgttgtagcccgtgtgcagcttaggggccagctggattcttgtgccctttaagcatcttgcacaagtgacgtgggtgggcagaatgtgccataacccctgattatcagtctgcacagctcgtttctctcaggcacatgcagacatgaatgagatttcatctatcacgttgcagggcatcatactgtcatggaaagagctttggacctggaaacagacttttttttttgagacggagtctcgctttgttgcccaggctagaatgcagtggcgcagtctcagctcactgtgcaagctctgcctcctgagttcacgccattctcctgcctcagcctcccaagtagctgggactataggtgcccaccaccactcccggctaatttttttgtatttttagtagagacggggtttcaccatgttagccaggatggtctcgatctcctgaccttgtgatctgcccacctcagccccccaaagtgctgggattaaaggcatgagccaacgcgcccggccgaaacagagtttttttttaaacttggttcaagttgcagctcttgtcatttgtcagctgatggccccgtgaccaagcatcacttcatcttgtggagtctcagttttgtctgtccataaatggaaccaatacctgctttttctccctttcaatgttgtgagaatccactggaatgttttatgtggaaatatttttgcaaaacatttaagattttaaatatttactattcagtatttaataaatattgaaaacatctttgcaacaagtatccatttgtacctacttgaggaaacctacacaccgctgaggcagtggcagctctgggagtgttcaccagggagaagctgctgagagcagctgagcagggagggcctcgtggagtctctggggcttgactgggggtcagggggctggctgtggacaggtggaccgagaggcagagggagccctgcctgggggctctccctccagcccatagtgtcggtggcagggtgagggtggccgacagccctgatgggactcctttccatctgggagcatgactacttccagccttgctgagtctgtgtaggaactggcagaagcttcctcttgcttagaggatggaagaagatcagggtgggtgttttgcgcccactgtgtcaggaggagagaagtgagcgggggtgtttcactaccttgcctgggctttaaatggggaggggcggggagaagctggcaatggaccctcacttgacgggcccttctgtgagctgggggctttggctttcatggcatggtcccccgcacttggtataaagcgcaaggctcctgtgggtcctaggactcagtgctgctaatcagatgttcttaattagaatctgattttgtgtaattttcagtaagaattttagacatttcagtttatcttctagactcagtttttctctcagttaacattttagctttgaatctgcttttgtgagttttgttaggggaagcttgctgaaccgtaagggctgtagtgagcatacagcaatgcctcttccatgcgtgctgagctgcagtgaggggacggacaagagccaaggtgtgaccaggtgatgtcgctagtgtcagggaacactcatgccagtgaggatcttcccactctctgatgaaaactaacaggctcccctctctctcgctgtgcctgttgtgacaaccatgacagctggagatggaggacgaggacaccatcgacgtgttccagcagcagacgggaggtgtgccggagagcagcctggcagggcacagtttctagagggcccgtccccagcccgggccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcggggtctgaggcccaggacccacccccctgccacccctcccaccccactccctgctcagtacctggcgttggtacacaggcaaggattggcacaaccaaaattggcctttttctccctcttaatattgaagaaattcccacatttctcatttggtaatggtgttgtggcctcagatttcttctagtatttgcttctgatgaatgattatggtctatacataaaaaagtaagactaagtattgctgaatttgcagttatgttgtcgtgtataagagctacttccaagtgtggttacaaatgaacccatggaatgatgacttcatgttcttctcgtgggtttgtgccgtgctgctttccaaataggtattgaatttatgcattagtctggtgatttcagttctgtgaaatattttgggatctataccaattaaacattttcatagttctgcctattgtccttccctgaggctccattgctgcttggtggccattctctgcctttttacagtcacctgaacaatgacccatcatctcttgcttgcttgaaatcttgctgaaatgttctcatttcctgtttgctgtatgggctcgggtgggatgtttgttggctctgttgtgtttattcaccaatttgtacattatttgttgtcctttactactgtaaacagtaaatatagtttggtattctgtctcttggcttctactaaacactgcatttgaaggttggggcatactggtacaattcagtgtttgaattgaccattccaggcagccactgcactgagaaactttgattgaaaagctagccgctggaaggttagtattcgcctggcagctcatttcccctcccctggcacatcaccaatgctagtccagccttcttcctgctgagggatgcatcctctcctcagagacctcctggctgacagctgtctgagctggcatcactgtgacatgttaccctccctctcctgggtttcgtatgtaaagaaagggtggattttagaggcaggtgagcttgggtgttagtctaggacatctctcgttttctggtgtttgaatgtaagtcagctttccttctgccatggacaacttacctatctgctttgaaactgaactgacattgatttggctttaagaatttcccagtgtgcagtggtgtaacaaaacccaggttgaaaatgagctgttttagcccatcagttgaatgaacccaaggtgaagaaagatgggcagctgtggagatggaacacgtgattcacttgcaccaggaagagtgcacggattaaggcacaatacaggatggggacatctgccagattccctaggcagcctggggcgaagcggctgccaaaatcaatgaggaaagggatgtgtcccaggcaccgtaggttagataagaataatggccaggagcatatgtggatgtattagggcagcgctgcttgaacttccacccacaacacctcacagcagaaccagcaggatgtcctgtctttctaaaaaagatttgtagagatggagctctcactatattgctgtattagtgcatcctcacattactataaagaactacctgagactgggtaatttataaagaaaagaggtttaattgactcatagttctgtaggctgtacaggaagcatggctagggaggcctcaggaaacttataatcatggcagaagaggaagggcatggacacaaatccaaaccataaatcagttgcccaagctgatctcagactcctggcctcaagtgatcctcgtgcctcagcctgccaagtagttgggattacaggcatgagccatggtgcccagcaaaggtatgttcttgaagttgtcttttttctgagatttatgcaaatggtgcatttggaaaaatagatctgttgggattactattttcaacaagattacttatgtgaaactgactccaagaatctttgggttaaattgatgctcctggaggagagaggccctatttatcctagtatctatgcctggggtcccaactggaacttctccagtttttgcaccgaaaggttcacatcccaggaacccccactcccagggaacttgagttgtcatcttagccatgctgcaggagtgcccagctggaaacgcgtgatgttcatgggaaaaccccaccgtataacatgggttaagctgtgaggtcctttttatatttcagaactttagttgctaaagatagaaagcattaattttattctgtacagttggcctccccagggtgtgctgccctgcagtatcacacactggctgctcagagtccctgggactccactaccacttgatccaagttgagagttccacgagttagccagttaaaacataggatgcccagctaagcttgaattccacataaggtactgaacgacgtccctgaaatgttgcagagagcctggttctctgaagataaggtgttgtaacagtcctgttgaggggagagactgccatcttgtttcagcaactcatatttcaagtgacttttgtcacttgaagctgaagctaatcctgatagaagctgtaaaccacatttctgaaaaataataattggaaaacatacagtgttctgcagtaagatgtctgaaaaagatggataaaattatgaaaacatcaagcatatgttgcagtgaacatcacggcattgacagtaatgct
